United States Patent 7,868,149 (PLANT GENOME SEQUENCE AND USES THEREOF) - sequence listing, part 66

SEQ ID NO: 36024 - DNA, 812 bp, Oryza sativa
attcgcgcttggtttattactgctgtacccgatggcgcgggagctgacttgctctgcgtggtttggactttggacctctgccgtttcatttggtttcggggacacggtcaaatgacgttcagctcgttaggtatgtgagaaccatggtcaagatccacggccaaatacttgcgctgtgtggctgctaaactcgattgcttttctttgctgactagttctaactcagttttgctgttccctgtccattagtagtagtcgtgcacatctgtcgtctctcggcaacgcgagtatctgatgaggtgttttgaactgttggcgtgtagccacgcaaggaggcttgaaagttttccaggctatgctgatgaaactgaacacgtcagagcccgacaggaagaaatttgattgtgcttactcagtcctttttaggaagggctgccggaaaccgatttgattcaatcagtatgtacagttgcagcactgatcggtctggtattgcttaaatacacacatatatatttatttccccctagtaaattacatttagaggatatgaatctttgatgatgtaaaaaattaaaattgtatacaacatttttctatgtgaaaaaaattacagagcaaaatttgctgtgtatcctacaggagtacatcctttcctcccatctccagtgttaagggacggtacccttttctgcagccatctgcattcctgggccctccaaacaaataaccaaatgtatcaaagactacagtttatcctaggtacgtacaagtacaaaacccccctaaactacaatttccgtcgtgtcatg

SEQ ID NO: 36025 - DNA, 46164 bp, Oryza sativa
  unsure (1)..(46164): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnngtgttcgtgaaaagaaaatactttgccggtgtaagtacagtgcggactgcaagaggcagagcaccggcgatcgatcaccggccgacgtgcgaggcaggcaaagagacgagcatctcgagagaatcacaatgtcgtgtgtctcgtcaactcattattgtatctgtataaacactcaaaagtctcctctgtataccttggatctctaaaaagtttcattttcattccttgggatgaagaaatggcagctataacatatccagattcattgtattaggagatgtcgcatccttatctaggttgtgcttttttttgagacagagggaatattccactactttcgtcaaaaagggttaaatcctgactatgcatctggacaaacatttatctagatttatagtcaagatttgcggagccatcatttggcttattcgcggaataagagaaatggcatatttacaaacgaaaagtaatttgtgaataaaattttatatacgtgttcttagcgatataaaagcaaagtctgaaaaataaacttcgataaaaaaacctcaaaatcacctctaaatttaaaattgaaaattcaaattttagctgataagtataagcataagcgagaaaagatgaagcccttgatttttttttatggacggaagaagtagtactgaaaatgaaagacgctcattgctcaccctggatataaactaactaaaattaccgatttgatcaggtaagtactctgtcagcattgatctttttctttctttattttcaaaaaaggcgattagttgatgtactagtactaatgcgtacgttctagcagccatcattttctgttaggcattgatatgttaccggttttgttttccttgcagctcacatggagagaggagaccatccatataagctgaaacgtacgtcctttctttcgtacgagcgtgacagatgatcacaccatctactcctatattgcaggcatcaaaattcactactttaattgaaacaaattgtttgcttcagtgcttcacactttatgttcttttttttttaaaaaaaactttattctactgtatattatttagaccattgattttaattttattttcaaaatattcaattcatctttacaattaagtaaataatagtatggtgatgtgcgtgtagctgtagctaaggtccatggcgtacgatgtggaaaggcgtatttgcgtgtgtaatcttcaagtaatcgcgcgcagctcgtactcaaagacgtttttctgactggttttggtgtctctagcacgcattctagagtggcaaaagggccgttagaacttagaacttagaacgactggctgtccgtccaagagggtaaacgaaatgatataaaaattgaaggaagagtatatcacaaatttgcagcatttttttcttggctaacatttgatcatgcgaccatatatcggggctaactttttaagccacgtaaaagcaagcagttgtcattgcaatctaacaagtataatgactctcaaaataatagcctagatgtattgtatttgtttgtttataataataaaataacctcttgatttgaaaccgaaaaatataatgattgtaaaaactaactgcataaaaactgttgtaacatagtttcccgagtgatcggactaatcaaacatatttgattgtctgcggtgatgaacaacgcaaaacgtacttatgaccaataacctagcaattatgcttataatgagaacaaacaaaataagttgaaatgttgaatcatacgtacgcaacaatgttattgaccaaaatgcacttaattgccaagttcatgtaccggtctgcatatttttcaatttgttacactaaatcacatccacctgccaagttcctacactacgtattaatttactctttttgaaaacatgaaacaaataatctattccattaatccgataaataaataagttgaaaagaacatcgccgttactagggatgaaaacggacggaaattcccgatcgaccgggcgccgtttccgtttaaggggtacagtttccgactgtaccgtttttggctatttttaaattttgttttttctaatttctttctacatcgtattaatgtcgatactgagtagtttaaatgatagatatggtcaattaccggctgatcgagcatcgtttccgaagagattctaccgatttcgaccctttttacccgtagccgttaccatatcttcccctcttgagccaaccatcccagatgttgttggtaggcaccatgtccatggccatgcaaatcagtccatgccccagtagtagtgataataagtcaagcaaagcaccaactccaacaacggaccacccacactcacactcacactcacacagctcccttcccttcctgtacacgcaaagcccaacaaaaaagaggcccaccacggcccatccggcccaccccctcgtctccctcccttttatacccgcctgtctcgcctcactccccccgacctccacctccacctccacctctacctcctcctccgccaccggcaatggcttcctccgacgccgcggccgcgcaggcggcgacgccgctgctgaaggacgagctggacatcgtgatcccgccgatccgcaacctggacttcctggagatgtggaggcctttcttcagcnngtaccacttcatcatcgttcaggacggcgaccccaagaagacgatccgggtgcccgagggcttcgactacgagctctacaaccgcgacgacatcaaccggatcctcggcccaggggcctcntgcatctccttcaaggactccgcctgccgctgcttcggctacatggtctccaagaagaagtacatctacaccatcgacgacgactgcttcgtgagcttctttcccccttccacccctcgattaacttcgcctcagtgagatctgtctctgttaaggtttgatctgctggttgatggccgctggatcttgggcgatctttctccactgccatggcgtgatctgtgtgcggggattttagatcttggtttggtggggatcggatctggatgtgtagttttagtgggggaaaggcgagatctctgggctgtttcttcgtcagcaatcggcattgccccgtagttagatttttgagtttagcttcagttttgcgagattagtagttctttttgttaggacagtttagtttagtagtgataaaaaaaccctttaatttttgcattacatcatactactactattactactgcatagtgctgtgatgtgggtaggttgaatgtgaatttcacatgttgcggatgactgattgatctgcctagttgaaaaggtagtaactccttaatccttggaatcatgcatgtagtctgccattatcagatctgacagtgtttgctttgtcttggattgaacgtttgacttggcccactgcttggaagcatcaagcattggatctagctacacttgcttggtggtcatgtataggttgcggttgcggttggaggggatgtgagctggaataggttatatgtatatctgtggtgccccacaggtttgtagtattcagaaattgttagtacgcgacaatgtggctcggatatatcgtcctgccgctgtgctttgtcggttgtgttaatgcatatgtacgcttatattactttgtttatgctcgaggccgttatcagtagtcttttcttcagaacatatcaatgtagaaacagtagagaaagggtcaagttaatggtgtcttttggactgaatggtatgtccactttggtttggggtcatcttggctttgttattggctacacatcattttccagatttgtatttaattatgattgattcctttatacaaaaacgttaatctgaagttagacaggaccaaacaatccatctaaatcacatgtgatggactatgacatcattaagcctcggtcactagttatcagttaagagccagtggaacacaaattttgtaggaattaacataaaggtacatgaaggttatctcgactgtattcctatttttgttttacttctacaaggaaaaaaaatactgttggatgtattcagcggttgtgttgtagcttcttcccccaaagcaaatgccatgtgtattcacatggggcacatgagccacaagggtcccacctgcttgttaaattatttgatttatatgttttattaggctggcttatggatgcatggatgtactgtagaatcaaccttaactatatgaatggtcctcagttgtttacagcataagaatatagtcatgttctctttcatgtcctttagttgcattctagtatgatcttcacaatagttttcttgattagcttacagttgactgagtacttccacatgccttgcactataaaagttgagcattggagtgtgatgccattattttagtcctctgttttgttacttttgggtaatgctaatacttctctgattccgccctatcatttgtttttggttcattgctgacctattcctcttgcaaaatctcaggttgctaaagacccatcaggaaaggatatcaatgcacttgagcagcacatcaagaaccttctgaacccttccactccatttttcttcaacactttgtatgacccgtaccgtgatggcgctgattttgtccgtgggtaccccttcagcctccgtgagggtgccccgactgccgtttctcatgggctttggctcaacattccagactatgatgcccctacccagcttgtcaagcctcttgagaggaacagcaggtattgatgttacatttttggcatttctcatcctttatcgttctcttcttgccaatctgatgtttttgtttattgatgatgaaatcaggtatgtggatgctgttatgacaatcccgaagggcactttattcccgatgtgtggaatgaaccttgcttttgaccgtgacctcatcggtcctgcgatgtactttggtcttatgggtgatggccagcctattggtcgttacgacgatatgtgggcaggatggtgcaccaaggtttgttctttctcccccttcagaaataatttgtgcattgtgcaagctaactattgttcaccactcaccaatcacaatccatgctaatatctgtcataaaaacaggtgattaccgatcacttgggtttgggtgttaagactggccttccctacatctggcacagcaaagcgagcaacccctttgtgaacctcaagaaggaatacaacggcatattctggcaggaggagctgatccccttcttccagtctgcgtccctcccgaaggaggccgacactgtccagaagtgttaccttgagctggccaagcaagtgagggcgaagctcgggaaggtcgatggctacttcaacaagctcgccgactccatggtcacatggattgaggcctgggatcagctgaacccaccaaagggagctgttgccaccgcaaacggcactgccaagagcaagtgagagggcggtagtataaaaacttcgtttgttcatgtgaactgcttatactgaaataccgaaatacttttggttttgttagtgctgattgaactgagatcgcttcagcgttgtaacttcaaatgtgtcacctccctggacaaccgtcctggctgttctatggtatttacaattttttttttctttttggtgtgatgaaacagttgtaatgtcaggatcgaatcaccttcaaattagaataaagatattggttatgtttacatatcgcatcatgtgttttgttggtgttgtgcagttatgcttcctttttgtagtgccttgataagacttgcattaaaaaaaaattaaaccatccctggatgcaccaattttatgtcagtttaaattatctgttcctaaattttgtctctccagtgcacaagcaacctgcttggaattgataataatacgatagtaatcattttatcaaagaaatcataggatttacacttacacatacatggccccattgtaaaaagaagaaagaactgccttcacctacgactgcatttctgaagtttttgcttatctgaacaaacagcaaagaaaacacattattttgaagcttgaagttcaaaatcacctcctgtactgtaaagttgcggaggagtaccttttccaatttggaaattatcggctatttcgtcatttaaaacacaaatgcatcttgcatttcaagtgccaaaaaaattaaaaactaattcgccgttgccggggatcgaacccgggtcacccgcgtgacaggcgggaatactcaccactatactacaacgactttgttgttggcagttctaggaaattattttttatttatttacttccagtgtttaaaaggaagagaagtagagaacttcccatgaatgtgcagtacacatatgaatatatataatagaagatggactcttccacatatatatatatatatatatatatataggacactcatatggggcaccatggtgcccgggcaccatggtatctaatgcacaaaatcactcaaatttttcaaaattttcaaattgtgagtatatacctagttataataatttgatttatacctatacttatcaacaaaacaactcaaatttaactttatttcacaatccatgattacatacctaacaaattatatgtatggatgctatatacctagaatcaaaatctaacaaaaacaagttcaaattcagttcaaacttgctttaaactagttagtaaagtagttaatgttaatacctaagtaattgaaaaagtttcattctcatttgaattgggtatatactcaatttcaacaatggtgcccgggcaccatggagcaccaaacaaatttactatatatatatatatatatatatatatatatatatatattgtatatatatacttctctttctattccctctatgccaatatataaaatcctagtactggatataaatcatccaagtattatgatatgacctccattactaaatacttatacattgaaattgagagattacgccctatataatgtccaacttacttttacttctactcttcgaaaccaatagctcactcactctgtctctcaattattgacttggaaggctcttattaattccttgttggtggtcacggctaaaatttaagttttacttccttcgttttacaatgtaagtcattctaacatttcctacatttatattgatgttaatgaatctagacatgcatatctatctaaatttattaacatcaatatgaatgtggaaaatgctagaatgacttacattgtgaaacggagggagtggaacttaattttaattttagagtcagttttagcttttttttacctagtctattttctactaccgtttacttttaaaccacatgatatagatataaaggtttaaaccgtaaattattttgattgttttgttcatttttctacctttatctcaaccaatcagagccaattggctcacggctgtggaatttactggctgaggtatccacttcagtactaccccatctgaaaagttttccatacattgattgaatggacagaaatgcaagaggtaggggcctgggagaatcaccaataaagcctgtcaatccaacgtttacaaggacagtttggctgttttcgccgaatcatgaggcagggtactccagcatcctatggtgaacagtgagtaacccataagaagaggattgggatcaggtgcagtcactaactttggcagtagcaactaatccaaccatccaactagtaaggaacgttcagacttaattgcctccttcctcatttagcatttgaacatgaaatactagcacaattatttttcatttgacaagaaatttagtactacttatttagatgtttaaaagaagcttggcatttattttaagggcttgaagtagagctcatattttgatgtaactcctttaaccttttttttatgtgactcatgctctgttcaactaagaagcattaatcctattgttttttctttacagtttctttttttcctgaatggaacattttctttaaaagttatcaatagaagcttcacactgatttacgggaagattttggagtagtagtttagtttttttcttttgactcagtggatgcattattcccaaacacagggaaaagttaaactcactagctcatttgtcagtgctatgtacaattgtgcaaaatattattgagtgaagtatgtgtgcattttgtttataaactacatttgatttctcttaaatttgagaaagttgagataaagaaaacgagaaaacatttcatgttcaaatagctaaaaggagggagcagagacaattaatcctggacgttccttacctattggatggtggatcagtggctactgccaaagttgcagtcgtgactgcacctgatcccaatccataagaagaaagaagaaatgtaaatctttttgccaataataataataataataataataataataataataataataataataataataataataataataataataataagtggtaggagtagtacacgttccgtcccaaaatataacatttttttacatttagaacttattcaaaaatataataatttctttctaaaccaaacacatcattcaaattcaccacttactttttttctcaaccaatcataatctccttccatttatttcacctacattttttttaatacatatgtccaaaccgataactttttatattttaggacggagatagtaattttcaaaccacaagttccaccgctacatttgctccatctctcgatcacacacacacacatatgccatgagcttgtcaagggctcaaggccatataaccccaaacacccaccagtcctgaatcctgatacaaagatacgcaaattttacgtagtagaggcatcatttcaacacttgagaggaagtagaggcataaagtccactaaacaatgccgcggatttaggagatttttttagcatcggattagcaacgaacggacaatactatcaatttgccacagtttgggcgaatagtctgagtttacgcagtttttacactgtggcactgtgctcattttactcgattatgtgcatatttgtcattatgcctgaacttttttcagctatgacagcagaaactcagcagattatccccagacatcaacatgacaaaacagttgttggctgtgtacacccccaaggtgtaaaggccgggttaatataatcctttatcttaacaaaagaacatgacaaaacagaggattttaatcaggcggccactgttatacagtagcttgcgagttgttgtctatgaaaacgagacgtaggtacgtccaaacttaaaagaggccgagacagtgagacataagtaaaataggcgaagttggtaatgtcttctgtttgagcaatactctcacatcactgtatcacaaaataaattcattttttatctattctatacataccaatagaaaaaaagaactataatattctcactttatcaaattgtaatagaattattctatactctagctatctgtttccaatgtgtttataaatttattttagaataaataggaagagaaaaaaaataatctttttttttctgagatactatagtagacatgaacgtgagctcagcttcagtggtcacaactcacaacctgcaacgacgtaaaagccacggagaaagcaacaaatctacctctgaatcgtcgaaatacggaaccataaacacatgtttggcatatagagttaatgtaacctcgtacaactgcagcacaagtggccaggctccattacttcatcggggtattatacggtgggtaatttcttcacctctttaaaaatacatgaatgtttagacagttttttggaccatgtattaaatgttgacattcattaagtttctctctataaatatctaatttatcattacgataaagcatagtccgtttcacagaaaatcaaactaaatgtgaataagacataacctagctagtataataaatctagataacctcttattcagatttgttatactatggccctgtttagttctcaaaataaaaattttcacactgtcacatcgaatgtttggacgcatgtatggagtattaaatgtagggaaaaaaaacaattacacagattgcgtgtaaattgtgagacgaatcttttaagcctaattgcgccatgatttgataatattgtgctacagtaaacatttgctaatgatggattaataaaattagacttaataaattcgtctcgcagtttcttggcagaattgcaatttgttttgttattagactacgtttaattcttcaaatgtgtgtccgtatatccgatgtgataaccaaacctaaaaatttttcccaactaaataaggcctatgttactttctcctttcatgcgtttgatcaatgcatttgtgcatggcagcaagaccaaagaggagaagaaaagacaccgttccttttccgggctttatggcatgcatatgaatgaccaattttaccgtcctttaaaagctaatatgagatatcaccttttctattatgaatttggtatctcgtataaggtaccgaattttacacgaaatttttagtaccccatggtaccttctcaacaactgtaaaattactcagcatgaatagagagggagtaaaccccatctaattctaagctggttttttttatagtatggaggggcatagtatacggtaataatcggttcaataattccaaaccgagccacacacgtgaaacagtttcatgtgatgagttcagtggatcggagtgcagagactctctgcacgcactgcattcagcagctagctcggagcttaatactacctccatattttaattttaatgtacaacgtcgttaacttttttataacgtttgaccattcgtcttaataaaaaaattatgtaattattatttattttattatgatttgattcatcatcaaatgttctttaagcatgatataaatattttcatatttgcataaaaaatttgaattaaacgaatggtcaaatgttggtcgaaaagtcaacggcgtcatatattaaaataatacggaggaagtactagcctcggactagcgatgtgtccttctcccagccgcttgttgttacggccacatcgatcgatcgatcgatcgctgcagctgcagctgcttcgccgaccgatgattcgccgacgaggacgtacgacgacgacgacttcattgcgggcgtctcatgattcgccgccgctagcttgcgatcgagcacgtcgtcgtcgtcctcgtctccgtcgtcgccatcgtcgtcgttgtcgtcgtcgccgtcgattgattggtgattgaattgatggatgggggtggtcagtggcgttggcgcctccgcgtcgacgggagaaagagagagagagagtggagtgaggatgatggattaggatctgttcaggaggaggcggcacgtaacacaatgttcgcattaacgcgtgattaattaagtattagctatttttttaaaaaaataatagattaatatgattttttaagcaacttttgtatagaaacttttcgtaaaaaacttttgtagcaacttttgtatagaatctttgctccaaatgtgatctcaaggtggcgtccgtgcgtgcatatgtgtggccgaggaaggaagacgtccgttcttcccacgtgccggtggccgtttctccccccgaccttttcatgtttttaagttctactcccttcatttcgagttaaaagacgtttttactttaagttggatcaggtttgtagaaaaaagtagctagtaacattttcaacccaagacaaatttattatggaaatatattcaattattgatttgatggaactaatttagtattataaatattattatatttgtctataaacttagttaaacttaaaatagtttgactttgactaaagttaaaacgtcttgtaacctgaaacggagtgactaccttcgttttcatattaagtcgctttgatttataagtcaactatgttcaaatttaattaaatttatagaataattaaacaacatgaaaatagctttattatatctagcattaaatgtatatttataatatgtttgttttatattagaaatgtttgattcgaaaaaataagccagatcatcatataatatgaaatggaggaatttgaaaacttcaactcatcggtgccttcctcggtcaattatggtgcagtggttagctggtactagtacgtatcatgatgttgatcgtgtacctcgtattatccttgaccaagtgaatattgatgtgccatccaatgtacctgtccaagaatatggatccattcaaaaggacataaaagaatatagagtgttgccgttccccggcatttccatcggaaggaggactgtaattacccaccgtacccttcaatcgcgaaaacaaccttacacataaatttcttcttaaagatatttagatggtatacatgaaaatcacgtgtgtagatttatctcagaaagtacttttacaaattgtgattttattaggtttctaaaaaaaatgcaatacgaagtattagcggaaacagtatttttaagactatgtcagaattgctttttgtttgatgggagggagtcaccgctagaaaatcgatttttcatggcgtttatctattttttttctctgacgtctataagcgaaaaccgccagcgaaaatttaacgagggatgaggtgctaagaactgccagcgaaaaaattcattttcgttagcggccgggataagagaaccgcttgtaaaaatagaggtctttttaaagcgggcctcttaagtgaccactagataaaatcaaaatttcgctggtggttgccaaggagcgccgaccgcaagaagttattcgctatattaaaacaccaagtgcggactccattttatccactgactagtcactccatcttatcctcttctcctcaccacctccctccagattcatctcaccccacctctcggctctcagctgacacggcggataagatgacggcgatagcggaccgcgactgcggcgactgtgaaatcgacgcgcgcaaaagccgggcctcccccctccccctccccctcccccgcgcgctgcgataggaggcccagatctgggcggaggggagacgaccggtgggtggcggctgcggttcgtccacggtgagctcatgcatgggggcagcggcgcgcttgaggggacaacggcggtgggcctggagcctgtgaagcatgtgggcatggaggtggcggaggaggcagcggctggatccagtttggcggtggcgggggccggatccaactccgtccccgtcttgccttccttttcttcgacagcgcagacagcgggaggcgccgtgggcatcatatccggccgccgtgacgggctccctccccaccgccgtgacgagctccttcccacagagggtgacgagattggcggtgtcgagctctctcccctctccaccggcgagatcgagccgccgccacctctatcggcgcggatccggcctcgttcttgccagatctgtgcggggatgacaagggcaaggaggagacgacgacctcgatggtggcagtgaccgcgaggaggaggaggccgccgcaagccggtcattggcgaggcccaagaccatgtgcagcgtgcatcgggagggcagatctagcatcggcgattgtgcatgttcaatagttgagatttgcttatattttgtggaatttgtgcttgtatttgtggcatgttcttggatttgatttgcaatgtggaatgggaatgcagggttgttgtatctggcaattttcaatttttctttaattttctttgctggtggtcagagaacagatgcattaacatattttcaatttttttaaccaaaaaagagcttcgctggcggtcgtcttaacactacgtaagcaaaaatggactgttgccagcagcccatgtaacagaaccgccaacgaaaatatgttttttggctggcggttaagttccgaatgtgaaaacgtttattttctctaccctttggtttcaggcggttaacctaactgccagcaaaaatcagcaaagactgattttggccgacagaaaaaaccattttttagtagtgagtaaggctggcaaaaatcaaagactgattttggccgacagaaaaaccattttttagtagtgagtaaggcttcgtttgagaaggcaggttgcatgttctcgtataactagaacaaccattagagcatgattattagccattataaacttaaaaagtagagttctttgattttttttaaaaaatatgtaaatatttttttttcacaaaacacaatgtttaactatttggaaagtatgataacggaaaataagaaaattgtcattattgctgaaaagaactcaaactaattcaccttatacatttttcatttcaacagaaagcacatactaatacaactactcatcagtttttgtgtgagaggtggacaaagatctcgaacttgtgagctccatttagtctcacatggcttggtttcactcataagacaacacgtttcgagaatgagtatagcccaagctagctggcgagcccactcatttaactcatagcacattattagtctagtggtcaatctagttaaagaaagccgaagttcccaacctttcctcgcaccctgtctcctattccctatctcagccatgctcctacccacaacactgctttcttcggttcaacacatgtcatacttgaggctgcacgtaggcatgtcgactccaccaattgaaggcatctctagcctccaccaactcgtcgtgttgcctctctgcttgaccaaactatagaaagtcgctgctccttggtgtcgctagcttgtgctaacaagcacaatgtgcgagttgccactcacctctcgcaaagttggtgcggctggtgcccaatgacctgtcgcgcgccttgttggtctcgactcctagttgccactcttctcgtcggctcctccaatatcctctcactcctcttcatctctgaaagtattttttgttcataggctcacgagccaactagaggtcaagaagaagttgagccaagccgagctactcttttagcttgtgatgctaatttcagcagagcctagctcggcccgacttgttttcacccctaagtatgctaatcaagtatatgcgtttggtgccattatatttactctatttttttcatgctagctgcatgtgtgaagacatcgctattgttttttactcctaccacatcatcttaagtgatagtcccgataacttttatccatgagatagcctaccatgtcataaaacaccttgaatctttccacgttgcttgtaacattgaatgataaggtggaggatatatgcaaggggagagatgataaatcgcctagatctcatgcaagatgcaacctttgcacaagatctaaggaaaatacaaacagtagtgggaaaacatcgtctgtgtggtggtgaagtcgtgggtacgtgacttcagaaatagctaatatggttcaaattctggttccaataaacattccacacacacggatgtactttcaataacattatagtgggaccagggatgtgcttctggtttgcgagtgagaggcacatttgtgggtgtgtgagcattgggagtgggaggtattcatggatgtgggagtgtggtctgcatgcccacgcgtctttcgtgtactcactccgtagccccccctcccccctcacaaaaaaaataaaaataaaaatctggatacacatgtgtccagattgatctctggagtttgatttatttttgggatagaggagtataatccaaaacaaaaggaaggtgagagcaaaccaatatgtatattttcatagtttgtttatcaaaggttgctctaatttatacatatttttcgttgaaatggctccatcgcttgtttgttaaaggccatgattattttccattatctttaaaaaaatatttcaacatgaatttaacatggtaatccttttagacatggctaacattcgtttgtgtagccagtggcggagccaggattttaaagttgggtatttccgtctaagcgctgagccgctagctgcccctgcccctcgcggccaccggccacccaatcggcctgaccgcctgagcttggcggagtggcgggcgccacccctccgcggtagcacggtccagcttccgccgccggttgccgcctcgccgcgccgccacctggggtttggaaatggggagcggcgcgagggaaccgagctagggagggatgggtcacggagggagagggagagggggccgtatggaagagtggtggctaagtgggtcagctgatgtctgatgggtcatgacggagtgggtcgggttggtaggaggcgttgcaagaggccagttggactgtgtttggatcgaagaattgaggatttaggtgcactaatatgtgtacatgtgtatatactaaaagtatacttgttttttgataaaaaagttgggtattcccgggaatacccaggaatcatggtagctccgcccctgtgtgtagccaaaggtcatttacctatctgcaattttgcaatcaaccacggtagcatagcaatacaaagccacaaggtagttcatttttcttgggctgtggagaccagttaatctattactccctttggttctatattaattaatgttttagacaaggttaaggttaaacttttataactttgaccatcaataactttaaaaatatttagtttaaagaaactagaaaaacatatatagatttgtctttcaaaacactgtaataaaagtaaacatgtatttatttattgtatatattataatagaaaaataagatccaaggtatatcttgtagagcgtgtcattgtccaaagcgtcaattaaaatgaaaccggagggagtatcttaaaaaaaaaaagtctagcctttttctacggtcttgttgtccgctccttctattgttgcaacacgaactctcttaaaaaaaagaaaaaaaaatctttcaacaccaacaaacaaacgctggtactcccagtacgtgtattgtactactaggtagtactcggtgccaaacagtttggcggctatacggagttgagtagtacaaacagaaatactcgtatcgtatcggaatttctaaaaagaaaaaaataaaataaaagaaaaacctgtactggcaggtgggccccacccgcccgcttcgacgaccacacgtgggctcgccacgtgtcatccggcgtctcgtttccttgtacccgacacccccctacgttgtggaaaaagaaaaacccatcccttacgcgagcccaccgcacccgcagtcacagacaagcgggccccatccgacccaccgaccaatcccgagcgcgagcccgcgggtgcacgggttcgcgcgcgccgcgtggcccgtgggccccaccgggccagggccgcggtaacgacctctctcctgatccgacggccgggatccctccacgccgccccgaaaccgcctcggccaatcggaaatcgacaacgaggcactcgaaaccgccctggtatggccacaccgcattccacccccatctaaaaccgccttccctccccctccctctctcttcctccccccatttccatcttccccgagctctccaccctccacccgccaccgccaccgccgccttcgccgccgccgccgccgccgacgacgatggggagagggccggtgcagctgcggcggatcgagaacaagataaacaggcaggtgaccttctccaagcggaggaacgggctgctgaagaaggcgcacgagatctccgtgctctgtgacgccgacgtcgcgctcatcgtcttctccaccaagggcaagctctacgagttctccagccactccaggtacgcacgcgcttagctcctcctcctcctcctcctcctctccgcgacctcccgcctacctacgtagtacggcccatgcccgtcgcctttcctcgccgcgcgcgcgccatgggcgagctcgcggagctccccgttcctgggcggcttgttgatgcgttcgatttcgtttcgtacgggttcctgccttgtgttcgatcgtttccgctgcggaatgcgagggggctggtggtgttggtgcgtgtacgattgctattatttcgtgctgattgatttctctcatgtgctctctgattgcacatacggttcatggctttgtacgtgttcgttcgtgcgattgctgcttagctcgggatggagttgctcgcgaagtctagctagttgtaggttgcttgtgtcccctggattacagctctctatgtgatgctggcatgctgctgctgctgctgccatgcatatcagaagctagtaatatacagtggtggtacatgcactgttgctgatttagctttatatgctgctcagttttgttcttggggactcatcaatcatcgtagcattggtgaacacgttcacttccatttttttttgtataaaaaggaatggaataataggtgaaaaaaaattcatgtgcttcatcagtacgggcggaaagaaagatatgtttaaattttaattagtgtgcttatctaggtttatcatatgcttatactcttgtgtactgtagcatatacaagtgatgcttattaccaaagcctagctaggccggtaaacttgtattatttgtctcgttatttctggaaatcattagagcagcacttcagttgaaatatgcacggacgccttgctaattaagcggctcctctaaccaggccagtaaggtcttaagttactgacaactcctggactggtataaatggcgcggccagctttacatgacatatggtttgatacttttgtttagttaatttcgaggtggaatataaggtgaccagcttacttaacttgttcatttgatgcattcggtttcatttccctttttttttttaagataatgggaagtaaattaatacccggccttgctttaactgaaactacaactttcttttgtccctttagtgtgtactgtcaccaagttagctatacatggtgcaagttgccattgcccattgctattaacttgctctcacaaattggggtgtttatttcttgaaatggattttttaggacaacaataaactgattgacatagctatactgttcaagtataaccatgtttatggttttcaattaagcaaactgcttatgtttatgctaatatcttttgtttaatgggaggaatttaaatatttcattattggtattcctatactctattatttcataatatttggcaattttgaccggtgattgcttcagtttaaccattaatatcttttaaaatttatgattatgatggatgggatttatatctctatatttaccattaccatgtaacatactttaataatatgttacataatctaatactaaaagtttatttataaaattggaatggccaaactaaaacaatgcgaacttaaaatcaccaagtattatgaaatggagggagcataatatcagtagctcgtaagggaaaaaagggacctaaatgatgccttttgtgataaatataatttcaaatttgcaaaatttttggataggcaacaatactctctcattattgtgttagtattaaggtcaagctacttctatgctaccaaatactccttctgttcctttttttatttcttgtctaggatattgacattatccctaacacacatctttctttgtatgatcatctactcataaaatagttaaaatataactacattattcaattatgaatctatgaatgttatttttatacaccgagttgggaactattctaaactctcgaggggacatcccctcattatctgcatgttatccaaacggttgtgaaaaaaattgaaaaaaaataaacaagatagattaatatgtgataaatcactccacaaacatgcaaggacaaattcaaattctacaagttgcaatgaaaaaattaaatttgaccgtgaatatacattaactagccatagtttaatttttttttgttgtaacttgtagaagttgaatttgaacttgcatgtttgtgaagtaatctatcacatattaatctatcttgtcgatttttttttaaaaaaatcataaccatttagatgacatgcaaaaaacgaggggatgttcccttgagagtttagaatccattctccagtgagttgatgttgagatttgattacacatttcaaaacgacttttatttgttaacgaagggagtaatgtggattcaccatatgtactaatgttattaaggccagataatcctttttttaatcattctaattagatataaacttacgacgaagaacatgaatggataaagtttcagccaacaaatacaaatgtttttcaaagtgctatttctgatgcataatttttgtagcagttatgatttaaatttatacatggataatttgaataatggatcctacttttgtagttgtcacctgacaagccttaagaattattgagggtacaaaaattataactgtgcatttgtttgatattgctctaagactatgcttggcatcatcttttgatgcattggtcaaaccaaagcataatcatgtgatacttcttctgtagtatggaagggatccttgaacgctaccagcgttactcgtttgatgaaagagccgtactggagccaaatactgaggaccaggtaaaaaaacatccctgactgttggagaactatctccggctgtttatttaactagctggttagttatctgatcttgatattcattttctcctaggaaaactggggtgatgaatatggaattttgaagtccaaactggatgcacttcagaagagccaaaggtactgcaaactttcttaagaaattttcactttggtaacaagattatgctaacttgagttggtctatctactgctcaaggcaactcttaggtgaacaattggacacactaacaataaaagaactccagcaattggaacatcaactggaatattctctgaagcatataagatcaaaaaaggtgaaatttgtgtccattatgcactgttgactgagggatcaaatttgcttgatttaattatttccaactaatctttgaaaacatcattactttcctttttgtttttcttttgcagaatcagcttctgtttgaatcaatttctgagcttcagaagaaggtaggttaccctcaatgtggctccttaaatagcaatgtagcagtctgtttataccatattgttttggagtattaaagttgcattcaaacaattttcagacaactaactcttcttgccttctaccagaatatattcatgtaaaacatgtcttttggcaattctagaaattccattataagaagaaatcattagtcaatttgaatcacctaaggaactaacgagaagccacttgtcttggtcatattgtgggaaatgcacaatgttgtcaaatgggtataacaggaaagtcgccatcaatgtatatattctaggggagagagaacagactaagtcagactacgttgtaaaattgaacattctacgggaaaataaatcttcgatgcatatggcaaggacttgaccgttagccttttacgcaataatgtatgcataaacatagggaaaaaaaaggacctgcactactgattgttactgtatctgatctggcaagtggcaacagagccatgttaatattgtgctgagaaatggacgaagttgatataggttcgtgctgatgaatattcttacaatctgctatcttcctgtctgcaggaaaagtcacttaaaaaccagaataatgttctgcaaaaggtaaatttcattcttgtttacaacaatgttttatatcagatcactacaaaagctgtattggaggtcaaacccttttgtctacattcttcggagcagctcatggagacagaaaaggagaaaaacaatgctataataaacactaaccgggaggagcaaaatggagcaacaccaagcacatcatcaccaacaccagtgacggctccagatcccatcccgacaacaaataacaggtaccgcttttacttccatatattttgcccctgcactcaccataaataaaacaaaactctgttttgttcttcagcaaatttttattctatattttttcttttatcagacttccattatctatcacagttcagtagtttttgatggtctatgcctaggaaacttaatccggtgaaatttgttcaatcaaatgctgccggtctatttcatatggctattggaagtttggaacaaataagcccaggcctgaaagcgcctgaaccaaacagtgaaaaagcctccaaatggtttggtctcagcttgatatatcatgtctgaacaataacttgacgttaggaatgatctagcatgttactactatttcatcaactccattgtctgttttagttatgctgtttttcctcatcttaattcagtcaaagccaaccaagaggatcaggggagtcagaagctcaaccgtctccggcacaagcaggcaacagcaagcttccgccatggatgctccggacaagtcacacatgaaggcatctgttgatctcaaacgtcactccactcaatggccaacatcaacatgtttcttccaactaaggcagccactgttgtgcaatccatcttccagcgatattgatatatcggcattcggcatagccaatatatattaatgtaatgtatcttgtcaaagcttcatagggttaatgacgccttgagcttctctgttctatatctgtcttgtaacgatctttgcatatctgctgcatttttttttctctctgatcgatgagtagtccttggtccgagattgtagagccgtgtatgtttcctctcgtcgttgtgctctgtatgcaatcgacggagatgtggtttaacttgtctcacctgctgtgatttcctttcatctgttcttcagatgtaagaaaacgaacagcgccaccgccttttcaaggattaaaagagtaggattcagaactttttttttagagaggagaatcaaaacgcttcctggttatctgaaatctgatgtcagatgccttaaacccttgactgaaagggaagtggttatctgaaatctgatgtcagatgccttaaacccttaactgaaagggaagaggtttgtcagctctgtttcaaactgtatcactgtcatcttgtccgaatctcaaggaaaaaaaatctcttctcatatactccatcttaaaaaaaactcaatttctgaagtttaaattttgtcaaaaaaaatcaacttctactgtcctgcctattttcagcacgtaaaacgagaagttttatcccttaaataccgtttacatatctatcatcattactatttttttttaaataataagggacattttagttgtctttactcctcactaaatttgcattgggatgctaagaatgctctttttatgggacggagggagtattgttccatagcaggttaatgctaaggctgagttcccgaggtggagttcattaacgcacggaaacaatgttgtttattaacacgtgattgatcaaatattagccaaaaaaacttaaaattttaattaatatgaatttttaaaacaactttgatatagaaactttttttagaaaaatactttttagcaatttaaatagcgtacgtcgcggaaaaagaaggatgtgagtcgggaagagcacagtactagtattcgatcttttctgaatgacagattttacatattttcctctgaacaaatggctttactttgtactccctctgttccattttaagtgcggtcatgattttccgtgcatgattttgaccgttcgtcttatttaatttttttaaaaaataaaaacataagtcacatgtaaagtaatattcatgttttattatctcataacaacaaaatactaattattaaaaaaatttaaataagacggacaattaaagttggacacgaaaactaaacttatgattgcacttaaaatagaacggatggagtagtaatacttgtggttgctttattgattttgcatatagtacaactcgtactcttgcgaatcttatcaattagcatcctctaggataaattctcaacttgtctaggagtatattttgaagttttttgtgtttgttttctctggaagcttcacttctttttcattactctatcaactgaacatatacatgtacatatggatatatgtgcctcttgggcctagatagacatacttctacatttacagcccaacactccccctcaagatgggcgatagatatctatcatgcccatcttgttacacatagacaaacactctgcaacacctaaagcctttgttagacaatccgctatttgttctccagatattacaaagtctagcttcaacattccctcatctagtttttcctttataaagaaacgatctatctctatatgttttgttcgatcatgttgaacaggattgttggcaatattgatagctgacttattgtcacaccatagcttcatgcaagtattcttcaacaacttcaactcacatagaagattcctcaaccataacatctcactcagacccaccgacattgccctatattctgcttcagctgttgagcgagaaaccacaggttgttttttactcctccaagacaccaaattgccaccaacaaatacacaatacccagaggttgaccttctatcatcaagactgctagcccaatctgcatcacaatagccttccaaactaagatgaccacttctcttaaaccacaagcctttgccaggactacctttcaaatatctcaagatcctatacacggcatccatgtgaccacttctagggtcatgcatgtatcgacttaccacacttactgcataagttatatccggccttgtgtgacataaatatatcagccgccctacaagtctttgatatctctccttattcactggatctcccgactcagcacaaagcttaagattttgctcaattggtgtagaggccggtcgacaactaagcatacctgtgtcactgagcagattcaatgcatactttcgttgtgaaagtactatccctctaggggatcttgcaatctcgatgcctactgacccaaatccttgacttcaaattccttacttagattttctttcaatcttgctatctctatagaatcatcccatgtgataatcatatcatccacatacacagcaagaatagtagtgtgacatcccttatggcaatagaatactgtatgatcgccattacattgcttatagcccataccacacattgcacgtctaaaacgatcaaaccatgctctcggtgactgtttgagaccatacaaagatttcttcaatctcaacacttttcctttagtttgtgaggtagcaaatccaggtgggatatccatatacctcttcctgaaggtctccatgtaaaaaggcattcttgacatctagctgatgcaatggccagtcaagattagttgcacaagatataagagttcttaccgtgctcatctttgctactggtgcaaaagtttcatcataatcaattccatatgtttgactatatcccttaaccacaagccttgctttgtatctttccacctttccatcagggttttgctttattgtgtatacccacttacaattgacaactttcttcccttcaggaaatggtacaagatctcatgttttgttcttttcaagagcctctagctcatctagcatagcttgatgccaccttgaatcttgctttgcttctctccaatcctttggaatttgcattgagtctagtgatgctacaaaggccttatatgtagatgacaaagagtcataagaaacatagttggatatgttattctcatcatcaccttcatgttgatcttcaaaaccataccttagtggatgtttacctgcattgctccttacaccttttctgacagcaattggcatgtcagatcctttttctctaacttcttcatcttctccccctgactccaaagacccttgctcatgacttacatcttcctctacctgattatcctcttcaacttgttgtattactggacaccttgctctccttgtgtatacttgaagattttcctcttcatgtggcttcctccattcttgctcctgtgcaacaggaccacctataggacatggaattgaaccaatcacaagcttttccttctttgattgttcatctccctttggacccaatatttcaccttccatttgttgaccatcataaccactagttgaatcatcaagatcaatgaataaagaacttaaatctgtcttctcaccatagaatgggacatattctctaaaagtaacatccatacttacaaaggttcgtcgttctaatggactccaacacttataccccttctggcaagatgaatagcctacaaagatgcatttgacagcccgaggatcaagttttccaatggaaggtctatgatctctaacaaaacaagtgcaaccaaacacttttggtggaacaccaaatttattctttccaaatatcatctcacatggtgtcttcattccgagtatccttgatggtgtgcggttgataagataagttgctgtcattactgcctcactccacaagaatttaggtacattcatagtatacatcaatgatcgagctgtctccaaaagatgacggtttttcctctcagctactccattttgtggaggagtatcaggacaagaagtttgatgcaatattccttctgatgaaagaaagctactaaattcattgttcatatactcccctccattatcagttctaataaactgaacccgagcattaaaatgatttttaatgtatgcatagaaatcctggaagcatttaagcacctcatccttatgcctcataagatataaccatgtcatgcgagagtagcaatcaataaaggtaacaaaatacttcattccactcatagagaccacaggtgaagtccaaacatctaagtgaattagcataaatggtaacatacttcggagtcctctactcacatatgatgttcttgtatgttttccatactcgcatgcatcacatactaacttatgtttatccactctacttagttctgttgggaacatcttactcatagtttcaaaagatatatgccctagtcgacaatgcaaaagtaataccttagcctcttcttcacttgtagaagccatcaatgcaagacatacatcttcacttgtctccttttgatccaaataccaaagtccatcacgcctgacgccaatcccaagtttcttccctatttgcctctcctgaattaaacaattctcacgatcaagggagatctgacaatccatatgatcaacaagagaacttattgaaaccaaattcactggaaaagaagggacatataacactgatgataaagtgattaaaggagtacactgtactgtaccctctcccttaactgagcatgatgttccatcagcagtttgaattgtttcttttcgtgtaaatgggtatggtttatatgatgcaaattctccacacatacccgtgacatgtctagatgcacccgagtcaagtatccaatttgaatgagagctattgatagacataaatgcttggtttgaattacctgaggtagaatgaacaaggttggcaacatcaacatttgtaggtccagaagaaccctcttcaagagtgaccacattagctctgtgatcacctctatactcataacccctacctctgttacctctacctgcataacttcttccacctcttgctccacccctgtcaccaaatcttcctctcccataactaggcttgcgaggagcacggcaatcacgcataaggtgccccatttcaccacaattgaagcactccctagtctctttactttgtgcaactacatatgtggcacttggtgaagatggtgtgacactaggcaatactttcttcttaagctcctcctgtgccatagctgcaatagcctcatccaaggtaggaagagtggtttgatgaaacattgcatcccttctcccttcaaactctgaatttaggcccttcaagaactcaatgacccttctgcgctcaatccatttcctcattttttgctatacaatcggggtgctctaacccaagaggatcataatgatccaaatcagaccatagatgcttcagttctgcaacatattctgcaacagaacgctccccctgtctcatagcacttatcttctcttgtgcctccaccattagcattacatttccttctcctgagtagagattggtgagagttttccacatctcacttgcactagatatggtctcaacagttgtagcaatagcaggaataagtgaagtcaacaaccacgctactactgaagagttggtagtactccaagtcttccactcaacatttgaagtgctctcaggctcctttatctcccttgtaacatattcttctaatccctttgttttcaagatcaataaagctctttttgaccaactcaaataatttttaacaccctccaacttaatgtcattttgcatcaactcaattttttgcattgtttcagtatgaggaaccactgcattacttgtagttggggcctcactaagtttctttgcaagcatgtccaccaatttacccatcacttgttcaagtccctgatttttccccattttaatcaagtagcagcaacaagaacaacactgattacctcaatttgaagaagaaaacacagcaatagcaccacttcccagtttctctcaggtcagagtagcagcaacactacttcagcagaacaacagcagcagcaaaccagaactgcagcaccactagcaccaaatcctcagctttcctctctttttccttgcaaccgctacagcacaagcttctccttttcttctcagcgcagcaacagcaccaaatcctcagctgcagatttcctctccttctcctacttctccttttctctctccttcctaccgcacgggcctcctgccgcaactcagccagcaagtgcacgcccggtgccctcagcacttccaccacgtcggcttcctctgccgtcgctgcctctgctgcagctgcagcagccgtctccttcctcccttcgagctctggcgacccctgtcgtcgacgccgccgccgccgctcctccggtcacagcgccgcagccggatcctacgccgacgatccacgcccagctcagctcccttgccaccacctggctcctcggcggcagccgatccgtgccgcctcgccgtgccacgctggtccgcgccgccgccagcttgggttcagcgtcggcgaggtcaccggcgacctgctctgataccatgaagttttttgtgtttgttttctctggaagcttcacttctttttcattactctatcaactgaacatatacatgtacatatggaaatatgggcctcttgggcctagataaacatacttctatatttacagcccaacatatttttcctgtctcatcagtctcactcactcacacactcactcctcacactactgagatcgagagatcagcaatggcgttcccggagaccgcggcgaggagaggctcctaccaggcggcgctgcagccgtggccgccggcgccggcgccgaccacagcttcggccgcctgtgggagctcgtcatggcgaggaccacggagctcgtcgtcttcctggccggcctgctcctctccgcggccgccgaggaagccgagacgtacgctcttacacccgccgccggagacgacgtacggacacaccggcggtggctccgcgtcgccgcagtggtcgtgtgccccccgccgtgctcggcgccctcgcgctccactgcctccgcctcgcctgctgctgctgctgcggcggcgccgcccccggcgagaagtgtaaatggcctacgtacgtgtaccgtgtacgtgtacaccccgtatatacgtactcggatactcctgtacgccatacggtaacgggagtatatacttccttcgtagtcgtaaaaggaggttttgaccgtgacccgggcttcaaaatattactttaacttcttggttcttataaaaatatttatttaaaagtgatatatgtatacttttataaaattattttttaagacaaatctattcatataatttttacattttcaaactcaacaactttagagttattcatgatttatattcccaatgtttgatttaaacattatactaaacaactttctttacgtttctttacgagtatataaataagggagtatatacaaatgttttcctagtactacttactagcatatacgtacgccatggcccatggatgatatttgccgaacgtgtacgcatatttacttccgtccgtacgctcggaaatgtaatgtgaattttgactgtctaattttgaaccttataactgactatctcaaataatgtttaggtttctttttgccataaataatgatattgttggattcatgttcaaaagtgctttctaatgactatacgattttccaaccgtaagcaaaatagtgcaagactatagtcaaacttgcttatttaacggttaattaaaatacgtcatatatatattttgaacggacggggtacaatatattcttctattacaatattccaaaattatatgctgtttggctgcagctacttgcatgttgaaattaagctagccactttgcttgccaccaggaaaaggtatcgatgtcgtctaggctgtgttcggcagatgatttccgaactggtaataatatatttttttaaaaaaaaattcatgaaaagttgttttaaaaaatcaaatgattaatttttaaaatttaaaatagttaatacccaattaatcatacggtaatgacttatctcgttaaaacgaatcttcctaatcttcccttttcctttcctttgctgtacataacgatcgaaacaacaagacgaggcatgagaaatgggatagaaacttcctcatgatagtaactgtcaaggtcatcgttagtgttactgttctagctaattgcaaataataagattatcattggttgatgtgaggtttttcttaggtgaaggccgagatcatcggtaagattacacattgaatttgtggataacaatggggtattagttgataatccctccatatatacggtactacttatatcatataccgatatgtgactaaattctataaaaacaatatgcaaactttatttttattaatagcgataaaatttgatattaatagttacgaattctcatctaaaatccatccaaacttttcaataattcttaattttacaagctgtatggagtcttaattttatttccccccattgcctcgttgtaccacacacctcgctgctctactgatcactcgaacagtcgaactctatgtattactgaaatgtgaattaaagcctccgttggaattgagaatttttttaatgaatttcatgggaattaaattgattcatacaaaaaaaacgaaaaattctaccatccaaagaagtcctaagggtttcttatttgaaacatgtatatttttatagaattttcaccatccgtactaacattaagcttcaaattcttataagattgtaccaaatgcatgagcggtggtatgtacgggtacgctctcaggctggttgggtggttgtgtgggcttcactgctagtatgttttattactgattaactaaaatactttaaaaaaaaatattagcgaagtccgataagtactcactccatttgaaattataagtcgttttgattttgatcaaaatcaaattgcttctcacttcgcgcgggcgacggcgcccctctctcctcacttcgcgcgggcgacggctccggccagcggcgcccctccctcctcactccgcgtgctgcagccgtcgtcgtccagccgcgctgccgctcctccgcgtgccgttggtcgcgtccgttctgcctccgccctcgtcctcccgccgccccggccaaacctcgcctacccaccatcgtcagtaacatgtgggatagagagagaagagattagtgagagaagtgaaagaggtgatagagagcagagggataggagagctgacgtgtggcccaagggcatttttgatatttcacatgatttctctctcctcttcaactggagtgaggaggtgccgtcggagtgaggaaagaggggcgccgtcggcggcaggcgccgctggccggagccattgccgtcccgttgttgcggccgctccgccctcgccctcctgccgtcgccacgacatttgggataaagagagaagagaaggagggatagagagagaagagagataggagagttgacatgtgggcccaagggcatttttgacatttcacacgatttctctctcctctctaaccgtaaattattactttaatgcttgcggtgttcactagcaaatatccaacttttgggagtgttttcccccaaaagtcacttcgtgcggtgtactacagctaaaaccgtgaagtcacgatgtcctatagcaaattttgcctagtcacgatatcctgtagcaattttgtctagactttatgttctttgcatactttgtgatgcatcatccctagccgtgcttagaatcatataattgaaactaacatggaactaatcataactaaggatagtattggggtttcagtccatcttacctggtatatatgatagcgcgagtttcatgatctgtttatttataattgcctcttatatagatagattgctttatataaatacatcgagttagattgaccgcttaaacttcatatctggtgatcaattgttatttggtatatttttatagattaatctgtttatataagtctgtattggagtattagccagtacattatctttcttcgctctaagtattgatctatcggctatttccataatattgtcttaaaacgattgataaaaactaaaagaaacagtcctacaaccaatagggcatatttagggttttggctctaattgactatcataaagccacagccaattaggtttacccgtatcggttgggtcctgacaataagtcatcggccctatcggccgattggctatcgttcatctaattacgtttttgtctttcttgctggttgcaggataaaatcagcctacatgctcttgacacttgagacaagccttggacctgcactggagtgaagcaaatctcctaagccgccgtgttttcagtcaacacacacgcgaaatcaatttagggtttgcctcctcctctatacagtgttgtcgcacatagtttattccatcctgctcgccagcgtgcaccagtgattgggagagcaggtctccggaaccctcgccttcgacgtactgcatcgggagaaggtgacaataaggtttttgggaagcgctttgcgcgactgcttgctgttcatccacaatagctcgtctttctcttcgctcgggtgctgcacgctgttgtcaacgcccggtaccgcgagtccttcccgctgtgcagctgagcttcgaaaaccctcaatacgtattcgttatgtttcgcatattcgatctgttcaaggtttactgtccaatttatatgtgtagatcgtataatgcgattatgctagtttacatctgcaatgttatgatttatttatggaataaattaaattaatatatgcttatatattcaataattatatgacaattaatatcaaatggagggagtatatgtcacaggcatcacataaaccgtggtcgtaggagaatcggatgtcgtggttgtgtgcatagaatttttcttcttttccaattgatgaggatcggatcccttaattaggcagaacaatccgcgtgtcaaaagcttttgacgagtattggcatgcaagccacgtccattcgaattcatccgggcccacatgtcatttagggtgcgtttggttggtgaaaagaaaatttttagatgcctcattggacgtttgatcggatgtcggaaaatgttttcagacacgaatgaaaaaactaatttcataacttgtctagaaaccgcgagacaaatttattaagcctaattaatccaccagtagcacacgtgagttactgtaacacttatggctaatcatgactaattaggtttaaaagattcgtctcgtgatttccatgcaaactgtgcaattagttttcgttttatctatagttaatgctacatgtatgtgtccaaagattcaatgtgatattttttgaaaaaaaaggggaactaaacaaggccttacttagcttcccaaggtaaagcagcttgtgcgctactccctctataaaaaaaaacccaatctagaaggagatacatcccctcctaagagcaagtttaatagtatagccaactaatagttccaaataatctataatcaattttatagccaatatatataatagttacctataaacatatactatactattgatacatgatcccacctgtaatacatatattgcgtccattctatgctgcagcgggctataaattatagcctactgctcttcactttcttctttttatctatatatgtgtttagagttggcttatagtttgttattgtatctattttaatacaacaaatttggataaagaactgtccagaattccaaatttattattctatatgagaggttacatgttggtttattttaaaggacggagggattatatatggagtacatacgtatccatcttggtcgccgatatcgcgcgcgcctcatctcttccaacttccaagtggtaagcaacagaagccgaggccgagccagtgcagagggatcggggatcgccatggttgccgtgggatacatcgtgggagccatcgcctccgtggccgtcggcgcggcggtgagcctgctttggccggcggtggcgcccgtggtgatgatgaaggcgccgggcggcgccggcctcctcatctcccgcatggccttcgaggccaacccgcagctctactaccacctcctccacaccgccggccgcgtcgccgccgccgccgccttcgccgtgtgacgtgacgaatcgacgaccttaattattacttccactgttttatattataagaatttttagaattgctatgaatatattatgtctagattcactaacattcatataaatgtgggtaatgctataatgttttacaatataaaacggatggagtacgtacgtcttgcgctgctttgttgttaacttgttgcttggtcgtaggaacttacgttaatcgtgccacctagttgaagtgtttgcgttggtgctgctcacattgatcgatcgacgatcgattgctgttcgacatgctatgttatcctggctatcctggctagctagcttttcgagcaatacgtaggttctgtctgagagattacgagaaatactctcccgccctaaaaaaaatcaacctagatgaggatgtgacttcacctaaaactacgaatccgggcatccccatctaggtttttttttttgacggagggagtagctaaaaggaatctagattctggtttttagtttaattttttgcgcttttgctactgtgcagtcgcctgcaaatttgtaattcatcagttaatcccctagtcgttgattctgcattaagatctatgcacactactgggctggtggagaagactttctagatatggaccttacttacagatatattgaatatgctctaagttttaaccaaatttttaggaaaaaattagttacatttttatcccaagataaatatatttaattatagatataataaaactaatttgattttgtagatattactaaacatagttaatcttgaagtagtctaatttaaataaagttaaaacggagatgatggcggcggcgacgacgcgaagctcctcggcgatggtggtggctaagcaaagcttcaagactgattcaaaacgatcatctgggatacattattgaggaacccaagctgcaggtttgctctctcacattcccaaattccatttttctctttttcaagttctctgcaaaccctaatatttaatcccctctctctctctcaccggtactgcaggtggcatcaacagtggatatggaggcaactccgtacttgctcttggttacagtacccatcctggtgcacacacgcgcactagctttctctccggcgttgagtgattgtagatgtagtatgtggcgatgcccctgttcctgaccattctgaaagctatcgctctgaggaagcattgctactgttaggtggtgtgaggaagcaagaagaataattttgataagaatcattgctactgcttagtggtgttacaaagcaacaattggcagtaccaactaccaagcaataacaacaaatctgacgcacatttgatttgcacatattttcagaaatattcagaatgtttgccattctgaattttgagcggactgcacatttttctttcttcttacatggtaaaaatgttcacccagattgaattgaatgtaatatctctcaaattcttgaaatctgaatgcaaaaggttatgatggcttgctgatatgaatgtaaaaaaatttgctggtttttccatcgaagtctctgtgtgaaaattatcaataccaggtttaattatgtgaacatgcatagtgaaaattttcagtgcttgctgaagcatatcaataatgagaaatgcacttgtacatatataaggagatacattaaaatcaagcaagctgtcctgatcaactaatagttttcctgctactgcagatgcctcccatattctcttgctaccatcttcattcaactattcttcagcacctgaccaagtagtatctctagaaatagtaaatcaagttagaccatggaagccaagaacattgcatagctcctataccattcccttgaaaaaaaagaatataacaatatccagtatccagtacatgtgtatgcttgtaagaaaaaatatcatataggagaagacataaggtcttgttcaaggattacctcataggaaggacatgaagctccttcccaatcaccgttttcacctatggcaagaggaaatgcaggagaacgaacaagttcaacaaagagaatcgcaagagtcatggattagtgcgctcggaggacacacgatctgatagatgaggggataggaaaaccaatcgtgaggggggtttttgcaaaatgccagggcaagaggcgggcgctttttttgcaaaattacctcacctgaacactagcctttggatctagattggaggggcctgattgtgtgtgtgcatgagtgcaccagattcgtgaattttttttaaaaataatattattttaatggaaaatcgcaaaattataggtcggctagacgaaatcacaattttagcgccctgtcgaactggggcagttcgataggtacccctgtcgaactggggcagttcgacaggccctagttcgacaggctgtttgtccaagaaaaaaaataaaaaagtacttgaacagtacccgatagggacgtatcgaacagggggagttcgatagggcgcgtggcatggacgtatcgaacagcgggagttcgataggcagcgtcgctacagtgtcgctacagtgttttccctttttttatgttattttattacctgtcgaactgtaccctatcgaactggggcagttcgacaggtaccctttcgaactgcctccgttcgacagggtgctaaacttgcgatttcgtctaactgacctataattttgcgattttccattaaaataatattatttccaaaaaaaactcccagattcgttgccggttatctttcctagcagcataacgtgacataagcatacatgacatcaatcagggaatcccatcttgcgtcacacttccatttcaccttcatgctttccacagctttggtttcttacctttttcgatttcgtcgttcactgttgttagtcaaggtgacctttcactgttgctttgcttgtgatgcgtagtacaagagctcatacttttgtttcgttagtgctggtggtacatggtgcacctcctatctttaagacctttttagccaaaggaatcaccttgggaccgtgcaaacaatcaatcaatgctgtagtatttaccaatgtcgaattccttcgtttccaagtaagctctaatggtgtatactacacagagtcaaaccttgagctcttaaatcattaatagattcagaaagttattaaaaatccaatatatagataaaattattagatttatttacttttatatagttatattcttaataactttataaaaatataattagaacaataatgatgatacgtatatattgggactgctccattcgtttcataaaaatacaaggttagtatgggatgtgacatattaggccattcctaacccaataattaggatgatgtccatagcattaaataagttgttacctagaatgaaacatgatgtggcaatgacaaaagagaaggaaaccaggtcttgcgtgagacatagtttctatacaacatttaaaacatcatgtgagataagtagcattaaatttaagtatgaaagagtggtgtttgcattgagaaagtagtgtctagggagtactagtttttaataatatggagtttatgaaaaccatgtctagtgttttgggttggaactggtattatgtactagatttttctaataagaatatgtttttatttttttaaattctttttggaagttgcaactttatagaagtttactatattactgtagccatggccttctacataagcaacggaagactccactactcagtcctcacctcggtagctaatactactttactttattactgtcgttttggtttgcttagcagaatatggttggcgtgagcgagttcgtcggcggcctgctcaactccgccaagagcgcggtggcggccgtggcctccaccgtggcggcggcggccaagccgggcctcgccgcgggggtcggcttcgtgaaggagcagggcgtggggaagtcggcgctggccgtcggcggggccgccgtggccgcctacttcctctggcccacggcggcagtcggcggcgccatcatgaacgcgccgggcgccgccggctacgtcatctcccgcgcggcgttcctggcgaaccccaagctctacttccacctcctgcgcacggtgggcgccaaggcggccgccgccgctttcctgtagggaagaaatggtatccgccgccgccgacgtccgccgctcgctggcgttggcttgctggttcgtgtgtggcgtttggttgagtgagtaatcgccttgctaattaaggagggatttgtgatggagttcatgcttagattactcttgtttggctgtgaatctgtgtgggctagtaattcacggtgtttaggcgacgtggttatatgctagtacatccatggtcatgtgtaataaggtgccgtgtaataagtttttgtggtaattaagtatgttgccgtttaaacttatgtaggaatttaacatgtctaaaccctattatccaaacaaatatcccttggaacacagggtacttgaagaaattttggaaatcctacaaaattcctttgaattattattccaaaaaaaatcatttgaattggcttgaaacataaaagaaatttagagcctctttgaagtaaatgatttacagaggaatttcatataattgaaattttatagaattttttttatttggccttttgattaaaaggatttgagttttccaaaccatatatatacaattcctatagaatattggtctatattgcacatccagtaaattcaaaggtgactgaaaattccaacgatttcaggcaggacaatccgctaatacgagtattggcatgcaaagatggtcgttctcgatcttgagggtcggccgatggcggacttgaacgttgctctacgcgcctttcttgccagctgctctaggcctctgccggcctgccccctgcgttgctcccactggacccgcctccgtcgcctgccatcgcggccatggggaagtgccgagccacagcgagaggattgcggccaaactcgcgctcgacggcccgagtcatacggtctcgtgtgcgcagcacaatctgatatgcaagcttgggttggtgtctaaggagggtcctgtgtaaatcgaggcggagggtcctgtgtaaatcgagacggttgcggcttacaacgtcatcgccctatcttcgctcttctccagctccctgcctagatgcaggccggagtgtagtgggtttccatacccatccctccctcgtggtaggagttttctttttctgtagctaaccgtttatgtatttgttttttgtttcttttttttcttggcccctgacaacggctttctgaccgtttgtgttgtgtaactaaattatgccatcttcttataatatattaacgtgcaaattttttgcgttcgtaaaaaatattgtatgcaaagccacgtccatttgaatttgccgtggctgacatgtcattgactcagctacaaccctcatccgtttaaacctcacaataaaactagtaccactagaacattaatcaaggatcaattaccggagtatcgtttcatcttcttcaccgtaaaaactagctaccgactcccctgctctgccttccttcaattctcagttctcacctccccaactctttcccttcccgagataattaagcaacaaatgcacaaggctcgccagctagtaccaagactagacttgtgtactactcatataaatatactctcttcgttacttttgatagttatattttatcttggcacacaaaccaaggataagtacattcccaatccaataaataggatggtgtccatagcaattaaataagttgccacctaggaaaaaaaatgacgtggcaagtgaataaatgaggaaagataaggaaactatatctagcatgagacatggtttctacataacatccaaggcatcatgtgagataagtagcattaaattgaagtatggaatagtggtgtttgcattggaagagtagtgtctagtactagtttcttgatgatgtggagtttatggaaaccatgtctagtgttatgggttaggactgccctaagtaattctacttatcatctatttaaatatgctactagtcattcatcgcaaacaaacgattcatcaatatttacatttctcgatgtccatgtagccaatcttgtatggaagaatgaagagtcatgcattaaattcgagaaaatcattaagatgataggttgttgaattgaaatatgcctatcaaaaatattttttttaaatttagaaatatgactatcacgagtagatagagggagttgtatactatatacatacgtacttctatccatcctggtcgtccatactctccatctacttttccgtacagtccacttaaaagcctgcacgcgaaaatcgatttttccgtacggttctcttaagtcgacagcacgggataacgaggattatcccgtgcagtcgggttaagacgtgcgggcaatagcccggtgctcgtccccccatttttccatgcggtttcagtttcggaccgcatggaaacaaaatgggtggtgtccaggaaaatctatcatgtagtactccctacgttccataatataaggcacaactacttttttggatgttccataatataaggcatgcatgcatgcatacaattaattagaacctcttctccgttaaattattacttttttaatcctctaccatcaagacctctaattctattggatgcatgtattatactccctccatctatttttgatagtcatatttctaaatctgaaaaatttatttttgataggcatatttcaatccaacaacctatcatcttaattactttctcggatttaatgtgtgactcttcattcttctacacaagattggctacataggcatcgagaaatataaatattaatgaatcatttgtttacgaggaatgactagtagcatgtttaaatggatgataagtagaattatttatccttggtctgtgtgccaagatgaaatatgactatcaaaagtagatggagtgagtatttattatggtgattcaaactagaagatgataataattgtttcttggtctttgggttaagagtggctgtgtcttatattttagaacggaggaaatagtcttcaaatatgtcgtttaactcgagcacataagtaggtgcctgttttcttagggggacttgtcctttttttacatagtaatttgcttgcgttcttagcttagtcgagtgctagtttatttttctgaagaaacacaagacaaaattaaagctctgacttatttcattatcttttcgagttacttatggagctgtcagttaatacctaatttgcttgcgttcttagcttagttcagctcgttgtcaaaatcaatctcactaagatttgacattgccaaatattggcacactttggtgtcatcaaagttggtattgttgaatgttttcagtttgtaacttaccaaattttgaaagttctcttattggaagaaacttttagaaatatcaaaatttggtaaggtgacaatgaagaagagtgtttagtttatggtattactccctccatctacttttgatagtcatattttcaaatctaaaaattttatttttgataggcatatttcaatccaacaacctatcatcttaatgatttttttaaatttaatgcgtgactctccattcttcaacacatgattggctacatgggtattgagaaatgtaaatattaatgaatcgcttgtttacgaggaatgactagtagcatatttaaatagatgataagtagaattatttatccttggtctgtgtgtcaagatgaaatatgactatcaaaagtagatggagagagtaccaaatttgataacataaaaaatgataaggttaaaagtggtaataaactgaacaagcatttatattgaccaaggtggcacgatggaacggactaattaaggtataaattccccccctcccttctttttttcatttgaggccacctgtacaattgtttgcatgtttgggctaggtttattctgtggaataagttcactttatgaccctcaaaagtgatcgaaatctaatccatgaccctaaaccacaaaaccggatatctcgacccccaactcttaaaaccggtgcaatttgactcccttggtggttttggaggacagtttcgctgacgtggcgcttacatgtcagtattgactcggtcttctgtccacatggtgttgacgtggcgcttaggtggcattagaaataaaaaaaatatacgtgggacccatttgtcattcaccaaaagtataggtgggacccactgacatgtggggcccacataaatcatatcctcccctctctctttctctccgcgagtgtgggacggtggccagcggcggcggagacctgggagtggcactggagcggcgacagcggcgtgcgggcgagggccggagcggcggcggcggatatcgagactgccgtggaaggttggccgtcggaaggaagaaaacgggccacgagaatggccgcgtcctcgccaccctcagccccgtgactgtactatccaccactatgctccacgccctctttgccggccacgacgcacccgcttccgccgttctcccgccgcgcccacgaacgcgtaagggccgcttgcgtctcgccaccgcgactcgcgtcggcatcccctcgaagatggcggcatccggcggtggcttctcctgcacctgcgacggcggctgcgttgaaggcgggaggagcggcgcgagcgggggaggcgccgccgccgccgatggacgcggtcggcgtgctgagccggccgacaacgacgcgaccacacgcgagttgggaggcatctgcgtcgagcattctcctgctggttgctgaggcaatcggcaaggggcgacagatgaggactggctggactgcggctagcaagcacaagcggtagcaacaggcagtgcatgtgtgtattaacatcaagcggcaagccaacaagcaaagggctgacaggttcaccgcgttgtcatcgaccatctgcctagtcgccgtttcgctgatcagcgtccagtgatccgagttgaatagccacccaccttcccggcgagcacgttcctgtacgtagcactggctgtcgagctcccccggcgtgccgtggtctaggtgcacccacgccgtctcctccgcgtccggcgggcacacggcccggagctcgtcgccatactgcgcgtcttcgttcaccatggggtatatccgctgcgagaaggaggagcagcgcgagcgcgtcgaggcggccggagcggacggtgtagctgatcgcctgcgggcggcggcggcgcccgggctgagctccaccacggtgaagatggaggagaccacagcggcggcggcgggaggcacacgcggcggggtacggcgagctcggccgcgccctgctcgacctgcaggtcgccaccgccacacccgcgtctccgttgcgctgctcgtaggccgccgctccacacctgcgcctccgccgctcgggactccgtgcagccgcagccgctcgccgcagtctccgccagccgccgcgacacccgcagaatctctcgggttctgaggggagctcggccgccgacgacatctcgatgtcggccgtcgggtggtgcgggtggtggtggcagcggcacgacatggactccagcctacctccgccgccgccacttcagctcccgccgtccgccgctgcttcagcccccgcccgccgccgctcgctccccgcggacggctgtaggggagagggagagaaatagagaagggaggaggggaggaagaagaaacggataagatggcatgtggggcccacatgtcagtggaatccacaattgtgtgtgtgaatgacaaacgggtcccacgtatatctttttaattgaaatgctatctaagcgccacgtcagcacacagactaggtcaataccgtcacgtcagcgaaaccgccctctaaaaccgccaagggagtcaaattgcaccggttttaatagtttgagggtcgagatatccgattttgcggtttaggctcatggattatattccgatcacttttgagggtcatcaagtgaacttattccttattctgtagcttgggcgcccaaccagcaggtcgccttcaattcggcccaaaaccgcacaagcgtgttgacaactttacatgtcttgcgggccatagcgtggtgaaaaccgacgtcgccgcctctacctgaaatttttacaatttggtcctttttgaaaacttattttataaatagacccctgggaaaacttaaaccggaaatggtccttttcgggacgccagagtggctggcgccgtaccccaacatagcggcgccagccacactggcgccgtgcccgtgccaccgtggcaatagggctgtcgtggaggtgctgactaggccgaagggggcgccagccaaagtggcgccgcccctcatagaacggcgccagcatggctggcgcgcccctcctctacgggccccaccaactttctcccccccccaaattttcgccaagtctgttctgcctccaggcaacggctggcgccccccccgaccgcggcgccagggtggctggcgcccccctcctccacccatcgaagcccttctgcctccgggcctcggctggcgccgccctcatggaccacggcgcctgggtagctggcgccgccctcccccagcccgaaacccttctgccacgcggcactggctggcgctgcccttctcaacctcggcgccagggtggttggcgccgccctctgcctccctgcaaattgtagatccatattgcacaaatgtaccaattcacagttcgcaattcaaatcacaattcacagattcgtacagactaaaacaagttccaattgcacaaatcacaatgccaaaagtccatcacatagtccatcacatattccacacattaaacaatgccaaaagtccatca

SEQ ID NO: 36026 - DNA, 694 bp, Oryza sativa
aattccagatcaatagaacttgcaatatcttgacgatgcatatgtgtaatagacatgaaatatttttcgcatgaatattaacacgcactgttttaagatatcaaacataaattatttaccttctcgatccaggatccaagaggtagaaggatatacagtgcatgctatatggtacatgccttcatgctgaagctgactagaagtgtcaatacaatgacaatttattcacacagatacgttcacaatttggtggtagatatatacatgaatgatactgttcagtccaggctggggccgccgctcatggactcagtgcttgtgcttcggcttttttactatcatcacggtgcagtgcgcatgatgagaacagtagtcactcacgcttccaagaacagctctgcagggaagttcaggcatgccagtaagaccaatgtaggtgaataacatgaagtagggaacggaaaaagatgattgggagtaaagttgatgcatcagccagtaatgttgcatgagttcataagattagcttttgttactgtcttccatgaaagaccaaacaaaattaagttgcaggcagcacgattggtcatttgtaggtcgatacaatgaaacaacaatgcattgtaatctgcctgttctaaaaaaaatctagtctagtccaggtcataataaatcgtgttaatccacttttgaa

SEQ ID NO: 36027 - DNA, 683 bp, Oryza sativa
tcatcacatccaataggtaaggaacgtccaggattaattgtctctgctccctccttttagctatttgaacatgaaatgttttctcgttttctttatctcaactttctcaaatttaagagaaatcaaatgtagtttataaacaaaatgcacacatacttcactcaataatattttgcacaattgtacatagcactgacaaatgagctagtgagtttaacttttccctgtgtttgggaataatgcatccactgagtcaaaagaaaaaaactaaactactactccaaaatcttcccgtaaatcagtgtgaagcttctattctttgcatataccaattgaaagtgtagagcatttcattgcagtctggtacaaggatcacttgctcagaacataactgtttcgatgcctcatgtttgcaaatgttggattttaatctgaagatgacaacattggtctaggagttgccaaacataaggatggcactgcagcaatgcagagacaccatcgtcagtacatcttgggtatgaaaattgacgattattgcgggtatctaacatggcttgtaagcatgctagacttggtaagggctccatggtgtatgatccgaggatattaacactgcacagatgatgatatgagagcaagtttagtccttgtagacaagaggcttgttgacccaacggatg

SEQ ID NO: 36028 - DNA, 688 bp, Oryza sativa
ccgtgaatctgatggttagttttgaacttgttgaacaaattggtgaccttcttgaagctcgtggcaagttcatgccccttgccctttatcatgaaggtgtcgatggcatcttcgatgtcgtaagacagctccctgacatcgctggcccagatcttcgccagcttatcaagtttatctgcaggcgtctcagccaccttgtggagggctgcggtcatacttgtcagctctttctcaagttcttcgatctctcccttgacacccttttgtagcttgtattcgcctaccagcagctccccaagcttggggagtagggtgttcattgcccctgtggcaacgttcatattgacctatctatcttcaagtgagctcttgctcgaaaatctggggttgaatgcctgcacgggtcacacagctgcacttaatcgatcaggaatgaccaagcaacacaaaaacatgggagaaaacatctggataagagaaaaagaactccatccatatctagcatgtcaaatcgaaactagaatactagattgagcaggcaacaaagtaacaaccgagtggctatctcacctaatcggtcgaagcaagctttgctactaattgttatcaaggcccacgctatcaccaatttcaccatgagtagcgtaagcgctggctgcagcgacctctcaacgctgcagtcctactc

SEQ ID NO: 36029 - DNA, 716 bp, Oryza sativa
cccaatatatacgtatcatcattattgttctaattatatttttataaagttattaagaatataactatataaaagtaaataaatctaataattttatctatatattggatttttaataactttctgaatctattaatgatttaagagctcaaggtttgactctgtgtagtatacaccattagagcttacttggaaacgaaggaattcgacattggtaaatactacagcattgattgattgtttgcacggtcccaaggtgattcctttggctaaaaaggtcttaaagataggaggtgcaccatgtaccaccagcactaacgaaacaaaagtatgagctcttgtactacgcatcacaagcaaagcaacagtgaaaggtcaccttgacttacaacagtgaacgacgaaatcgaaaaaggtaagaaaccaaagctgtggaaagcatgaaggtgaaatggaagtgtgacgcaagatgggattccctgattgatgtcatgtatgcttatgtcacgttaatataatgatttaatttattccataaataaatcatgacattacagatgaaaactagcatgaacgcatcattagatctacatatgtaaactattcagtgtaacataaacagatcaaatatgcgcaacatattgaacacgtaccgatgtgacagaaagaccggctgcttggtccaaacttttcgcaggtgtctacgaaggcacgaa

SEQ ID NO: 36030 - DNA, 1863 bp, Oryza sativa
ggccgactgcccaagaagaggaaaaaggaggaaaaaggaaaaacaaaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacagttcaatcaagaggaatcaacaacagaacaactaatcaaacgtattatgaagggggttaagatgctgatacatagcaagaatattacttcaaccccgatttgtaacggtatttttatttgattaatcaccggaggggagagattcctcacctgaatctttcattgccaaagaaagatagttctgagttacagagattgggctataccagcggcaagccattacagattaaacagaaaaaggggaggagatataaagaatacaaaagagaggccaccaccttcccaaagagacaacaattgatgttaggcacctgcaaaaaacccaaccaaaaaccagagcaacctaaagctatcacctaagctcatcaacaaacattttcttatgcagacttggaaacgccagtactcctcactgaagggcctttctgccacaaggtcagcttggtttaacagcgaccaaaagactgtggaagtcaaaaaccacccgcatcagccatcaagaattcaacttaaacttgttgctgcttggatcagtgcttgctgacgcaatttgtgggaaggaagccccagaagagggagggccactgaaggttgcggccataggccgcccgtatcgagtcttcttcaatccgactataacaattgcttgcaagttccatgacctccaaggtcctttcagggaaggaagcctcaaaggaggaagggccgctgaacaatgtggttgaggacatgccaaggtaaagagaggagacgaacagggagctagacaagagagaagtggcagatggggggaccctacggatggaattccaacaactgcgacagcagggaagtgcttaagatcagatgctaagccagccaaaagagagccatcagttctaacaacaaagacctaagccatcaagcaaggagcatgcctaaaagagatccagagagaggtgaggcacgagcaacacctagatgatggatgaaagcctagctggtcagggcaaggagcagcgcaaggatcggtgactagagagacatcacagttgtcggtgacatgggaccgggagtatcatgactagaggcttgaggcagacacaatcgcccacgtggcctggcaccctcggggggtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaa

SEQ ID NO: 36031 - DNA, 39687 bp, Oryza sativa
ggaaccgatttcatgcggtttgggcgcgagggcgcgagcggaaaaggccggaatcgtgggcgacgtgggcggcaatggcggcacagcggtttggatgagggaggctggaggtagaggaagggtctgacaagcgggtcccacggccccacttgtcggcctgaggggagggaggaggcgcgcagggacgcaaagcagacttggggaggggaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaattcaaatgacaagtaattccaggaaaacctgcttgacctgcctttcgtctgtactacaactgtcctcgctgttgcttttctaagctaaactgttgacatgcttcacaggtgtaccttagaatcgaacctgtcgacctgagattggggtgactctgctgacaccttgcaactggcttcttcaagtactacccggattgttgcactgggttgaaccttcaactaaaacagcgacgaagtgagccaaaactcatctccgagacctaccccccttacatggagtagtcttactttctcctgactaggaacaattggactattgtccttgaaaaataaccaacacttctcttgcttacaaaggccctcactttgaaaactgaaacttcaccgattcatcaaaatagagtaatgacggcgcactttcatcccagcaagatttggaacttaatcctcagttgctgatgggagattccacataaaagtgactctcatttagctcatgaacacactgactcttgactaactttcccataagttctaactactggcatgactgtcctgcttctatcttgacttcggtgtcgagttgcaaaaactgaactaaccgactctgcattggaactgacacaactcgaggagttggggtgtcgctaacaaagctcttgatgtgatgacgctgacgccttactgtggaacaaccctctgagaggtgccctgtcgtacatcttccatggatagttggacactttgcaaaaactgctcttgaaaaccataaccactataggtagcatatgttactcctgggattggtggtggcttagctgtgctgctttgctgaggacttggtggcgtactatctgaggttgtgggtgcttcctctttgaaaacaaattggctttggctctgatcctaattccagcttgcatctaggcttgtacatgttgttggagacactggtgttgcatctgctgcattggactctacggttgctgtatcaacatctgacacatccatcatctgacattggctaaccaaaatctgcccagagagaggtgctctgatttagcttgtagctggctgccttgaactgatccaatggctctgaccgcaacacactactgctggagttatttccgctacatttgaccaggtgtcgaacctgcatctcccacatcgatacacccatcttctgatcttggacaccaaaagttgatcatgagcagggttcatctggcgttggggcaccttgcagctttcaactaaaccattgatctgtggctttaattgatcttatctctgacactgaccatctgctgctaggacggaagagaggtggaagagaggggtcgctaaagataaggtactaaaccacttgcctactgatctgttgtgactacacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttgacaaagaaatgccgaagggcgagaggagacatttttcaaatagggttttcagaaagcttgtccttagggtttgaccgtttggctcaacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaaaacagtaaaactgttgagtaattaaagtaaattagatctccactgatcaacgctacaccacgttgaacaggcccaaccaacccacctgtactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattctcgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccaggtgtttcgagcacgcagctcaacaagatactagaaaggtctaaaactgtaattatcccatcaactgagctagtggtaattaagcatggctaagcatatagttctagctaggtcacataagtaacacaagctagtcgatttatcacccaaggttgacaaaggacagatatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattaaactcgatttattgcgcaattattaattatttttacaaaggaaaaaggatctcgctgacgtcagcaaggggcagccggcgccgacacgcgggccccacacgtcagcgggtcaaggagctcggtgcaccgtggaccgggaccacaaggacggtccaccgccggtccacgggatggacggcccagatcgggccaagccgatcgggcagctgaggggagtggtggcagggcacgggcacagccagggctggcccgaccgaccacagagggcggcggcgcgcagacggccggacaaccggcggcggcggcggcgcaacgcggcgctggcacgggaggcggccggcaaagaggaaaaggaggagggaggcggctcaccgagaggcgcggcgacggagggagcggccgcggagggaggcggcggcgctccttgggtcgacgacgcggagggacgcacggcggtggatggcgagggcgaggaggcagacgaggtgcaacacacgacgacgaagccgacaaaggtgacggcaagcggcgaccgcggctatggcggtgatgattgccggccggaaacggtgaatggatgtggtggctcgggtgtgtggtgggaaggtggtttcggtggtggcgagggagagaaaaacggtggccgagcttgggcttgtggcgacgaagccggcggtggcgacggagcagtgctgcggcggttctagcgacgggaggcggcagccggcgctcacaaaggcaatggcggctcgggttggcagtggaggtggcagcccggtggtggattgggggagtgtagcggtggacgacgtgcggcgtggagtggtgatgccgacggcatgggttgcgcggcgcggcggtggcgctagcagcgacgaggtgcggctggaggcgacgaatgggtcggcggcctcgggtgcacggtgaagaagtggttccgggggtggaggagggaagggaaacggatgccggggtgaagcgtgggacggcgatgccgatggtggcgacggcgctgcgcggagatggcgagagcggcggctagaggcgaccggagctcgccagagagcggcggcgcgcgggagcggcgtggggagagcgggagaaggcgagggaagcgccggcgaggaggggaaacgagagaagggagcccggggatggattttataagctcggggagggaaaatcgttgccgggcgtggcggatttggggcggcaatgacccgcgacgtgggtgacatcgtgggcgaagtggagctcgatcccggcacaatttttgggggaaacatggggagagtgtagaggaggtggatgggaaccgatttcatgcggtttgggcgcgagggcgcgagcggaagaggccggaatcgtgggcgacgtgggcggcaatggcggcacagcggtttggatgagggaggctggaggtagaggaagggtctgacaagcgggtcccacggccccacttgtcggcctgaggggagggaggaggcgcgcagggacgcaaagcagacttggggaggggaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacagggggcgtcgggcccgagggtgatgtgttcgccctcctctttgtctccccgagggggttgggccgcttccgcctcggccccgagggctggggcgccccgaccccttgtggattttgcgccgcgtgtatgggttaggtacggcgctcacctaaccgcatttattgcggtttggacgagcgcgttacgccgcatgtaacgcagtgcagcgcgctcgtttatccggtctgtgaccagtcacagaccggtcagatcatgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccggtctgaccggtctgacaatggtcatgtcatcagcagacagccatgtttccacgtcgcgcctgcttccggcggaagtggaggtaggtatgggccgtcccgtcagaaggtcattcggacgacggcgatgcaaatctccgtccgttaatgaagagaagtcaaattggagggaagagaggatgagtccccacacaaaagaaagagagggagagatggtgcatgtgggatccccttgagatataaaaggaggaccttgcccactgagagaaaaaagaagaaaaaggatccgagcttaatcgggggctggctggcattttgtagcttcttcatacacagatccaccaaaacacaggagtagggtattacgcttctcagcggcccgaacctgtatacatcgcccgtgtcttgtgtgtttccacgatcgcgaacttttcacatacagactaggagcttagaatctcacccagggcccccggccgaactggcaaaggggggcctgcgcggtctcccggtgaggagcctcacgctccgtcaacagttatagagcacctcaaagaggaggaaggacaaaggagggaagatgttgctgggcaaggtcgcaggcaccgaagaccgcattcgtcgaggccacagcccgccgccggcaccacagagctgaccacgagccgctgatcggtgcaccgccagccgggaccagctacggtgcacaagctgtcgaggccaaagcctccaccgccggccgtaggggggtgggtgggtggggaaaactaggcccgccgccggacgccatcgtaacctccgccaccgtggcctccgccgctagccttcgccaccgctacctctgctgccagtcaccaccgcgtcttccgtgcgcgccgacctcctgcgccggctgccgccagccgccgagtcgccatacgccgccacctccgcctcacatcgtcaccgcacgggagcggctcgctctagccagatccggcgtggaggcgtcggatccacccacgaggaagccagatccggccgcggctgcgtcggatgcgctgcctccaccccacgtcatcggactctccttcgcgcgccggcccgccttccacgcacagagacggggcgccatcgagtcttggcctcgccgccgccatcccggctggccgcacggaactctggtagcacactctggtggcggcgaggggagagagaggaggagaaagtggcggtgggggcgctaggttttcccccgagtcgcccgctccccgagtcgcccgcgcgcgggcgacgtgggggccaacagtttcttcatttgtaacagtattgatagaccagagtctgtcgcgcgggcgacgcgggggccagcagtttcttcatttgtaacggtattgatagactagagtctgtaaccgtgcatgtatagtcagcttccttgcgcaagtggatcaggaaggatgacgactccgtttttacatcactaaagaaattcgcagggaatttttctaaaaaaaatggtgaggaagatacgagaacagaataatctgagaacccaagcaatggccttgcggcttgtttggttattaccctgataagaatttgcctgacctaaaactagcctgacttatcttagtccttgtttggttgccacactgagagctcttctcctcggccttggcctgacggacccgggcaagtgattagcctgagctctacgcacacgcgcgcaacataaattaatgataacccattggagcgagtgttaggaaacgatcggcagataaacgataaaaaacaatagaacgattggcagataaatgataaagaacgatagatcaatcacgaagacacgagatttaacgtggaaaactctcctaaaacaggagagaaaaaaaccacggttgccagtcagcaaagatctttactatattatgtgagattacaatactgaacagcggcttacaggaagtatatatataggtgaaaccctaaaaggataacgttctgtatcgcttcgctccggcccaagcctctagcgacgggcctccgcttcgctccatccgaagttggtgtttatatgtgtgtaaatgaatttgtatcacaactcaccagcgaggacccctgtgcgcagcatgaggcccatagcaccactacaccttcgccgccattgtcgtcatggcgagaaaagcccagacctccgctgtcgtacgtcgccgcgtgaagcccagacgtcccatctgccgctgtcgtcgtttcctgaagctccactgcagtgtcgtcgtcgcgctagatttggccatcgctatcgcaccgaagccaccgactgctgcttgctagattcggcgttgtgcgcgcgaagacgccgcggacgcttagctaggatgttgattcgctgagttccggtcacgcggcctgcctttccgcacgaagcacgcaacaggtcagcaggtattgtcttcgatggaatcagataactttgtacagtctgcagttgtgccactgatatgtgggccccactttagtatggcccacatgtcagtggcataactgcaaactgcacaatattagaggagtctcatccatcttcgatgctgggtgttcccaacccttctccctcatattctgcgtgcacacttttaaactgctaaacggtgtgttttttttgcaaaaagtttatatacgaaagttgcttaaaaaaatcatattgatccattttcgaaaaaaaatacttcctccgtttcacaatataagtcattctagcatttcccacattcatattggtgttaatgaatctgaatagatatatatgtctagattcattaacatcaatataaatatggaaaatgctagaatgacttacattatgaaacggagggagtacctaatacttaattaatcacacgctaatagaccgctctgtttttcgtgcgcaggagatttgttctcaactgcccacaacgaacacagcctttgacatgaagttggagtttaatttgatgcattctcctaattgtttcccctctttagatatgtgatagatttgtcatttgcacatggaaagctaggtagcagatagatttttggtgggccatgcattcttgccaatcccacattgataattgatggtggggaagcacaacttaaaagatagtctcatccattagacaagtcttttgggttgtatagtcttaagacctaaaattgtggcctcagtcgagcctgtggcggagcgagcccaatgtgattcgggtgacccacagtaagtgagccaggttgcgcactctaacaaatattttgcatcttattccgattatcacttgacttagggcctatttagatcctccaaaatggcaaaagttttatcattttggagcactttttaccattttagatctaaacactagtagcaaaagttggcaatttggcatttgtcatttgctagtctagggtagcaaattttgccaaaaatgctctgggaccatgcgcgtgctctctctctctctctctggtactaaaatggtaaaactttaggatgcatctaaacaccaactacatgccaaatcttttcccaccaaaacttttaccatttaccatttgctattccaaatgaatcaaaacggacccttagcaaaaattatgtaccgcctaatcatacttctcaggcggcagctgcaaatcgaacaatcaaatatcccgcctgcctgaccaggcaaaaaagtagggggctgtttggttgctgccctcgcctggagaccattgctcaggcaggtcgatccgaccgcaggcgaccgaaatcggacgcctgagatcgacgcctgagccaggcgcgaatctgagggcagcaagcaaacgcgccctagaactcatctgtcaggcatgaaaaaaaatctcaggtatgctgttcaggataccatggtcaggcggcagctgcaaatcgaacaatcaaatatcccggctgcgcaaaaaataagggggtatttgggagagaggggctaaactctcaaaaacataagtccctcccataggaacttatatttttgtgagagagactaaattgtttagccccactttagtccctccaaccaaacaccaactaaagctcatctgtcaggcatgaagaaaagtgtcaggcatggtgttcactgttcaagtgttcagggtaccatgatcacacaaaaaatagaactcatcggagaactgtcaagcatgaaaataaataccaggcatggtattcaggataccaaccaaacagacccttgatgccagcatgatcgaagcatggaactggcctgttgggcttgctgaaatgggccgagatcaaggcccattaaaacgccacgtggtcacgtggagcgctgctctccctccttggcgggcacgccaagcttagcacgcaccgtaaagtccaaatttgaccagtcaacaagtcaaagaaaggcacaactccaccttatcatctccactatataaaattcattttcgatcgatcgatcgctcactcacccacttgtctcacactctcactgagctcctctgcttctcgcatccatggccgccgccgccacgggccctgtccccttcaaggacgccgacgacgacggcacgctcgccgccgccgaggcgcgctcgcctctcccgaaggaggagttcggcgacctcgtcgcggcgctgccgcggaaggagcagtacctcgacgggcggctctacgaggggttctggctgccggagcactacgcgccggggatcatcgcgttccgccgccgcttcacgccgcgcgccgacgacgtggtccttgccagctaccccaagtgcggcaccacgtggctcaaggcgctggccttcgccgccatgacccgcgccgcctacccggcggacgaacacccgctgctccgcctcaacccgcacgacgtcatcccgttcgtcgaggacgtcttcaccgacggccacgaggccaagctcgacatgctcccctcgccgcgcctcatcaacacgcacacgccgtaccagcttgtcccggagtcggtcgtcgccggcgacggcggcggcggatgcaaggtcgtctacatctgcagggaccccaaggacatggtcgtgtcgctgtaccacttcatgcggcgcctccagcccgacctgtcgctcgccggcgtggtggagtccgtcgccgacggcacggtgccgttcgggccgatgtgggaccacatcctcggctactggcgggcgagcgtctcccgcccggaccgggtgctcttactcaggtacgaggacctgctccgcgacggcgccgccggcgagcacgtcagggcgatggcgaggttcatggggcggccgttctcggccgccgaggaggccgccggcgccgtagcgagcgtcgtggagttgtgcagcttcgagaggatgaaggcgctggaggtgaaccggcggggcacggcggggtcgtacaagagcatgccgcgcgacgccttcttcaggaagggcgtcgccggcgactgggcgaaccacatgtcgccggagacggcagcgaggctggacggcatcttccgcgaaaaattccgtggcacagggctcaccattgttccatgacacggatcgagcagttggccagcgacgtcgtcgtcagtcactgacatgtgggccatagcaaagtggaacccacatgtcaatgacccaactgcatgtcagaggatctgcttccgtgtgcttcatttcattgtgattttgctgctgtttcggacatttttgtttggcatcgcttgtttttatttgtgattacccacttttctcggttccaatcatggaacggagatgtgacgaaaggcgcatcgaataaagaaatgagagtgattcgggcttgatcatcatccacttgattttgtgagcatcatgatacaaattattaaatgaaatgatgtattttgtacgaaaaactttaaaatataagataaatctatttctgagtttaaaacaattcaaacttcgagttatgaaattagtttttttattcgtgtccgaaaaccccttccgatatccggtcaaacgtctgatgtgacacccaaaaattttcttttccccaactaaactaaataaggtcttattttgtttgggctatttattgatttgggccgagtttgtttgttcgttttggacttttttgtgtgggccatgtgttctgcatttgcccaagtcaaagccatgaaaagatccaaaagagatggtggttttgatgaaacaagcagagtaagaaaacgagattgatcaaaaaaacaatcacacacaaaaaaagataaatcagaaacacagcatgagcgaaatacactactagaaaaataattttttatggtgttggtcaataattttcgctggcggaaaaataccaaaaccgccagcatggtcgtaacgagggggtgaggggtaccatgttatatcggccgccaacgaagatatgttcattttcactggcggtcacttagatgagccgctaacaaaaatggataatttttgctggcagttgggttaaatagtccggtagcaagttacaattatttttgctggcggcccacttaatcaaccgccagccaaaattgatttacactggcgctcttaaaaaaattcgcacataaaaaaatcaccgcgcgcccatacctttatccacccaccactacagaataaaaatatctccacttctcccctccaaatccagatccacttcctctcctccaaatccaagcaccctcctctcctcttcccctccagatccacatctcctctcaggcggcgactgcggggttctcgggtggcgacagcggctccggcagctatgcgtggtggcgacggcgacgggaggcgggcacgtagctgcgacgggaggccgtcgtcgggggggtgcggcgacagcaacgggaggagccgtcggggggcgcgacgagctcctcctcttcccttccccttccacagtggcttggtgctgcgatggttgcggcgacggctcgttgttgcgggacatggcgagctcccccctcccctcccctcccctccccttcctctccctctccctctcccagatctagccggaggggagggggtggcggcgaccacggcggtaacggaaggcaggcggtggtggatctgacaacggggtcggcggcatgagagcaaccgcgacgacgacgaccgtgaccgcggcgacgacgacgacgatgctgcgcgccggccgggagcacggctctagcggcttcttccctcccctccttctccctttcccagaggagaggtggaagcggtggccgtagcggcgacgacaggtgggcggcggcggcggatctgaccgcggcggccataattattagaaccggaccggaccggcggtccggccaggaaaaaccggaaccagggcaccgcccggtaccgcggcagccatagttattagaaccggaccagaccggcggtctgaccgggaaaaaccggaaccagggcgccggccggttcggttcagatataagatcagcgcgcaatcaaaccggagagaaaccggttgaaccgggcggtttactgcagaaccggagaaaaaccggggtggttcaaccgcttgaacggcgtcacacgtgaggtggcgacgctgtagagtacatgcgtcacatgaattagagaaaataggtaaaaaaaagctgtagaacccaaaacctccatgcttccaccgagaatctctaccagcaggctatgtgatgggttgtgaaacaactataacacacacctatttgaacctctttaaaccgacggtttgaccagtccgaccaataaaccagtgacccaagtgacttaacggttcgatcaccggtctggtcttaataactatggcggcgacgacgacgacgaccgcaatcgtcgaccacaaccgtggcggcgatgacgacgacgccgctatcgacagctctatgcgtgggcggcggttgtgatattgatgtttgcttgttgaaaatgtggtgaaaattgatgtattgttttctgcatgtggatttgaatatggatctgatgccgatttgaattgattttgagtatggattgaaaaaaatccaactgctcaagaggtcgattgctatttttttattggaaaaaaaatcttttcgttggcggtcctcttaaggatccgcctgcagcggttctcttaagggtctgccagcgaaaatctattttcgcaagcggtcctcttaagcgtccgcctgtgaaaatcctattttcgcaagcggatcgcaactgccagcgaaaatcttagatcttcactggcctttgctttgtggcggctccaaataccgttagcgaaaacgcaaaatgaccgccacgaaaaatagttttcctagtagtgataagaggagatcgaataaaataaaataaaaatccagaagtgttttaggtggaacctgaatttggttggttacggaggtaatcttgaccctctcacgcaagatttcgttgattttgcttactctttgtttacttgatctcaaccgcgtcaactttttttttgttcgatttgttctactactcgatgaaacaattgcagctctgtgaaacttcaagagaagcctccattgcttcattgttggcctttttattatcgacgtttaatcattctaccattataaaaaccatttgtcgcacataagaaaatataaaaagaaaattacactaagctccaaatgtacaaaaagttactttggcttcatcacagagtatgacaatatcgatcacaactattactcctctctctgtaaaaaagataaattttataactaagaatatgtgtctagactcatagttaagatgaggcttaggatatgggatatagatcgacgttcagagtcgcaagaaggcctcattcaatacaagaacgagagaactagagaacagaaaattttctgaaatactcctccgtttatatatatattagtttcaaaccattacagagcaacaaggaaacaagcagccatcccgatcgatcgaacgaacatactcgaccatgcaagaaagcatctagcattaataggtagaagtagaaccacaagcaacgatcacaatgcgtgcgtacgtaatgtcgtcgtcgtacgtcgtcacgcggcggcggcggtgcggaggaggtagtagtagagcttggggttggcctcgaaggccacgcgggagatgaggtggccggcggcgcctggacctttcatcatcaccaccggcgccgccaccggccaaagcagcaggctcaccgccgcgccgaccacggccgcggcggccgctccgacgacgaatcccagcgacaccatggctagctctcgatcgatcgcggtctcaacctcccaaggtcgactacttctgaacttcccaagatcgagatgactagtgctagacgtggtatatataggcaatttagtctgcattaatttgcttgttttcctcgggaaggggatgggttggaacttggaagctgatcacaatttgaaggacggtatagatcaaacggctcgtagtaaaatgtgtgaagacgatgggacgatgctttttttttttcgcaaaaactaatcagcgaggcctcttgatattgtcttatcgggcgacgccaaccatagaagccgtggagaagccagcgcacatgcatgcctttttttctattacacatcatgtattgttttcccttcttacaaagttttctctcaaattaattatccgatctataatccgattacaccattgtgttcgttgcaattaaatcttcaaaactagatcttacatgattatactacgatgaaaaaatatttatacttgtaaattacttttgttatatacttaagttacttttatcatatatataaattacttttagatttaattaattactttttatatattcataatgctttaagtcgattatatttattatagtttttagtcaattctataatttatggactttaaatttaatttttagatacaaaatatttttctctcgaatttacttctaatgttgtaacaacttacttctattttgtgctaacttacttctattgcatagctaagttacatctattgcatagctaagttactactacaatttaaataaattacttttaaattaatgaaatgtttgaatatattcaacatggatttttttatctcatattttatgtagagtacaatgatgtaaatagatcatgaaaataatatgtgatttaaaagatataagttattaaagagcttaaatctaaaagtaatttatgtataggacaaaagtagcttacatatataataaaagtaatttacaacatagatatttcgtgtaagatcttgttgtaaagatttaattacaacaaccataatggtgtaatcggattataaatcggataagtaatttaggagaaaattctctaggaagaaaaaaaaggcatgtactgttgagtgtactagtaactgtttaagagaagggcgtcgctggttagcgatatgccgctagcgcgcgcgatctagccgtgtctttttttcccacgcttttttgggactccggccggtaattgatccttcaataaagttctacaattaagtgagaagcagcactgagaggatgcccgtttcgtttacccgagtaattaagggggtgtttgggagacttcagcccctctctcaaaaacataagtttctaggatatggacttatggttttgagtttagcccctctctcccaaacaccccctaaatctgtgagcagacgataaattctagtagtagtgtgctccttcccccaaataaaccatctcatttataaaaaatcttagagcaagtttaatagtatagtccactactagttttaaatcatctatagccaatgtaatagccaattcatacaatagttgcttactatactattaatacctggtcccacctatcatacacacattccgttttggagtccgtgctacagctggctatagacttatagcccgctgctcttctctcttcctttatctatttaaaatatgcttatagctggcttatagcgtgctattgtaattgctcttacatagacgtaggtaatagtatagtaggctagtaacaccctagttttctccatcctaacaaaaagtgaatctagaactctagtacaactaatctatatgtgttacattcaatactagattatttttttatgggatgaaaggattaatttttcataggacggaagaagtggtatgaaactcaacgtagcacaaaaaatctagaacattctcatttataaaaatcctatatagatgtaggtagtagtaggctagtaacaacatagtaacatatgaaactcaacatagcactaaaaatctggaaaggaagcttgtttggttggtttagaatatagtaaaataaaaattaaaaatcaccaacatttgtaactaaatttcactcacactaaataagttgtcactcacatccgtggaccttttaacttctaacgataatatctaacttttaaaaataaaattagatatgcattttttatccagatcgatagatccgttaacattgactcagactcgttcgttcatgatttttataatctatgggcatgtttaaatcaattttctgtggtaaaagttttggtgacaaaaaaaaattagcatttgaagttgaagttttaatagttactgtttagatgcatattctaccatttttctggtagagagagcactcccaacgcacttttcgacaaaatttactactctagattttcaaattttcaaatgacaaatattaaattgataacttttactactagtgtttagattcattttgacaaaatatgcttcaaaacggtaaaaacttttaccattttagaggtttggaagaactaaacaggccctaacttcaccaataaacttcaccaataaattgctcgatcgtgcatccacataatgactttaagttgatttttttatatgaagggattaaagttgatttttataataggttaaagttgatatattttataggatgaagggattaaagtttatttttttaaggatgaactaaaggagtacgcgatgaccaattcgaatggaacatactatttgggcgtgtatccatgcaaagctaggatgcacgatctgttgagattatagacatataatgatttaatttattccataaataaatcatgacattacagatgaaaactagcatgaacgcatcattagatctacatatgtaaactatacagtataacataaacagatcaaatatgcgcaacatattgaacacgtaccgaggtgacagaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaacttattgccgccttctcccggtgcaggacgtcgaaggcaaaggttccggagacctgctctcccgatcgccggtgcacgctggcgagcgggatggagtagtctacgagcgacggcgcagtacagagtaggaggcaaaccctagattgatttcgtgtgtgttgcgtgaagacggcaggtcggtttatatagagaagggtcgcttgatcagggcgcccgcacgatctctactgcgcgtaaccgaaccggataagtcacgcgtaacttatctggactccacgccgtttgcacgcaccggatttttcggaagaatctgaatttgcagcaaaacaaaactgcaaaaagaggctgcatctgcgcaagggtgaggagccaatttttcggaccattcaacgcgtacgtcgtgcacgcgcgccgcctgccctgccctgccctgccaggccaggcgaggcgaggcgagcgagcgtgcgcgtgtgtttcccctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatactctgcaggacaacatcttcgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagaatagtgaagccccaattccacagtacctttcagatagcgcattactcgctcaagcgcacgccagtgatcatctcccggattagaggtaaatcggctcaacttgcttacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaagatttgtcccaaatatcagtatgtcgtcaacatacaagcacaaaataactccctcacccccaccatggtgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtatcaaagaaatcttcgccttctttctgagtatagcccttagcaacaagtcgagccttgtacttttcaatagtaccgtcaggcctaagcttcttcttgaacacccacttgcaccccacaggtttacacccatagggtcgctctgttacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctgtgatgagcatatcccagaaaaacacagtccacagtcttaggtccaagtttgcgcttcttcgttattggtacattgactgtcgccaagcacccccatgtgcgcaaataagaaagtgatggttttctaccaatccatatctcatatggtgttttgtccttatttctgttaggaactctatttaacacatgatttgaggtcaacaatgcctccccccaccatgccttaggcagtcccgcggcgtccaacatggcattcaccaagtcagtcagtgtgcgattcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcttcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctggtcagacgggagccactaacaagattcctgtcgaaaacaaaaacgaatccgaatttgcagcaaaacaaaactgcaaaaagaggctgcatctgcgcaagggttaggagccaatttttcggaccattcgacgcgtacgtcgtgcacgcgcgccgcctgccctgccctgccaggccaggccaggcgaggcgagcgagcgcgcgcgtgtttcccctcttctctccaccacacatgcttcaagtgactgggagggtatcctcccttttaaggaggtccccctctcctagaataagcaagtggtactaaactccacatgcatgccatcccatgaggtgggcttttgtgattttccaaagaattaatcttcgagtgggctaagacccattcattaattccaacacgatcaaccacactgcttaccctacaacaaaaccagcagctttttcccgtacgtacgtggaggataactatgtactagtgtagctacatagtacttactagctagctatagcctataggtgtgtagtcgtctatccagcagcagcaatagctaacggagtggagtacgtacgtcgccggcgccgtcgcgcgcgtcaggcggcgacagcaaaagcggcggcggccgccttggcgcctgtcacatcctgattttcgtttcaggatttataaattatttaataaattattaatagaatttatattaaatgttctttaatttacaagtgaagttaaatgtgggaaataaaatttccctaatataaagcatggatggatttaatttttattaaattctccatgattaagtcaactctctgaaatcttctcaaatttttcggagctcaattcctaatttttaatcatacaaagaacatttcagtaataatccacatattaaattaatcattaaatggtctggttttaatattgttaaatactttgagtgtccaagtattttcatgatttttcttgaaattatttgagcattggaagtatttttaacaattcaaagatcatttaagtgattattttaattgggaaagtaataaaaatcctcctcctccgcttgggccattttcggcccattccttcctcttctctctcccttgcgcgcgtgctgtgcagcccaagccggcccaagtcaagtgctctgttctgttctcagccaaccgaaaaaagtctagtttgcctccctggcactgttcatcttccagctctggacagagcccgagccagccgagcctgtgcacagtgccgccttcttccaccaaatccggcctcctcgttgctcctctttccaaattagttgaggggaaatattcctcttattctcctcttccttttccccaagaaatccccaaaattttatatggaaatcctttccaatttcgcggatcaaatcctttcctttttccggcgaagataaactttcccgagtttttcccgtcgttttgggcccggacccgagcttccaaggctataaataggaccccctagtcctcctctttcgtttgccccctctcccgagctctctagtgcctcgtagcctcgtcgccgcgcgcgtttagttcgtcgccgccgccggccgagtgcagccgcgccgccgcgccgcttctgccgtcgccgccgcttgccgccgtcgccaagaggtgcgccaaggggtggagaagcccggccgcccgtccttcttcgccgccggccgccgtagctcgccgtcgtcggtaaggtccaagccgccgccgcctcctctcgtcgccggccgtcgtcggacgtcgattgtcgttgtggtgagtaccgttgggttcgcctcgtcgtcctctacgtgtgcatgccctccaaatccgcagccggccgctctatctccggcgaggtcgtatcgtggttcgccggcgccgctccagcagccccgcgccgtcgctgtggtcgtcgccttcggtcgccgctgccgccgttgggttcgcgaggaggagaagaagaccggcctccacttccccgtcgtcgaagaccccgggaagcccgtcgtcaccgtgaagccgatccgttccatcttcagccgcgccgttcgtcgccgtccatcgccgccttcattcaccgtcaccaccctcgggatcgcaggagcgaggtgaagaccgtccgccctcggttgttgcctctcgtcgccggaaagccgtcgccatcgtcaacccaaggtcgccgcctttggagctcgtcgcctgccatctccctcgccgtctgtcgtcgcataagtggtggtaagggtcactttgatcccctctcgctcccggtgccctccgtttgcgtttgtgccgtggttcgccggcaaccgccgctcctttgccgttcacctgtgaggttttccctagggccttaatccgatctaatctaatcttgtttggccctaacgtcatcatcgtctccgtgtgtgtcgtcatcgctgtgtcgtagctgctgcttgccgtgccgctgctgcgcgtgtgccggctgagccgcttagctgcagctgcttgccgctttgccacagccgcagccgtgccggttgcgtttttgctcatagccctgctgttctagccgtgcatggttgctaccggctgtgccgtcaccctaaccctagctttgtgtatccgctgagctgccgcctagccaagccaagtcgccctagtgccgccgtgtcgcagttgtgtgccgcttaaacctagccgctgcttttagtcgagttgtgcagccgtaggtgcaaccctaggttcctaccggtctatcgtttgtcgtaccggggttttaccatgaatcgtttctagtccaccggtttagccgcagccgttgttgagtcgttcgctcgttcgttcgaatgaggtgttccccgtgcttcgttcgttcgtccgtgttgagtcgtcctttagttcagagccgccggttccgttcgccggtttcggttgatcatttgggtgatcccgtgtcacgtagaattgactcgttgagtcggtatctcgtgaggcccgcttgccagatcaatctaagccatccgatcttggtcaactctcggtcaagattaatctcagccgtccaaaatcaatataaattcgttctatcttttcaatggcatattagtcctttttctttttatcatgtcatctaccaatataatctaatcttttccggaggttgctttaatcttctgtctccgttataaatcatttgtaaattgtttaattaatttggaatagtcttttctttaataggtttaattggaatttaatcttgtaaaattcataataaattcatatgaaatcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgcttgcattgattactttaatccttgataccttgggttattataatttgactagttgagctttatatattagttcagctagatattagatgtgattgcttagccatgcttagaaacattagcacactattgggataacttatgattcgttattatttaatgatggtttaatggtagctcacgatggtcaaacgtgattggttaattaattacttgccaactaaaacttgataatggtgggttgtgagcacatggttttgagagtcgtgctcatgacaattaaggaccggttcgcgaggtactgttgtgaaacattaaccgtaccaaccacaagccagcgtgggcaacggctttaccttttgtatagcatggttcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgaacaatgtttttcgtgattagtctcacacctctcacaataattatggatgctataactggtaataatttgcttagctcctggtttggagttaaatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaagaatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacagcgcccaccgtgcgcaggaggtggaagtagacctgcgggttcgccaggaacgccgcgcgggagatgacgtagccggcggcgcccggcgccttcatcatatcatcgccgccgccggcgccgaggccggccacagcaagtacaagaaggcggtcgacccgacgcccacggccacggcagcgatcatcgacggcgccgcaaccatcggcactacaagtttgtaattccagatcgcgcgcgtggagaccaacgaacaatggaggagatcgacgaagagatcaagcagagtgaaaggtgcggccactggtggtaaagctagtggtaactggttttatagaggattgcaaaacacaggaaagacatagaaatgactgtttgattgggccgcaggaaaaacataggaatttgaggagaaataaagactcaaaggattctttccatgaggttctatctcatgtcaaatttcctccaaaacttgcaaaacttgtatggaaaaagataatccataggaatttcataggattttataggatcaattcctttaatttaaagggctatatagaaaaaaaatcctacaggaataaaaccatctaaaatttctatgaattctttttaatcaaagggccctaagttgctggtggttctgttcatggtggctgggttcctccggaagggccgggaaggggcgagggtgcacggacagcgggacaggtggcagaagtgtgggatgcatattgcctggttttttacttttacctggtccgtctactcgacacgcgtacagggatcgagatcggtaggggcggcgctccaaggagcatcacatcggtagagacggtgacgaaggagatcacggcaggctcgtatgttatcatcaatcaaatttgtatgctttacacgtgagatctacgtgttatatatttaaacaaacattattacactataaatgtatgttgtgtgttcttatttatagggatactagcttaattaaagaaaaacagattgagaaaaaaatttataaatgataaaaagaacgttgattggggaccaaatcagagtattccccaagtctatttgaagattactacgtcacttttagttcatagaagataataagatataaagtttttaattcggattcagctctcctaacaccatcaatttcaaacggatctagccgctcatatagaaggaatctcgggggtccatgtcacgccccgaactagtcccgaccggaactagcccgtgacgttccaaattaacctgttaatcgataccagtcccaggaaacagtgctggtatcacagggagacagaatatcatagcatcagaggtctctttattatagagtagaggtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcagcttccgcttcatcttcttcagcaacttggggggggtcatttatatagagcaagggtgagtacgggagtactcagcaagccatgggaaataagtgtttaatgcaggcttcaaggaaaggctgttgtttttgcaattgtttttatttgaactcttttctaaaacaactaggtgagtgcttctcaaacgacacggatgagacagtgcgtctcgtccggtcggagtatgtgcaatgtatcagtctttagaattgaaacaaggttggcacccggccaacagcttttcaaacggccacccgggccaaccacttttcaaacggccacccgggcctagctgatcccatcacctgcagaattttcaaacatcgaaccccttttcacaacagtaatttcacaagcagtagtcaaacaaaactacgctaggaatcacctcacatccgcccatgaccgtgggcacggctgttcgaacagtttgttaacctctgcagagggggtacactttactcacacgacattactaacccggatcacccagcccgtggggatcagccacgtcgggagacctccaagctttcatgacaaggcatttccaaagccgacacaggtttaccatatgccgacgagaggagtcccagaccaacaacaggttaggtcccagaccatactgtgccaagaagcccaggggtcctccccgacaccaccccggcgaatccacatgtctctcggcatcaaggctcccctgataagctagttactcagccaagggtgtcccattccacccatgtggtcgtacttgtcttatgtttggatgaaattccaaggaaatcggtccttaagtgcgagagcgggaaaccgtacacccggtacgttccccggtccgcggttttggaaattcatttagttcgcaagcaccgacccaggtgtcgggttttccaaatcttttgtaaaacccaagttttacgcaagttgttattcagattttaagtttgaaggcgtccgtcgatactcgcacagggtgcacgaatatcgagacgcaactagatggttacaaggggacatggtataacaattaacaaaagaaggatcaaatacaacaaattagataggtccgccaatctgccttgcagacgggacaaacagattaagtgcgatcctatcaatgcataatatttttcaagcaacataattaaatttcaaatataggctcaagatgttcaaaggtagcttgccttgctcgagatctggagcttgatcctcgaaatcctcgcactgcgggtcttcgggctgtcacgccctgaagttttcccccctttgcttgctttaaaaattggttaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatcctttcttctttttgtttttcctttttcctcctttttcctcttcttgggccgtcggcccagtccacccgtcgcccgcgctcggcctccccttgtgggccggcccgttcccctttcccctccccgaagttctccctccctccctctctccttcgggcgccgacaggtggggcccacctgtcggtcgtcttcctcctctagccggttggagccgagccccaaccgccggcgccccacctccccacgccgcccgccttctccgtccctctccgcgcccgcacctcgcgcccacgtcgccgctctcccccccccacatctcccgcgcgcgcgcgcccgcaagtggtgggggatttgaatccctctctctctctctcttcctccccactcccccacatcgccggccaaatcggccacctccccggccacgtccgccccctcccgcacctataaatcgctccccgcgtcttcctctctcgtttttcgcactcgccgcgccctcccgtgcttcctatcgtcgccgcgccgctcgccccttgcgccgccgcctaccgccgtctccggccacgcgccgccgccactatagccaccgccgcgccacgcagtcgccgccgtcgcgctcaccgagcccgcccgcacctcggccgccgcttcattgccgcgaatcaccgccggagcccttttctcctcgcgcgccggtgagaccctctctcccctccgtctccggccggcaattcaagccgccatggtcgccttcccttccctaacccctctatgctctctcctagggtgccgccgccgcccgttcgcgcctcggcatcaccggtcgtcgccgccgttttcttccttcgcgccggccgccgtgttcgccggtgaggaatcccctctcctcctccttccttccctccctcccatgagcgccgccgccctccgcgcgtgtgccgtcatcttcggccgccgccgccgccttcgcactggccgccgccgtctcccgcgccgccggtcaccgccggtgaccgcgcgtgtcgccgccggtcgccatggccgccggtcggctttgaggccgagccgagcccggccggcgcctccctcgcctcccctttgagccaccgcctggtggggcccacctgccagccgccccctccctctccccttgtgccgctgccagtggggcccgcatgtcggcgccccccccccccccttggatgacgtcagccctggggcaatattgcgcaataattaattaaggacttttctttattagtaaaaacacagtttatcttctaaaattcataagtaattcatccgagctccgtttaagtccattcaagtctcagtaaatcaagaaaaatgcaaagaatccattaaaaatagttttgtttcctgcttcagtagtcttatagcctgttttgcttgtgtgctttgtttgtcgcgtagatttcggccgtttcgtcgatccgcagtttctcgaagacgttgctgtgatctcatcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttttttaaaaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttcccatatttctacctatccccttcagatggagataaggaatggttcacgcgactcgaacaacgccagtggcagcgaagagccgatcaatggagcacgtgccaacggtgcatctgacaacagtccgtccccaccgcccgagaacccaacaattgctcaggtgttggacaatcagactcagataatgacaatgatgatgcaacagatgcagcaacagtaccatcaggtgatgcagcaggtgcagcagcaagcacagctgcagcagcagaacctgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccggctggggcagaggttacttggacagagtttcgtcatagtttcaataaagcacaggttcccgagggaattgtgggacaaaagaagagagagttccgttccctgcaacaaggaaccagaacagttatagagtatttgcatgagttcaaccgcctcgcgcgctacgcccctgaggacgtgcgtaccgatgccgagaagcaggagaagtttatgtctggtcttgatgatgaattgaccaaccagttgatctctagagactatgaggactttgagaagcttgtggacaaggctattcgtcaagaggagcagtgtaacaaaatgaaccgtaagaggaaggcagcccagttcaggactccccaggggaagtgtcagaagcctcgttacacgatgggacgtcacggtggaccttccaccatgattatccgacagcaccgtccctaccacccgggtagcttcaataagacccaccatagtgatagtcacaacaacagtgagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgcccaaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaaactagaggatattcctatagtcagagagtatccagaggtttttccggatgatctgacaacaatgccaccaaaaagggatatcgagttccggatagacttggtaactggaactgcaccgatccacaagaggccttacagaatgggagccagcgagttggcggaagtcaagaagcaagtcgatgaacagttacagaagggatacatccgtccgagcacgtcgccttggggtgctccggttatctttgtggagaagaaagacaaaaccaagaggatgtgcgttgactaccgcgcactcaatgaggtcactattaagaacaagtaccctttgccaaggattgatgatctgttcgatcagctgaaaggagctactgtgttctctaagatagacctgcgatcaggttatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgttgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtccccatgaaggcaactacccgacgcacgatctggaattggccgcagtcgttcatgctttaaagatttggcggcactatctcatcagtaaccgttgtgaggtatatacagatcacaaaagtctaaagtacatcttcacccaacctgatctgaatccccgacagcgaagatggttggagctaattaaagattatgatatgggaatacactatcatcccggcaaggctaatgtggtagcagatgccttgagcaggaagagttactgcaacgtcgcatgggtagaggaactatgctgtgaggtacaacgtgatttggaacatttgaaccttggtatagttgagcacggattcgtggctgccctagaggcacagcccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggcagtaccaaaatgtaccaagaactcaaagaaaagttctggtgggtcagcatgagaagggaaatagctgaattcgtagcactctgtgacgtctgtcaacgagtaaaggcagaacaccaaaggccagcaggattgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattaggaacccggttgaatttcagcactgcttaccatccacaaacagatggccagactgagcgagtcaatcaaatactagaggatatgttgagagcatgtgcgcttgactttggtggagcatgggacaaaagcttaccgtatgctgagttctcgtacaacaacagttaccaagctagtctgcagatggcaccatttgaagcactgtatggacgaaggtgtcgtactccgctcttctgggatcagacaggggaacgccagttgtttggtacagaagttttaaatgaggcagaagagaaagtcagagctgtcagggaaagattgagaatcgcgcagtctcggcagaaaagctatgcagacaaccgccgaagggagctcgctttcgaaacaggggattatgtgtatcttcgtgtcactccgctcagaggagtacaccgtttccaaaccaaagggaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcaaatcaaaatccaggaagacttgacgtatatggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttcccccctttgcttgctttaaaaattggctaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatcctttcttctttttgtttttcctttttcctcctttttcctcttct

SEQ ID NO: 36032 - DNA, 344 bp, Oryza sativa
aataccatggccccggtgagcccctgggatcgcaggcccgccaggcggtcgaggacggcgtcgtactcctcccccagatctaccggcgcccgccagccggagacctgcgccgggggctggctcggaagtcggaggcgcgcttcgtcggcaaggggggtgtagaaccagtcgctcttccagtcgtcccacttcttgcggaggacgcaggggatatagcggttcagcaccggcccccgcggctggaagtagcagccgccaaccaccgacggcggtgacaccgactgcacggtgaagaaccaccggaacagctgaagagaggggcgcaccccaatgaacatctcgca

SEQ ID NO: 36033 - DNA, 957 bp, Oryza sativa
ctatacggaaacaactttcagatatagaaggggttctgcataagggaaggtgaatagagtttacatggaaacgacaaggactactcggattgtatccatattggtttccctagtcctacttggacaaggggacatatgggtataaatacaaggccccctaggaggagaggggacacgaaacaatagatcaagacacaagatccacatacaagccaacatgcgccaagacaagacgccggatatcgacttcagagataggcatggctaatcccctacggtgtctccggatactgtcaggagagacatagcgttgtctctgatctcatcgggcacggattcgaggaggaagagtactctgtcgtcgactacgagtcagaccttcagaccgccatgtcgacaacagttagataggctaccccaaatattgtactggtgtgattatggtgaataagatcaatactggcttcggccaacaggatgtagggttattacctgacaattcaggggcccgaacctgtataaaaatcctcgtccccatctcttttacctcagtctcgcacatatcctagtaccaacgatccccatactatgcaaataccggaatcacgacatcaaacgttgacacatattactactacttactagctcgatgtgatcccgtactagttttgtttattttaagataaagtaattatatattaaatttgtttatttttagatgaagggagtatgttgcaaagaaatggttatattttgtaacggatcggatacattttttttacaccaaccagagcatgaggaaagatactactccctccgtccctttttagtgtagttacaggtttctatatctaacgtttgatcgtctgtcttattcgaaacatttgtatgattaataattttattgttattagataaaaaacataaatagtattttatgtgtgacttctttaaaaa

SEQ ID NO: 36034 - DNA, 1435 bp, Oryza sativa
ccaggcgccctcccttccccttttcccctcccaatcttccctgtttctcgcccgcgccattgccgtccttctcgccgaccgcagccgtcgcgtgtgtgccggaggagccggtgcgcactaggacgcggaagggaacttcggccgcgccctctccttcctcttctccggcccgaggccggagagattactcccgcgccatcggcctctcgtcacagcgccccgacccgcacggtagtgcccctctccgttcttcctcctcgctccatctccccccttagtcttcggtggtagcacgagtagactccccgtagctagccggcgccgccccaaccattgccgtcgctcgccgtgtgctcgccaccgtcgccgctcgagctccgtagcacccgcacgtcgccagcctcgatcggcgtagctccgcccaatccgacgctagcatcggattcccgtggccgcgtggatgctctcaccgccgggaatcggcccctcgtggcctcgtcgccgtttccctcttccctccccgccggttgtcgccgccgcgattcgccgccgtcaagcttcctccggcgaatccgagccgttggctcgtctcccctcgtctcgtgcaaccacccggcgtgctcgctttcgccggtatcgccgtggttcgctccgccgctcgccgctgttgtccgccgtccgttccggccggcgtcgtcgtctacctcccgccagcccacgtggcagccacgtaggcgccacgtcggcgccagctcagccgaggtcgggacgggccgaccccggtcagcccctcccgtgcgcgcgttccaccgcgagccgtgaggctgcgcgtgggcccgccgcatccgttcctccgcagaccgcgcgcgtgcaccacgtccctcccccgcccgcgcgcgtgcgccgcgtgctccctccgcacggtgagccgagccgctgacaagcgggtcccacccgggaccgcgcacggtgagcccggtccaccggccctctctctcctcccctcccgcacgcgcgcacttgggccgccttgggccggccggcccatttagctcggccggtccgctccttttcccttgggccgcgccctagccgcccgaggaaaagtctataatccctccctctttccttttcttttctttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgcagtttgttgagttgtcccgtttcgcgtgtagtttcggagcccgtgtcacgcccagaaattctcgaaccagaatttctaagctgaatgtgcattaaatccctgtccaggacc

SEQ ID NO: 36035 - DNA, 2777 bp, Oryza sativa
cctccaattccggtacgccccgttgatccagatgctgattttctccatgtgtgtttggtcgttgcttggtccttcctgttactagtataccgtacagcgttgagaggtcgctatcttgcgctgctcacggtgatgagctttgcttggatcgattaggtgatgcagcacacggttgttacctcaatctagtctcgattagacatgctacatagcagcttaattattcagatgtcgtttttctccatgtttttgcggttgcttgatcattcctgaatcctgatacatactgataaactcaagaggctcatttaagtgcatctgtgtgtacccgtgcaggcattcaacatcagataggccaagatgaacatcgccacaggggcaatgaacaccctcctccccaagcttggggagctgctggttggcgaatacaagctgcaaaagggtgtcaagggagagatcgaagaacttgagaaagagttgaaaggtatgaacgcagcactccacaaggtggctgagacacctgtggatcaacttgaccagcaggtcaagatctgggccagcgaggtgagagagctatcttacgacatcgaggatgccatcgacaccttcatgttaaagtgcaaggggcatgaacctgccacgagcttcaagaaggtcaccaatttgttcaacaagttcaaaactaaccatcagatccacggtgtcatcaaagacatcatggaccaggtcaagaaggtcagcgagcgtcgtgataggtacatagtcgatgacaatgctgccaggccaactgttgtggatgttgattctcgcctagaagctatgtaccgaaaggcaacaaaactcattggcattagcaagccaaaaaatgagctaactaagcgactcttggaatatgacggctcatccagccaacaatcaaatataatttctattgttggattcggaggcttaggaaagacaactcttgccaattcattatttcaggagcttaaggcaaaatttgacagctattgttttgtttcggtgtccttgaatcctgatataaacaagattctcaagaacattcttctccaacttgatgagaaaatgtattcccacatagatgaaacatgggaaacgaagcagctcatcgacaaaattagagacttcctcaacaatagaaggtacatttctatgttatacctaccttttatcattatttgaagataccttttgttgtacaaataagagtcctggctcaagtttttattgtattctaatataaccgggaatcctagctcaagtttttatactattataatataactggcttgtaaataaagttttggttttccaatggaacacatagttattcagaaatctgccctatttacgcataattaagtatctttgtaactttgtgaatagaaattcacaaagctgcacttattgtgtcaaaattgttggaaaattacacatttaaagctgcacatcattttcgacattcaatgtgcaagatacatattcctatcttttttggacaggcttcacatgatttatatctaggttcaataacatgtgtatatgctaccatctttaggttcttgtgcgtgattgatgatgtatggaaaaaatcagcgtgggatactatcaaacttgctgtgcaagatgctaaacttggtagcaaaataattgtaaccacgcgaaacaaggtcattgcagaacatgcaggcggtggtgtttatgaaatgaaacccttatctgatgatgattccagacaattgttctgcaaacgaatatttgactctaacgatgactgtcctgctgatttgtgtggtgtcactgagaaaattttgaagaaatgtggtggtgtaccgctagcaatcatcactacagcatgcctacttgctagcaaaccaaggaattcagaggaatgggacaaggtcaataagtctatcagtttggggcttgagaacaaccttgatgtggacaacatgcggaagatattaagcctcagttacagcgatctaccttttcatttgaagacttgcttgttgtctctaagcaaatatactgaggatgagctaattagaaaagatgttttgatatggggttgggtagcagagggttttattacagatgaaacacgacctgcagggacaagcttgcaggagattggcgagagctacttcaacgagctcatcaatcgaagcttgatccagccaatgagtgagaacactctttgggatgaagatggtaaggtgcatgcatgcaaagtacatgacatggtgcttgagctaataaatcagctgtcagtagaagaagattttgttacaacgtatttatctgatggtcaacaaacaggtaaacatacatgtacagcacaaaagaagaagattcgccgattatctctccataacagcaataagtcctatgcctcgccagaagcaagagaacaattgtccaaagtaaggtcgattactatcttcggcaaggtcgactcgataccacccttgtcgagctttcatgtcctgcgtgtgttgcagcttgaggactgcagtggaatggacaagaaccatcttaatcatctcgataagctactcctcctaagatttctgcgtctagggcactatggtgccactgagctccctgaaagcattgggaaactggaatctctcgaaaccttggacataagaggtgcacgtaaaccaagttcttttaaatctcataaggtactgtttccaatgtctttttgccaaactaaggaaactgttgcggctatatgctggcagagtgaa

SEQ ID NO: 36036 - DNA, 688 bp, Oryza sativa
ttgttttcacagacgggagcatgaacaaaggattaagcaacggtcgacactagatacctcttgatgcttttttctatttttaggcgtggagtttctgaactttgctttgtttctgtttggaatctggtgatggcgctagcgcatatgtaccaagtggccgtcgctgaagcagtggacggatgaagcggtggcagtgcgggtggccgcagagggtgtggtttgcgcgatgaagctggccgcgccgcgcctatacctgtggtgcacgcgcctcggcggcaggagcttggcgccgtccaattatctaagggctggcagtctggcacttcgccggccgccgtgatgcagcgccccgggttgcgctgatggatgggttgacagactctactagaaaaactattttttacgggcggccaaaacatgttttcgcgggcggccaaaccatccgcacgtaaaaatcattaatttttccagacggaccaagcaccacccgcgaaaatcattttcacatgcagaaattcaattttcccacgcaacagcagccccgcctgtgaaaatagtttcagcgctaaaaaataattttcggcagcaaaccagcccgccctcgggtttcacccacaaataaaaaattcttattcattcaacaaaagacaatcacaaacatccattcatcaacacaatctatacatga

SEQ ID NO: 36037 - DNA, 349 bp, Oryza sativa
  unsure (1)..(349): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtttgagggccaacggaacgaaaacgtacgttaaggagataattcaatgtttatatttaaatatagagctctcagttccccttttaaaatatcctttggcgacgtgaatgtataa

SEQ ID NO: 36038 - DNA, 739 bp, Oryza sativa
gtgcttatatttttcttgtacaaggttaaggcattatctattgtccaatgaatgcactgtcatatgcaaagccgatgtcgtcaagtgcatgttatcggctccaattttgaaaggaagggttggaaagtggatattttccttaacggtgatcgatcttcggatgagtcaccgaaggcggtcaaagggaaagctatagccgattttattgttgaacatcatgatgattcaatcggctcggttgaagttgtgccatggatttagttttttgatggatcagtatgcactcatggttgtggcatcggcttgattataatttcccctcggggggcaagttttgagtttgcttacactattaaaccttatgcaactaataatcaggctgagtatgaagcagttctcaaagggttgcagttactcaaggatgttgaagccgatgctattgagataatgggggattcttggctagtgatcagtcaattggcaggagaatatgagtgcaagaatgatacattaatggtttataatgagaaatgtcgagagctaatgaaggaatttcagctggttactttgaagcatgtatcgcgatagcagaatattgaagctaatgatttggcccaaggggcgtcgggatataagccgatgatcaaagatatcaaggttaaggttgctgcattaatagccgatgattggagatatgatgtatatcaatatttacagaatcaatctcaatcggcttctc

SEQ ID NO: 36039 - DNA, 1772 bp, Oryza sativa
  unsure (1)..(1772): unsure at all n locations
tgaaatatgcctttttggatgatgaattatattatcaaacaattgatgaggtgttacttaaatgtttcagtgccaatcaagctaaggttgtgttgggagaggtgcatgaaggtatatgtggtactcatcaatcggctcataaaatgaagtggttgcttctgcgtgttggatatttttggccgacgatgttagaaggttgtttccgatactataagggttggcaagattgccagaaattagaagtaattcagagagcaccagcatcggctatgaatcctataattaagccatggtcattcagaggttggggaattgatatgatcggtcagatcaatacaccttcaagcaatggacataagtttatattggtcgcaacagattattttacanaatgggtggagggcagttcctttgaagaaggttgattctggagatgcgattcaacttgttaaagaatatattgtttaccgattcggtgttcctcaatatatcacaacagatcaggtatcaatctttctgtccgatgaagttgtccattttgtagacatcatgggcattaaattgttaaattcttcaccatactaagcgcaagctaatggacaggctgaagcatctaataagagtttgattaaattgatcaagaggaagatttctgatttccctcggcaatggcatacaaaattagctgaagcgttatcatcctatcggatggcatgtcatggatcgattcaagttccttctttacaaacttgtttatgggcaagaagcagttttaccatgggaaagtgtcaccggctcgaggattatagatttacaagattaattgacagccgatgattattacatcttatggtagatgaacggaagatctggtccattctagattacgtgctttggaaaaagtaacgagggataaggaacgagttgctctccattacaataagaaagttgtgcctaagtcattttcagaaggtgagctggtttggaaattgattctgctgataggaactcgtgacaacaaattcggcaagtggtctccgaattgggaaggaccgattcgagtatacaaggttgtgttgaagggagctgatatgttgcaagggcttgatggagaagtttttggacgagctctcaatgggaaatacttgaagaaatattatccaagtgtttggattaatgcgtgaccggctgagttttgtcgatacatgttagccgatgtgttaacatcgcctttagatggccgatataagttatatcacccttagcattgtttttatcatagttggttgtgttttaccaatgtatgatggccgatataagttatatcggtggtgtcgtgccgatatgtgatagccgatatttgtcatatcgcccttagcacaattataattttatcaatgtgtcctcagcatggcaaaattaagggggcatacatatatgtaaaatgacggatttcaaaagcaaaatatcaatgatgggtttctaaagcaaaatatcagaacaaactatgtttttgtctgcattacaagtattgcacagttggtttctaacttgatacaagcttgttaatagccgatatggcccattgcctaatttgttctatatcgttatggcttgggcatcggtagcatcggttccagggatcacttttaaggatttgctcagatctgacagatgcttgatggaattccttaactttgatctcggcttctttcctagctcagctaagagttctgctctacgagacttcagccgatcaatgtagatttgta

SEQ ID NO: 36040 - DNA, 690 bp, Oryza sativa
aaagaaacttttctaaagataaaaggaaaacataatgtccttattggacactaaacatactttcctaaagattaaaggaaactaacaaatactggctaattaatagataaattgccatgccgcattcttcttgaactcggtcccttatggataagcttccttgaatagattaatttccttaaccggattctccaagaatccgactgctagcaacttgataattcccatcggtcgattccaagactctgaaaccgatactgactctaggccgatgatgacttcgggcttaccaaattttggtgttaacaatatccttatgtttctgaatctgaagaagatgatgtctccgaagtagcagcagcagccgaatgggcgagaaacaagaaggttttaacatgtagtcggtcaagaattcggggaaagatgagagatgattttgacatcaccaaggctgataaaatatttaatctactacttcggggaaagcagatccaacttcctactggccactcaatcccatcggttgatgaattagagaaaagaaaatattgtaattggcataacactgggtctcatactaccaatgactgcaagggtttcaggcagcagatccagtccgctattgaacaagggaagataaagtttgatgattcaaagaagccgatgaaggtgatgatcatccttttcctg

SEQ ID NO: 36041 - DNA, 604 bp, Oryza sativa
  unsure (1)..(604): unsure at all n locations
nnnnnnnnnnnnnnnnnnnnnnnnnnnnnnnnnnnnnnnnnnnnnnnnnnnnnnnnnntatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaaaaagagctgggtacccgattaaatttcagcaccgcatatcacccgcagacggatggacagaccgagcgtctaaatcagatcctagaagatatgcttcgcgcatgtgtcctaaatttcgggaagacctgggataagagtctcccctatgccgagttctcctacaataacagctaccaagccagcatacaaatggcaccttatgaagcgttgtatgggcgcaaatgccggacaccgctcttgtgggaccaagttggggaaagtcaagtgttcgggactgatatcctgagaaaagctgaagcgaaggtcagaaccattcgggataatctaaaggtggcacagtcccggcagaaaagt

SEQ ID NO: 36042 - DNA, 763 bp, Oryza sativa
agaggccagtgaaaatcctggacaccatggagcgcaggaccaggaaccgggtaatccgtttttgcaaggttcagtggagcaaccacgccgaagaagaagctacctgggagcgtgaagacgagctgaaggcagcccatcccgatctcttcgccagttcttccgaatctcggggtcgagattccgtttaaggggggtaggtttgtcgcgtcccaaaacgactctaaaatacatcctcaaaattatgcctagaataattaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaagtcccttttccctccctccccctcttgggccggctcggcccatctctttccctctctctcctcttccccgcagcccattcggcctcctccccgcgcgcgcgccgctgacgggcgggcccgcccgccccctcgctgacgggtggggcccacccgtcatccccttcctcccgccgctcccgccaccccgccagcgccctagcgccgccgccgccgccgcgaatcccgccgcccccgtccgccccgcgtgcaatcaagaggggggaaatattccccgggatcccctcccgggtaccgagctcgaattcgcctatag

SEQ ID NO: 36043 - DNA, 2003 bp, Oryza sativa
  unsure (1)..(2003): unsure at all n locations
atcgcgcacaaggtgttcgactgacgggcgagggtggttgatggaatggattggtgaagcagagcttcggagttgcggggctatggttgttgatgatcgatgatgggcaaggaagggattggggtcctatttatagggccaaaagtaaaggatgagctcggacaccatcatcgccatggatgagctcaaggattggatatggcaaaggtggcagaggctgtgagggggcgggcaagatcaatttgagtggcgggaggccatgtttgaatacttacctgtgaaggattggcttgactgcgggtagaaatggctggcgacgtgttggcgccaatccgggcgtgacgcgtggcggcggcgagggttaaaacggccggctcgggtgtgattggtttgaattgtgagaggggaaaccaccttctatcttcaattcaaccttgcggcaagaattggcgcgattcatcccgggtagaatcaaaatcggactcggcggcagcgttggacgggagcgcacggcgtcgagctgtgatttcttgcggcagaggtcgtcctggctttgtcgtcgtcaagattggtgcggcggcggcggtctgagggcgtcggacggccgatggcgcgcgaaggcagtcgggcacgcacaagcgatctcgaggcctacgcgctgcggcgcagcgcgcggcaagataggacgctaggcagcgcgcgagaaggggaggagaaggccaactaaaccatggtttttgagtgggatgtggtccccaaggtccaaacctaaactttgtgcaaggttggatgggtgttgggctgttctagctgggctgggcatttcatcgagcaccttgagtgcaatgaacagtgttnttcaggacttttgaatattttatctagagagaattgaatttaaactatgaatttgaaaggttcactagggtttaaagtatataaattctcaacaatattaggataaactaggaaaataatctatagtttgaaatttgagagaatttgctcaatttcactaaggtttgaaaattagtagggttctaaagaagtaatacttgaaccatttaagaatcaaataaatttttagaacacactaaattaatgaaaagccagcatgatgcaatcaaattttagtttaaaatttgaggatgttacactatttttccagacgcctcttaagggacggcatgggaaaatatattttcgtaggaagcccccttaaaaattcccccagaagtctgagttaccgagttaccttctctttttccctcctagcactttaaaattttcaagtcattctaatcttctctcctctctctctctctntgaatctcacctcccctcctccacaaactcagtctgggcaaggaagcggcgcacggatgggcacgcgacggagttcggcagacagcgttcgtgcggcggcggagtgcaagtgacgggtgagtccctcctccgtgtgtggaaggcggtcggccgacgggcagcggacgggctcggcagagggtttttttcgtgatttttatttttgcgtgtagacaacataagcacccacacgtgaaagtagcgatttttgcgtgcgggtgacccccccccccggcgcacgcaacgatagcaattttcatagatcctctagtgcatgtgggttgttctaccgcacgcgaaaacctcttttggccatctgcaaaaatcaaaaatcacttttttgtactagtgacttttgttttggttccaattgttagataaattatattttacacaagtagatgccgatgtgggaatgatttgtagtccgcgtgtggaatcacttgaaagcttcctaatgtcaattttatgtgtatgggaatattttgatatcatttgttgtaatagttatattttacatgactaaccgtgcataagaaagcgcttaaaatggctcttgtgtcggttttgcacatgtgacaatgatttgtactacgtgtatcaaactgctcgaaaccccactagtgtatcctatctgt

SEQ ID NO: 36044 - DNA, 1297 bp, Oryza sativa
atcacctggacactatggaatggtttgatattgtggaattggattcacaccttcccctctattcaaaacccccaaaaggttttaggctgggctcggggtgcatggttttgatagtagcacctcggccatataaggaccggtcttcgggcctctggtgcaaagcactaccgtacttccacatgtttagttggttaggcttagtttgtggctcagtctggttataacaaaagtacccgaatgagattgacgaagtcgggggtcgatgaacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttttctatggctaggatgggttggaaactatgtcacgtcttccgtctgtataccgtggtggtatgtggcacgtggctacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtgaaatggttggcctgggttggcttaggacgagctgggacccagggtcgggttgccagttcggtctgaatcatcataggccttgggttaaggcaggttcgtgtgggttcacggccttgattaataacattgtttagttctaggatcgtgtttacaaaatagctttgagcaactaaatgtcttttaatgctgtttactgcaactctaaccccttatgttataactcccttgtactcccttgcatttattatgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattatatttacgcttccgcttgttaaactctgaactgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagcaatattttcaaaaataaaaatc

SEQ ID NO: 36045 - DNA, 1369 bp, Oryza sativa
ccaccaccaccagacaccaaggccattctcacccaaatcctggcccagcaggccaacatgatgacggctttcctccaccacctccaaaatccgccacaacagaatgctccaccaccacccccacaacactttaaactcgccgagttcctccgcatccgtccacctaccttctctagctccaacaaccccgtggatgcgttggattggttgcatgccgtggggaaaaagctagacaccgtgcagtgcagcgatgaggagaaagtcgtcttcgccgcccaccgactgcaggggcccgcatctctatggtgggaccatttccaggctacgcagccagaggggcagcctattacttgggcccgcttcaccgccgccttccggaggacccatgtgcccgccgaagtcatggcccttaagaaaagggaattccgagagttgaagcaaggcaaccgctccgtgatggagtatttgcatgagtttaacaacctggcccggtacgccccggaggatgtacgggaagatgaggaaaagcaggagaagttcttggcaggaatggaccctgagctgtccgtgcgtctagtctccggtgactatccggatttccaacgtctggtggacaagagcatccgcttggaagccaagcacaaggaactagagtcgcacaagcgccgcttggcgaatttccgcaatcaacagggtgctaaccaaagggtccgctacaccaatccctatccagggggatcgtcctcgcagcagcaacagcagcaacaacctcgctccgcgccccgacctcaattcgtggtgcgcgtcccacagccgcagcaacagcagagtcaacaagggactcgtgcgacccgtcctcctatgccagccgtgcagcctggtcaaggccgcagggacgttcaaggtccgcagcgtctgtgcttcaactgcttcgagcccgggcactttgcggataaatgcccgaagccgaggcgccagcaaggccaaccgcctccccgctccaacaacggtggtaaggatgtcattcgggatcgtgtgaaccacgtgacggccgaggacgtgctgacaactccagacgtcatcgttggtacgttcctcattcattccatccctgctaccattttgttcgactctggagcttcccactcgtttatatcggtgccattcgtggggagaaatcagttgggggtagaaaggcttaggaacccttgctcatcaccacccctggaggggttatgacagcaaagtattatagtcctgccgtccctatagaaattcaggggattccttttccctcggatctgattcttctagacaccaagaacttggatgtgattcttgggatgaattggttggctcaattccaagg

SEQ ID NO: 36046 - DNA, 617 bp, Oryza sativa
taccaggtacttatgtcgaacgaacgggtacgaccgcagcttctacaatggggacagacctactaattatgttaattaccaatatggcacctctgtacagtggttcttatttttaagtcctcgcgcaggaggcaactatagccgccaagggcaactttaaccattaccatgtacaatggtttgtgatactcgagtataaattatatggtatatttgtaaaccctgatcgagatgacgtggtgtcatacgattagttccccttaaatacctccggaacaccaaaactcctcttgctgctgttaacattacgttcagagcatatgaggatataagttcatggaacaggtgccacaattgttaataacttaatactgggccatgactaaagccgatgattatcagcaagtcgtggactgcgggtaaagcgtacatctgctgcagtagaatatctttgaaactattcgaatagccgtactcatggaattgagtaccgggactcatatggtaccctggttagaaatttaaagtctacatttttataaattcttgctataacacttccagattgtttattactgcttttatacctccctagtcagaatgtatagaaacttccg

SEQ ID NO: 36047 - DNA, 902 bp, Oryza sativa
taatctgtacatcatggagctgtttcatgactacaagatggctgataaccgttctgtagttgagcaggcccatgtaatacagaccatggctaagaaactcgagcaggcccatgtaatttgtggccgggtgcattattgcgaaacttcctccatcttggagaggttttggtactgcactcaaccacaagacacaggaatactccgttgaggggttgatagcgtctcttgatgttgaggagaaaactcgggaaaaagactctgcgtctaagggcgatggtgggcaatccagcgccaatgttgtgcacaaggcccagaacaagagcaaggggaaatacaaagctcagcagaccaccaacttgaagaagaagaagaacaacaatcctaatcaggatgagaggacttgctttgtgtgtggcctacctggtcatctggccaggaagtgtccacaacgcaaggggatgaaggcacttgcagggcagacttctaagtctgctaatgtgaccattggcaacactagagacggaagcgggtatgataatttaccttctggtttttcagttaatcagtctactaattggtggattgatataggggccaatgtacatgtttgtgctgacatctcattgttttcttcttatcaggtcgcacggggttccaccgtcctaatagggaatgggtcacatgcttctgttcatggtgttggcacggtagatctgaaatttacttcaggaaagatcgtgcagctaaagaacgtgcagcatatccctactatcgacaggaatcttggtagtggctcccgtctaactagagatggatttaagttggtttttgagtctaataaaatagtcctgtctaaacatggatatttaattggtaaatgttatgagtgcggaggcctgttc

SEQ ID NO: 36048 - DNA, 975 bp, Oryza sativa
gcgggccaccccgtccacccatctcccgtgggattccgacgtcggaacccactctgcaccatgcgccggtgagcaccgccatggccgccgcttccggccggcgtcctcgccccttccatcttcctctctctctaaccccattcatcatgttcgctaggtggttccggagctcgtcccgttgccgtcatcgccctccgtcgctcgcgtcgtcaatcgccgtcggtgagacacctcctccccctcctctttctctcccgcgctgcttagccgccgcgccgccgcctagccgcttagctgccgccctctgcccccggccggtcgctgccggtcgccgccgctgcgtcgagccgcgtcgccgcgcgccatggtcgctgggccggtttgagccgtgcccgtgcgcgccggctgcgagccgcctccgccgtccgatctatcgggcggtagatcggggccatctaaccccaccgcccgtgtggctgccacgtggccgccgcgtgtgcgccacgtcagcgccacgtgtgcaccacgtggtgcactgcctctttcccggtccgtggacccagtccacctcggaccgccacccgagtcactgccatgtgggccccgcatgtcggcgccgccccctctctctccctaggaatttaattattgcgcaataaatcaattaaggatttttctgtttatagtaaaaacatagtgaatcttctaaaattcatatctaattcatccgagctccgtttaagcccattcaagtctcagtaaatcaagaaaaatgcatagaatccattaaaaatggttttgttctctgtttcagtagtcttatagcctgtttgtattgttaactttgtatgttgcttagattccggctctcttgtcgctccagtgtactttgaaatagtcgccgaggttcctcctgcaccagagcaaggcaagtcatgcttgtcacttaaacatgttgatcctatattgcaaatg

SEQ ID NO: 36049 - DNA, 521 bp, Oryza sativa
gattttgcttaatttcgtttacgagtgaatctagggtttcctttccgtttcggccgttatcgcgcctcttttaaatagtaaccactgctttgaaattttcacggcgtcacttccgttttcaccgccccaaccgaaactttccccaatcttctccggcgatttcctcgagttctccggcgacttcgcaggcgaacccccttgcggcgacaactccaccttcgacaatgtcgacctccgccgaaccctcgagtgcgccaatcatcgagtatgctaaggtaagtaccgtcggctaaatcgttctttttagcacgttttctctctcgtagttcaatcgtttcccctttttcctatagcatcttactcatcaagttgcaatccccaatttgcaacatccgaatcacttttttctgggaccaatcggcaattcagaccctaccgatttcattaatgctaagactaataggattcccttcagattataccctcctaactttagtcactagcataatatcttcaaatct

SEQ ID NO: 36050 - DNA, 1534 bp, Oryza sativa
tgtaactcgcatgacataagaaaggtatgatctaatgcagaattgcagatgacagtttaaaaagaagaagaaaaatatgacacagccccagattgaatttaacatacatccttgaaataaaattaaagttagtacgcatatgcatttcagagagatgtcatggattagcctatctccttggagattaatattcacagctaaaaacaaacaaattgcttctgaattacagaaaccatcacgaggttcagctctttagcccttcctgtgatggccgctgtcaaaaggaaatgacagcgaatcatcataacacaatctatcaggagtttacagcctcctggatgctaaccacaaaccatgaaaacaatcatcagaactatggtacagctactagcaatctgaaaaccatgctgccttttttcttttccataatctgtacaacaataacaacaacaattattctgtacaccagccaatgctacaatgatcccaatctgtggtcgtcatcgatgccgtcctcctcctcggcgacgagcttgtcgatcaacagctccattgtcctgatgtacttgggcatgtaatgctcccttatcatggatctcgccaagcgaatcttgctgtaaagatgtcgaggtgtctcatacaaggcaacgacctcctcaccttgttcacttgtactgtttggctctgatgatgatggcaatccaaccatgtgcattattcttcctggagggtagagctgggggggatcttgactttggctcgacgatgacggctcgtgtgggttgtcggtcaaggtttctagaagctccacggcctgatcttcgtctgtttcattgagagctggctcattctcccctctgtcggtatcatcgtcattatctgattcttgaaggtcaagttcttccatggaaattgagactagttgtgccgtttcgatgtcagttttctcagctttgacattgacatcagtttgatttgtgatgtcatgagttccatgttttgcagagtcaatggaatgcttatgtgcagcaacacatgaccagcaagctattgcatggcgtttcttcaccacagcatctgaatttgacgaaggcttcacctgatcagcctgccaaataatcatgaatcaactatttaggtgacaagtatgattagcttgttcgaagaactggtgtttgcaacaatctagctgccatacctcagagctgttgggcaccagcatgtcaacatctacaaccttggatcttggatcagagacgaatggcacgtgcgatcggatgaagctcacagagcgattgacaaagcccaagaatctggtctgctgaatttgctcacgaaggtcatgtacccaggatgatgccatgacctgtcatcaatgaccgcgacggtaaatatgttgcaatgattatcttttactagcttccaagaactgtttgcagggaagaattttataaatgatatgctctaaagaactgcatctgcgatacagttcttggttcccgttttgatcgtcatacttaggaatctgctcatg

SEQ ID NO: 36051 - DNA, 1225 bp, Oryza sativa
taaactagttgcttgtgctccatgatgcatacctggtccaaatgcaagacatgtggatgatgataacttctcattctcacgcagaatgtatgctaatattgcagcgatgccagcacccattgaatgcccaatgatctaaaatatataacaacagaaatgctgtgatttgagtaagcaaacaaaaatgatcagatgtagtgcacagtgttcatcatcttgtaccacgagaaaacttgattacaatgaatgcaactacattgagattgttaaaaaaaggctacataggtttgtgtagactgcacactttctctaaataaagtataatggtcgtttggataataaataaatacacgatgtatgccaataagcaaaatacgcaataacagttttactagtttgtgaaacaaaattcgtagttattagtctaaattgttgagcttctaagtgctgtttccactttgtccctttgtgctagactactaggcacaacttttagcttacttttggactaactatgctcgcttctgaattgtctttctcagcactagagaatcctaggaagtccataaaatatgcatagtaagagtacttgaaagtctttctcactttgacttcaaggtaaggaataatatcttgtttctaattggttaaaacaccatgtttcccatccacttgctttcttgcacatgttttggaaaattttggcgtaacttggataggaaaacatctcccttaaccatgtttcaagataagcctaaaaaaatactggtaaactatgatttggttttggtggcatattcctgtttaaatgagagtaagaagagaaatgttttataaactgcatcataaaagaatggtccaacttgacaaatagtgggtaggctctaaatgcaattaacttaaaattgcatctgtaaaggtttgggaaataaattaccttcactccataatctgggaattgcgcaaccgcttcattgaggcaaggaatggcctgatttgcaatccagcgagctgccactaccattccacaatgagcatgtcccagcaccaatttggagacatgaccatcttgtgtcacaacatgatgaaatggaacctctgctccggttgccgccgtcaaccgatccttaacgctgatcgccccccgaataaaaaggaggaagcatttcgcacttctatcgcggacaactgtgaaagaaggcttcataagctgcacaacaataac

SEQ ID NO: 36052 - DNA, 780 bp, Oryza sativa
ccatttcattttttttccgttttcttcttcttcctcccgtcttcttcccggtgtgccatctgtctcgtcatcgtcatggtcgacttgctcaccgaagaaggggcggcaatcctccacggcggcggcctgcaaggacacagccaccggctccagcggctcccgtgggggttccgcggcacttgacgtagaagagggccgggagccgaagtagatgagcgcgaggagatcctcgacggatgaatcagcgccagaggaggagggcacagcgacggatgggggaaggggcaacccaggaacccaggaggagtgctcctcggcaagggcgtcggcgagcggggcacgcatccgctccgcacgagcacgagcactacaagctgcaccgcatgacggtcgtctcgttcccccgctccaaaccctgccaccaccagctactcctccggccgtgcaagtcgacgtccttcttctcatttcacttctctcttctctcatactgtatgtttggatccaatcccctcagcccaccagatccttacgcattcatccatccatccctactttttttgcctgaaaagattggagaccatgttcttggattccaggatcgaatccgtggaagcaacaaataaaaatcacatatatatttttctttgcttggtcctgagttttgtttggttccttcctgcttggtttcttcctcaccgtcgttgacgcccaccacaaggagccgcctcaccttggtgagcgcggtggcggccatggtgacgatgaacagcacccggg

SEQ ID NO: 36053 - DNA, 681 bp, Oryza sativa
tcggcggcagggtggggcgcgttgtgtggcgaatggaaggtgtcggggttcccaactacgatgcgggcgtaggaaaggatgatgccctggaggtgcgcgatggaggcggcaaggtgcgcgcggaggcctgcttctcggatggtggagatcttgcaagccttgtcagctgcgtggcggacggaggaggcgaggtacgctaagggggaggggttgccggcgtgttggtccgagagggaaaggctgtcgatgaggaggatcttgcgcgtgatgatgtcctccacctcgtcgggcgtccgctgcggtcacactgccggggacggcgacgccatcgccggtgatgcagcgcgagggttgttgcttctacttcgtcttgtagttgggcggcagcgttgcaacgacgacgatgaccagcacgccatcagggctgaggcggaggttgtcagctgagggccactgttcttcctcgctgctcgtgttgtgtcagcagcggaggcagagccgccaccgcaacgtggacgggttcgcggatccgcggcatggcgaagctggaggagctgttcgctcggctcggcggagacggcggtgacgagggaaagggaggccggcgtggtggcgcgggcgtccaacggctcggccacactcggctgggtgtcggccggtgaaaaaaggggaatcgaggga

SEQ ID NO: 36054 - DNA, 874 bp, Oryza sativa
agccactcggtccgcgagctgaaaaagctccgcggtagtctggggctctttggaagtcatcttttcgagcatgcggtggggccgcacgccccccctgaacgcgtagatcaccgcgtgtgcagggatgcatgggatagtgttgcggacttggcaaacccgctgattgtccgagcgaagcgactcatattcgccttgcttgactgcatgcaagccgcttctttgcctgggcgcggatatgtgccttggaagttcatggtgaactgtgggcacaaatcttcccaggagtggaccgacccgggtggcaggttcattagcccaacccgcgcctgtccttttagggccatgggaaagaagttcgccatgaccctgtcgtcacccccagcggccttaatcccgggcgtatagacctggagaaacttcggggggttgacgctccaatcgtacttctcggtgatggggggccggaaccttgggggccaacggacattccgaagactcgccacaaggctctacagccaacaccaccggtcccggggcacggagggctgatcttcacgtccatgtcgaggtgacactctggacgaggaggctccctccgttgcacggggagtacgccggctattacgccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcagcgccggaggtcttggtggtggtggcggaccgtccaccagcacccaggcgctgctgtgccgtcatgaccaagttggccacgtcttccagccatcgttggg

SEQ ID NO: 36055 - DNA, 317 bp, Oryza sativa
attgtatcaacttttggtgtacctttccttctgggacaaggaataatacacgcccgtcaggaacgcctggtgggtgatttccggtcgtgacaccctctatcggcgcgcggctaatggaatcctcttgaagtgcattccacaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaa

SEQ ID NO: 36056 - DNA, 859 bp, Oryza sativa
cgagatcggagatggtgagtgctcgcgagcgatcgaactccatgtatctgcccgggtcgcttcttttcctcttcgttggtcggtgctttcgctttccctttttgtcccgtaggggatcggagttcataccagctttccttggcatgtactcatgcacgtctctttcccctcttcacccgcacatgcggttagcgaaaggggcatagcatttccattgatgtatccagccactacgctatgtcttccgttgcatatgccgtttgagtactctcaagctctcctgatcgacttcttttcatataggattctttaccggccgttaaacataaagcgcgagcgcgcatgcaccgtcacagccaggccgttttcatccatacaatctcgcatgaaaagccagtcgtcgtcgatcacttcagaattcagattagtgaattattctacgtgcgtgctggataaagagagaaacgggagaagatcgatcaacgaccgatccacgatcacaattcgcaaaccttaggtacgtagctaggcggcctatcctacactgtaaatggttgaagcgttcactcaatcgctcatcatccgctaacacaaacaacattaactaactggctaaggctaataaagcgaagcgtgtgtggtcaggtactaacttaggcgccacccgtgccgtgccgtccctttccccctcgtaccaccgacggatgccaggctcccctcctcggcgtgccgtgcctttggcttttcttctctgatgtactttggatcgatcagggagagagccggtggaccacctcggccgacctctgtgatcgagccgttgtgagagaaaagattgaagggctatgccacacgacgg

SEQ ID NO: 36057 - DNA, 415 bp, Oryza sativa
cagccttagactcacttaaaaatctgtcaaagccttgaattacttccttatcatgatgcatgactactgctccatgttaattaatttgtaccgaaatctcttatagatagttgaaaaccacgtctaagctaaaccatcttaatgtcctgctacgatcgagttgatggagctagctagtgtggtacaggcccagattaagctccttttcatgcttctgcatgtctctgcctgctgcccggagatggtcagatggagggatgcgctcattgctcggtgcagcgtagttattgtggtggatgggtgcctgtgttggtggaggtaatggggggtggttgttgagaaggcaaaatttgtgaaggtcatatgacatgtgtcctgtgcacgcacatgcctggcacgaagcgaatccgcggac

SEQ ID NO: 36058 - DNA, 186 bp, Oryza sativa
ctcggcatgagggccgtgacatcaccatcaacccggccaccaaaactatggacacacctctacctccccaacctcgacagctgcggctgcaagaggaagttgatccccatcatcctgtacctccataacggtaggctcgtcattggctcggttgaggatgcgctcgagcacgagctcgccaaccgc

SEQ ID NO: 36059 - DNA, 1052 bp, Oryza sativa
  unsure (1)..(1052): unsure at all n locations
ccggggtgttgcggcggctgccccctcccagcttggggttgggccgcccccaaacccacgtggctccccccgaggggggtcgagcccggggtggcgcggtggctgccccctccaagctagagggaggaggccaccctcgcttggggtcgagctgccccgaccccctccacatatcagcccacgtgtacagggttaggtgggcgcgcctaatgcccacctaactgcatttaaagcagtttatgcaaccgcgccaggccgcatttaatgcggcgtgctgcgcatctgaccggttgaatgaccgatgggatggcgactgtgtacccctgccctgtcagtgtgtcaggcggcgagcggcgtgctccatcccgtcccatcataatgatgaggggcttcacagcctcttaccccggtcagagctggtccaaccactctgaactgacccgggttcccgttttctggtgtgaacgagaacccgaaagtcctcatccattaaatggcgaatgacaagggcgctctgcattgatttgatgggccccgcgcagcaaccgcggatagcttctgggctaaggcacaagacatgtaattaatatagagaatattttcccttgtccntaggtagcactcgcagcacatgtggtatccccttagagtataaaaggaggaccatgcctagcgaggaagggggatcggactgaggatccctgagccaaagcttgtctaaccctagcttgcataccagggattcagggactttctaagcacagaagaatcatacacacaggagtagggtattacgcttcatagcggcccgaacctatataaacctcttttgtctcatcgtcttggaggggcctccgagatcaagatcacacacagtttcgctcaccaaatcctcgaatctcacccgctgcccctggccgaactctcaaaggagggccttcacagcctcccgctagagagggtcacccctcaacaaagacgagtggtcaaacaatgcaaacaaaaactcaaaatcccttatattataggatggagggagtacgacagaaagg

SEQ ID NO: 36060 - DNA, 402 bp, Oryza sativa
cggactaaatacttatatcgtgtaatttcaattgaatgttgttgtaatgagtacctccgactattgttgtactagtagtattgcgaactattcggtgttgtatcataatgttatcgtgatgagtgttcggactagtaactgcagctattgttgtaatcagaaatattccgtatggtgacacttttgtttgtttgtactcttgtttaatatgtgttagtaattcgcttatgaacatttattacttatgttgactaattatttatatgtttctgaccaatctatttgatgcaggtatggcgtacgacacaccggcgctgttgaaccgtgggattgacaggaaccaccgctcgttcctgtcagcagtcgagggtgcacagctcgacaccttccgtccacgcacgt

SEQ ID NO: 36061 - DNA, 738 bp, Oryza sativa
cttggatttcagtaaatcatgcccagatcgaaccacaatcagctaccagattatccagcgaagattctagccaaagggatatgtcttcaagtgttttcttgacagtgtcgaccaaaggggctagagccttgcttgtagtttcttcttctgtctcatcaaagtaatctttgatatcaaaagaaaacagatcggctaaggcaacaaaagagaaatttaaaggacaaagatgacaaacaaatatagccgatctaagacttggtgtttaaaagaaacttactgggatagcaggagtagctggttgtacttcttcttcaacatggtgactccctgcagctgatggagttttatcgcttgatgattgctggacaggagaaggaggaggaggctgaaaagagacaagtattagacaagatcggctgaggtcaactggtgaaagaattaagaacatcttactggtggagccggtttgagagttggtgctgccgatttcttcttcacaacaattctctttttctgcaaagacaaaattaatgagtgattggttgaggataaatagttattaaaggaaacagagagagatagttaccctggagaagtgagctggagcagagggagtcggaggagtttgtttgggtgaagccgatggagttctttcagtatcacatacttcatctacggcttgatcaacatcctctccgatctcttcttcatccaaagcttgttcgatggtgggtccag

SEQ ID NO: 36062 - DNA, 952 bp, Oryza sativa
acaaattacccccctcgacccaatccgcggtggttttagtccacgtgacgtacgcgtggcagcccagtcagtcctctatttataaaaaaaaaagagtaaattgcatcttagggctactatttcttacgtgtgttgtaacttggactagtgtaaaataaaacttttcactttggaacaagtatgtttacagaaggttttaatttggactatcttcttgttcctccagctccctttcttcctctcttttctctgtacagctcacggtctctttctcgatcaggcgtagtgcatgagaagtcaagaaggaaaacccttcacagggcagccacccaccgaaattgagctcgagctcaaatgtaggcggcactgggaaggcggagcttgagcactgcaaaacttgctgaagtgcgagcggcacatgtggaaatttagcgcaggcgcgcaacacgtatagcactagcggaggtcgagcatgagctttagcgtggctgtctgctactccctccgtttcataatataatactttctaccactgcccacattcatatggatgttaatgaatttagacacgcatatatatctagattcattaacatccatttgaatgtgcgtaatgctacgaagtcttatattatgaaatggaggaagtacttggcttagttcttatagtcagttcagaaagtagcagcaactgtatgtcattgccggccagcttcttcatatgctacttgctaccagtaggaatacttgttgtgcaccctctgctttccttgaaattaagcaacaagcactagctagttgatgattgaaaatgcaaactaccctttgaattctttggaagactttacagattgaaggagagagaggaggaagagagttggaggaggaagaagggagtccaaattgaaacatcatgtaaagatatctggcccaaagtaaaaagattggcttt

SEQ ID NO: 36063 - DNA, 1041 bp, Oryza sativa
tttttccatggattcttgattatggtgttccttccataagatatcagataagtctggcctttcgtctatttgttctcctccagttcctatacctgtctgaaccaccgattgtacccctctttcggtggttgttctcctttcttcgttagtgttcctatcatttcctatgttccaaatctgaccatacagctcatgttcgttggacaacttgctgattacggttgccatgttattcttgctcttgactcgcgttgtgttcagggatcatagcacgggtctcctggttggtattggccctcgcttccattattcacagcatctttgggagcttgactgactgttttctttccttgcttctgctatagcatccttcactcagtggcatcattgttggggccatctttgtggctctcgtctgtcacctttagtttgtcaaagtttattagggtctatgactggagatatatccttaaatcaatgtcatggttgtaaacttggtaaacagatacaacttccctatcatcctagtgagtttgtgtacaagcatccttttgttcttggttattctgatgtttggggccctgctccctttacttcaatacggggtcatcactactatatctgtcggagatatgggcctgggggtatgcaaagtgaggggatgttaccttcccatccagccacgtgactctatagcctggccctccccccgcgcctcgcgagtcgcagaagcagccggggggcctcggggtgccacgtcacgcccttcgggccctcgcgctgcctcgccccaaggccctcgcccaactgtcatgtggcggggggagcgtgcgggaaggagacctaggctgaaccgccatcaatgcgcgcggcgccccaactgtccctcaccgcgtttaatgctgtaagggcagacgtgtggtgccgtccgactaacccacgtcaatcgagtgtgaccagactgtgacaggcctgtcaccggtcacgtccgattggatgggtggtcgtgcccccacgttcgcctctgtcttcagcggagtg

SEQ ID NO: 36064 - DNA, 83 bp, Oryza sativa
tccgcctacacggctggcctattatgccaccgttgttgggcgtctacgacttcaccgccggcctgcctccgtcgccgccgact

SEQ ID NO: 36065 - DNA, 468 bp, Oryza sativa
agttattaagatgagttacataaagagtcagagtttcttagacaattacaaaaattcctagattctattacacagaatgttactgagacaaataacactggatagccgaaacagcccgttgcctaatttgttctacttcttcaatggcttgggcatcttgagcatcagttctagggatgatcttgagagacttggtcatgtcagccacattcttgatagccaatctcaatctggacttttgatcttcaacggcatttggaagatcggctagcttttgcttttccagatccagctcggcgttgcattcttcgagttgagctattaaataaatcttgcgagcttcgagccgatctatattcgactgaatcggcccaacagagagttgatctaacttggctttctcttcatgcacaagctgccgattggcttggatagtagattcaatatttttccattcttgccgatcgg

SEQ ID NO: 36066 - DNA, 93 bp, Oryza sativa
ggcttcctcggcctggcagggtactaccgcaaattcatcccggacttcttcacagttgcggcgccactcacacagctactccgcatggatcga

SEQ ID NO: 36067 - DNA, 1153 bp, Oryza sativa
agaaccacacggcgtcttggctcgtcgagccctttccccttctttgctttgctagacatgtccttcacgtagaaaacatacgttacatcattggctaggacgaatggttcatctgagtgtcctaccttgttaaggtcaaccgttgtcatcccattgtcatcaatcgttacgcctccaccagtcagcctaacccattggaaccgaaacagagggatcttcaggggaccataatctagttcccatatgttatcgatgacactgtaatacgtgctagttgtaccatcgtatctcatggcatcgatacgaacactcttctggttcatgctctttctgtcttgggctcttgtgaaaaatatatacccattgatttcatatccttgaaatgtcgagatcgagcaagatggtcccctcgccgagaaggctagttgtcggtcaatcatcccgttacccacgagatgttgttgcagccaagtggggaaagtataaatgtgatggcgtgtaatccaggcatcggacatgctgatgttttttgagtgaacaatcacccggtgctcctcgacgtaaggagctaccaacaaagattattgcaaaaccgtgaaatgtgctttacggaataaatcattgtctacattcattattgctttcctgccaagagtgtcctttccccgtactctcccctcatggattgattatggtaccccgattcgacgaaggtcttcaataaactcaacacagaactcaatgacctcctttgttccataccctttgcgatgcttgcttctggacgagaacggttacaaacgtacttctttagaacagccatgtacctctctaaaggaaacatgttgtgtaggtacacaggaccgagaatatcgatctctttcacaaggtgacatagaagatacgtcattacattgaagaatgacagtagaaaggtcatctcaaagttgataaggcattgcaacacgtcctcttgaaacggtgttgatggtcgttatataccaatgacgaccataaatataactaaaataaaggagatttagctatgcttgcaatgcatatttattttagaataatctacttccacttccacttgtagtattatttgtttctagggataaagcaaataaaatggacaagaaatgaggaaaac

SEQ ID NO: 36068 - DNA, 449 bp, Oryza sativa
cgcgactggatctctgccagtggggcttggcgcattttgcgccccacctccaccatgtcgtccatggcgtggcgcccctcgtcaacccgcgcgcagtccgccgcgagctgcgcccactccggcttcagggccggccgctcgtccgtcagggcttgaacttgggcgttgacccctcccggacggtggaataggcggcggcgagcacctgcaggagtggctccatacccacgggagttggagaagaaaaagtcgcggtccgcccccgggacggcggagtgctgctggacccccgcgagactgggagctgttgtcacgtcctgataaaatcatcccaaaataaaaatcattttctaaaaggaataatagaattaattaaaattcgaaaagaaatggacaaacactaaaatacatgccagaaaaattcgaatgtggtccggagaatttttgtt

SEQ ID NO: 36069 - DNA, 674 bp, Oryza sativa
gtatcttggagtttgttagagataatagtcgtgtccgacaaggacgtattttgtatctcgggtataaatatgacccgaacccatgtaatcaaacaacacacgttcaataacaatcttggcgcatcgccacccttttactttcgtttacttttgacgagttcttgctttcgggttgagctgcatcggtttcgatcttcaactagaggtaaaacttgttatggcggcatgcgttctcgggattactgtttccatctttatgatactctaatcttgtttatgtaattcgtcgagttatcatatatcctatctaatatctgacaatatcgttatttaaccttcaatcggctaacatctatcattgaaaggcagccgattaggttaaataccgatgttgatttagattatatatgatatccaccatcctatgaaacatccaatggcttgattgtctagatattgtccttcttttcatacttatagctacatcagttgagtttgatcttatgagtcgtgattagaatctcaatctctagcctgcttttggttgccgaataaggtttcatcggggtttcagccgatttaactactctatatcttatatgcttcattgacacgttaaatccgcccttatgttaagatcatgtcgcatttagatatatcaatatggagtagta

SEQ ID NO: 36070 - DNA, 490 bp, Oryza sativa
cctgcgcacggcgacgtcgtccgacccggtgttgctagctctccgtgacgagatcgccgccggtacacgtggcgcaccgtggacggtcactgatggcttcgtcacctacaagcggcgcatctacgtcccaccgggctcgccatggctctcgacgatcgtggcggccgcccacgaggaagggcacgaggggatccagaagacgctgcaccgcctccgccgcgactttcacacgcccaacgaccgccacctcgtcagcgacttcgttcagggctgcatcacatgccagcgcaacaagacggagcacctgcatccagcgggattactgcgtcctctcccgattctgatggccgtctggtccgatgtcgccatggatttcgtcgaggggttccgcgcgttgccggcaagaccgtcatcttgacggtcgtggatcgcttctccaaatatgcccacttcatcgccctcgcacacccctacacggcggagacggtgg

SEQ ID NO: 36071 - DNA, 676 bp, Oryza sativa
gagccaactcggcctgctgtttgttgccccagaggaggacaacatggagacgatcgtcgcgcttgatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgtaggatttggcggattctattgggatctgggtgggtgtccggtacttttgtacttacgttacatgttgcgctcttcctcttcattgggcacgggcacatccaacgctacatccgtatttgaaagatggagggaatacaaatagagaataagatgatgctgggcgataaggtacgaccttaaa

SEQ ID NO: 36072 - DNA, 11328 bp, Oryza sativa
  unsure (1)..(11328): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataagattagtctagctcccccagctaacaatgtgatgacgaatcgagcaacgatgtaaaaggttgcgcaaagccaacctatataggacgtggcactgcaaaatgatatgaaaatagataaacaaatatatgataattctaatatttatgaggcaaggaaaacattaatattgtattatatggtttaaaaaatgttgtattcaaattactttttagcaaaaggaagtgaaattcagtgactgaatccactgaaacatccattttacctcatactgcaatattgcaaacttcatcggctgaactgacgaatttatcgtagtagagcttatatcttttcgatgaaataaaaaaattatgcaatatttgatgcatgaaatccgtaaggtaaaaggcttaatccatggtttttttttcacaaggtattcatcaagaacagtaaccatactaagtgaatgatggtaacaaaattctgagaacatagaaattggtcaaaagaagttctgaacatgccaaaaatcaaatatgtaactccgcactgtagcagtagcactctttcttgtgcttgatcaaatcacttgatgccattatatcattacgatgaaaaggagttatattgatctgaaagaaatgtgaaatagatcaaatcccttgaatgttctgaaatcaccatcataattttcattagtgacaaacagatgaaatgggaaggtagagaggtaggggatcacaaacttgtaaggatatattatttagcatcaaaggggaggccaattttcctcgagtggccatccaggtagaatgtaactttgaccacctctgcttaccgaagatactgaatcttccaaacaaacttttggttatttgtttataggagggggaggggggagaacaaagattaacctgagctaacaatctagcaagagataaaaagaacaaataaatgaatgaatgagtaaaatataaaagatgatatcggctacctgaagtgagaggataatggcacagcaaaggagaaaattgcttagtacctcttacaaagaagatatcataggatggttgtattataatatctggaaagtcggtgaccatgaacgaatatgtggtaccaaatatattgggatattttcttgatagagaactcatatggagaaaccagataagccgctgctttggatgggaatgttatggagactgacctcagtgatagcccatagctgctgctacaatgatagtagacaataggaatgggaatgaactgcaatataaatttataaacacaacaaattatagctacagcaaagttgtaaatttgatttatataccatgaacagggttagtggaaaccaaataaataccatgaattgactcaaatttgacgtgttgaatcatactatatcttgcatccaatattagtagcaatgttaggaaaatacaggctaaaacttataatcctgaggttttatgttacaaagaaattattggcaaatatcccccaccctagaacgatgcatgaatactgatttagggagacaaacattgctcatatcacttgttaccttaatgtcttaacatgtatccataggctgcatctttggacaactatatatattcaaaagtcgtttgcagaagatcaccataaaaatggaaactcaaaagtgaatcatgatgcctagtggctgatgctacttgtctacctgaaatacaggatacatgtgggcattttatcaaacagagatacgtattggatggagaaatttaccttacactcgtttctgcagcagcaggagcagacagcctgatagaaactcctcaattttgatcgatacatgcagggactgaagataggaagcaagaacacaaatcgcctgtggcatccatcactcgactcaatagatatacggagggaggagaagcggccagagaatcgccggggagagaatcccgtagaagaacacacaacctcgcagaagtgaaagctcggatgaaacaaagattggggggggagggggaggagaagcgctagaggggggtggattggagaagaagcgccggggggagagggttggaggagaagcggcgcggggatgcgagagcggccggcggcgggcccgcgcctgacgcgtgcgcgcgattggggaaaggagcaagagcagtcggcgccgggcccgcgcctggcgcgcgcgcgatgtggggaagggaggagttgcgcgcgggggctggtggggaaaggagaggagcgcacgcggggagaggagcgcgcccggcggcggcggcggagaatccgcgctcggtggaggagggaggcgacgcttagggaaggatggaatacatcggaccgtctgtagcaactgatcgaacgactgagattaaaagggtgacgtggcttcaccagaactcagcaaaatcctaataactacactaagtggggatcacttgtatagtattactagaaggtaccccgcacgttgctgcggaaccttgtagaaaaaatttagaagaatagtttgtagtgaaagcaaaaggactttaaagtaagacaatatgtgaatattactttgattatatgatagggtacacgaaagttttgttagaatgaaaggaaactgggatggatcaatattaagaaagcagtaatcaatgtatatgattatttggaagcacttagagtatttagtttggatatagtctgacaacgaaaacaaattacaatagatgatgattgcggaaatagtaaccaacagagatgattatttggaagcatctgcaggctttaagttgtatacgatgtattgacctgcaaattttgttggacaatgtattagaatgaatcatagtaagatttgcttgtatgatgatgtattgtatctgaagtactgtaaagagcaagtaccatgcatatcatgtagatttctgtgtgagcttatccttctttgctggttggagctttttgctgtttgaaatggttcataagaaattggaattagcattatagtttaactttgcaatttggaaggtgggttagaagtacgtactcttccttctgacgtttgacagcaggtatatcaagttgtttgatactgccatgaagaagaaaattattgcaagggataaactgtaactgagaaatttaaataactaaatgagctatgtgcagtagaggtataccttttagttttgtcagtggagtcctcactgaaatcaatgcttcgttttgtagatgtgctgctgaaatatataatagatttaatgaataaatgcatgtatttaattaagtagttagaatatgtaattctgacatgttcttttctgtggatatgttgacagctgcagatgattctggaggtgtactatctttggataatcctgtattatcaatagttgtgctgaaatgaatttgccattagcagttagtaagtatagttttatatggatatgatgaatagaaaaaattgagagaacagtaaacattgggctacttgtatatgtcataggtggtgggaccgtgggagttggagttgatctttgttcttggagaactgaattagttagatagttcaagctaattcagttgaaatattgaaccaatgataaatagcatcttcagatgatatttactaaccttttcagatgtcagcagaggatttggcatagtatcatcaattgagaaactccttttgagcacatagctgatagggaacttagaagatgaatcagtattcattcctatagtaaaaagtcttgtttttccaatggctttattaagagttactggatgttcaactgagtctatcttcatgttctgagaagcttgggctgcatcaagctcaactaaatcttcagcaacaaaagaaaatgccactgcatctaaactccctgatttatctgtgattgtcacggggagtttatacctaaagcattgtaaaatagtcagtggcatatatgttatttatatcatattatttttaattgttggaatgtaaggtgagaagctgacattggtttggggaatgaaaccgcacagtcacatcttggggagtcagaactattgttgtaccctttgtcacaacgatgacatcctatgtagtaccacttaattgatgacagtattgaagacacttttgcaattgcactataagtaactcctcccttaagtgaagaaaattataagagttatatgttgtctgaagaaaaatatggaattccaataagaatatagatggttgtttatgtgttcagttttacctgaaaagctgaaacaggcataacagatatttcttctaagttgtaaatttttcctgctgcttgaactggggataaacgtacaatcttagggagctgttgttgaaggcttggagatcccagtttatagcttaaaattgcaacaatataggttggcatcataattgatacgaaaaagaaaactattgaacaggaaacttgaactttaagtagttttaagggattaaattgaaattacctggagcgaaattgttccacctgtggtatatcgaggtcaatatgaatttgagtagcggagcttgaagatgcttctgttttacctacaattgtatgtggtaaatgataagtttaaattttgtaggtatgttatgtgaggaggcatattcttttcatggaatgaacctgcaaaattgcctgcagtaagaccagcaaagatgactactacaattccttcctttgatttttcaagtgttacagcttcattaaatgattctccgtattgtccccatagaagtacttcttgagtctgttctctacaaaggtagagcataaaaacaattagtgaaatattgaattatcagtttaatgtttgaaaaagacatatactcttggttctgaatttgaattcttctgagttttttgtctgatgttgggctcgcgaaatcatatggaccaatacggctgactaccccaattaaatctgaaggaaaaagttaaaagaatgtcaagtataataggaagtgtttaggggtaaattaaaaagcaaggattacctaagaggggtttagaggtgatggtttttcctggaatttgatcaaatgggcaaaagctgaaagagaattttggtatggttgatcctctagattccagatgattcacttttgtttcgtgtttgaactggatcatgtagctttggtgctgatagatataagtctttcttctagcatcaacagcagtagtattagtaatcaggtagactgatccttcatttagcaaggggcgaaattgtttttcaagcttttttggtacactgatttgtgccatggaaccctgcaagattgtgatgcataagattgttatggttaatattgagtagaccaacgaaatgtaaatgaatggttaatatttggtgtaagacaaaagagattgacacacatgttcatctaataggattccatcaatgctgatcaatggatctgctgattttgatctcatgtttagagcatcccataatcttattagacggccaaaaaccttgcagttttgctggccaatagttacatctttgagtgctgtagctgagcttgccatcgaaataaatctgaaacaataacaaataatattagataactaagttattatttttattgagcagaatatgtagataaaagtagaatgaaacaaaacattgtataagatagggcatgcacaatatacctagatatttagttcctgtgtctagatatttggctgaatacctcagcatataccacattttgtgtgcagttttcataagaagcagggctattttctattagaactttcaaacccttgggggaagtaactcttgagaatgcaacatataattgaccatgggagaaaacaggagaaggcaaatacagaccaactctgctcaaggtctgcccttggctcttgtttattgtcatagcatatgaaagacgtattggaattgccggcgtctcaatttgaagggccacttggactgagctgatgttgtaatgatgcgaggaatatatgcttttgtaccttttgcctttcctgtgattatctctccctcaataacacgatttgttagctgtgtgacaatcagcctagttccattgcaaagtcctcttgatgcatcaagattacgcaagagcattataggcacaccaattttcaagtgtaacacatgttctagaagtccatttattgaaattgtgtttagaaactctgttggatatagtgcctctaaagtggtatggttggaacagctatcatcaattgaatctgagctatagtatgacatttcagtggttgctagctgagcaatcattttgttgtttatttctgaaactacatcatttgtaggtgctaaaattgcacgctcgcataagtacgatctaagatctgttgtttgacaacctgagtcgtacacaaaagaaatcaacccatccaaattcctacaatctggagatagaaggagagactgagggatctctataaacatgccctttggttggtctgggacatcaacataaggttctgcaccattgcctactctcaaaagccattcagcaaaatttttgaggtcttctctttccgatgcagaaagacatgcagagttaagtctcatattttcagttaaatgaagtagtatgcactgattccataaataagaattaacaatgcaagatttcaaaatcttttgctttgttgcattttggatgactggaagtgtttggcgaaaatctccaccaagaactactgttataccaccaaattgcttgtgtgttgaatgtgggctggtatcagataatatatcccgtagagtccggtctaatgcttcaaagcagtacttatgattaacaggagactcatcccaaataatgagggatgttttttggatcaattcagcaagatttgtatttttctttatactgcacattgaattttgtaaaatctccaaagggattttgaaacgcgaatgaggtgtgcgtccacctggaagcagcaaggatgcaattcctgaggatgcaacagccaatgctatctttccttgccttcttatagaattgagcaaagtagtccataagaatgttttcccagttcctccatatccataaacaaaaaatgttttcccttcattattgaccacagaattatagatagcattgaaaacttccttctggctattatttaaacatgacacttcttcatctatggtgtatcccatgttacaaacatcatagctaagctcatctagtagaagcctattctgtgcagacacacttgcaatatcatctggcattggcaaattaaaatgagataaactatacccagcgtctcttagcagcttgtctaactcaagaaggagagaagatgtaacaaaagtattgttggagctgctggcctgagaagtgttacgggttgtacgatatgctatgtcctcactcatacatgacatatgttcattgaaaagtctagtaggatttgttacctcacaaaagagtaacattgtaacaaaaagctggcgtagttggaatggtaaggcccattgagctgcatcctttatagcatttgaccattcttggtcatcaccaaggagacctaatgcttcacatgctgctcaaaatgtaggatattcaacacctgatacagttctgatttcagcaaaggatcttgggcccctaacaatgtgcagtagcttctgtaggtagtaagcttctccttgtgaagggctgacatgagcaatgcggccaattctgcgagaagcaccacgacggccatcccaatatttttctttattgtgccatgtccaatattcaggaaattctatatatgttagttgtcgggctgaagggttctccatattggcttctaaccatgcagtcagctttgatttagagttgtttggatcatcaatgacctcttcaagatcatcatcttctgtgaaaacaacattattcttgaagggaagatgtacagggaggcgttctatagagggatctgtgtggtgaatgtcaaattgctgcaatcgccaagcagcatcatttggagtgacacaacggcattccaaataattatttatttcatttatagtttcacttgatgattctgagtttgatgaattagagtggaatccaactcttgagcaatcaaatccttttgtaacatacttgaaaagatatttatgcataccatcataattaactttttccacatttatgtgagcctgaaatttgacaactaagtcgacattatgaggaaccacaaatctgttgtcaatttctacctcatttcttttaaaagttattccattgtttggccgtgcatactgtgtaaaaccattttctaatatagtagtttcctcacagaattctttggggtagaatttggtgcattttccttcagacatgcatactgaggaagggttgtgaggaccacaagggccatgcaccataaagttacaaacagcatcataaccaatcttgtcaactgcagggtccggaaactgagctaaaatatagctatcgaccttttttgcatctaggggttcttttttggccagccatatgatgatgtggacatgaggtaaaccacgtttctgaaattcaattgtgtagataactgtgtaaaaagaaaaatttgaagggacatgtaaggcatgattagtgttgcacagggaagtttaagggaaaattattgtttggaaaaaaacaaagggagaaaagtattaccagcattaatagggccaaagaattcacgttttttaatatcatctattaaaatattgagcttcattttgaaaaccctattgacaatatcagcacggtcagatggtttctgacctggaattcgtgctaaagcctccctgacctcaggccaagccggatttgatgtgaatgtgacaaatagatcaggacaaccatactttctacaaatagcaatggaatcttgataattttgatacaaataccgaggcccaccggtaaatgaagccggcaatattaccctttgaccaacagaagaaccggatgtaagacctcttgagacagaattaatcaatgagttgaatggcgatgatatgtatttagactggaagcttggattgcgataatgtgatatgtggctcccttcaacacaacagtaagaatctaccacataagattgagttagccttttgcaccttaatggagtattgaagtctcttggtctatcatgtagcctatatgcaaagtactccaatggggtcattttggtgcgtttaatggcttgactacgtgctgttgtattgtaggtcagtttctcatgataaccatcctctccatatgggaataaaagaggatattgcattgacataaacttgcaatggttttcatttatctgctgcaaatttgaagaacggtcttgtattattatatcccgtcctatatcagttgatccaatatcacccacaattagaccaacaacttcagaagcaaccggagcactgtaaatatctccatgtgcatcccttttgccaaataatcttatctgaatctgattagatgtgtctacagataatcgctcacgtgctgtcctgaatagctgaacaattggattatttgtattgaacatttctatcaagttggcaacaatttcttggtttgcatgaaagggagaacaggaagatgaagcaacgttgattcggtttgagacctcatgttccgtgtcaaaaatatataattgtgcatattctgggcgacgaccctctaaaggcagcaaagagcccattctatgacagacctgaccacttatcttgaaaacatacggtgcccttccatcatttatggactcatttactttagctcccatagatgtcattgcaaacatgctattatattgacgaatatgatcaaagaagtggttagaaagagttccgtcctgtgaagtcaacaaattcaataatggttgtggaggaggttggtatggtggcagcaagatacttccacccttacaacacaaattacatgaaggatttgaagtgtgcctctctctacgtatgcgttcttcataccaaaagaaggcaccgcagtgcacgcaagaatggtgtgggccaccaaggtttaatggttcatatatagtgcctgaaaggtttgcataaatgtaatgatttttttaaagataaaatgattcatgacagtaagatctgaggagcccaaaaaaaccttacgtctgtgattgaatgattgatttgatggaatggaaccaatatgaatatggggttcattttgctctgtaagattagaaatagaggattctccaatgaaccgttggcgcactggacgttgatctgcagaggttgatgctagataaaaaggaagagatttataatgcgagctacttggccattatgcataaattaatttcaaggaattatgatattctaaccaacctctgttcctatttgcatcgataacttgcctatgcctgcgccgagactcagcagcagcagttgggttaggctgtggcatgggagtaataaaggcacttcggcgtggccgaccacgacggcgtacaataggatgagaagtacctggtgcattatccattctacccggcagcacaaacaaagaatccctataaccagggatacaaaatcattggatttttcccagacaaagaggatagagcaaacataggggatatagtgaccatccagggggtataactaaagtgtatattcaggtggacatataaggtattcatattcacacaaaggaaattgcttgaactgaatataaactgaacagtaaaaaaaaaggggggaagtaagaaatgctggaagtgtaacataccagaattatctctgcagattgaatatcgacaggagcagcaaaatacagtcaagaggaaggccgttggtgacacatcaaggaataccgttctggacatataaaaaacgaagagatgaaaatgaatctaagaagaatctatagcactctaccaatcaaataataactggaagcattttgagtagtacctatggaccccgtgggagaacgcacaatctcgtagaggcgaaaactcggatgaaacaaagatggcggagaagaacgaaggagctgagcttttgtggattgaaggcacatcataataagggaacgacgacgatgatttcgcgtaacagacaccgggagtaactatgttaatggcagccatcaatgacctcgttggtgagcgtggagaaagaatcgccggggaaggg

SEQ ID NO: 36073 - DNA, 9660 bp, Oryza sativa
gggagtggaagggtgtggggtggaggagaagcggcgctggcagaggtggaggagaagcggcgccggtagagtgcgccagagattggggaaacgcggcgcggcgatgacgcgatctcgatccaggagaggaagcgagggcgtcagcggcgggcccgcgcctggcacgcgcgcgatggaggaagcaagggcgttcggcggcgggcccgcgctggcgcgcgcgcgatggggagagggggagaggaagcgagcacgcgcgatggggagaggaagcagcacgcgcgcgcgatggggagacccggcggcggcggggacaacaaatcggtggcggagggatgtgcgtgatggattgcgatccaacggctgatgaggattcgatcgaacggctgaaaaaaaaagagtgacgtggcttaaccacagctcaggaaaatccctaataactacactaagtggggatcaattgtatagtattataggataggataagttgtgtaactacttggaaaagaggattttaaaggtattgggtgtttatccattcgcatactgtaaaaataaatatggtgacacgtggcaggccacacccagaaatatgggttataaatgcctaatgggcctcagcccaaagagagctattcaacgaaacccgtaaaataatcaccaaaaccgcttcatcatcttcctcgccgctttagcttccaaattttccctttcacgctcctgttcaccgtcgtcgccgccagaacttgggcaaagcttcccctcacatccagccatcaaagcgctccagattctgcgaaaatccaagtgctctagattccgcgaaaatccaacgcgggcttcctcctttcatctcccatccccaagttcagagccaaaaaattctattccaagttctcctccatttcattcatggcggaagagagagaattccccttcgatcaatagggcatctctgtgaaggaatcaactctgaaggatatggtgaaggaaggcgtgatcccagcgaaggaaattatcgggtggtgcccagccttcggctatgagttcccaacattgaacactggcaaaatcgtggtatttactcctttcttctacaacggttttggtcttcccacttctaaattcttccgaggtcttctggatttttatgggatttagatttatcatctgaacttaactccatcttgcaccttgccatcatcattcatctttgtgaagctttccatggaatacgacctcatttcaatttactttgtcgaatgctttatcttaaagcccaactgactaaagaaaatccttgtgccatcagcaactctggtttctagctgtacggagctctccgcaaggattatttttcacttcctttaaaatcttcaaataaaagttggcactcagattggttttacatctcgaatctagctcctagccttcccgactttatcggtcttgcacccatccaccagtctcactggaattcctcgcctgaggaccaagagctgactaaggtcaatatcttgttataaaaaatcctcgatttgaataaaaccggtttgctaggtgaacaagtcactcggcatttcctcaaatgctgactgcctcctataaaagagatgtccaagccaacctttgagtatgaagaccaaactgatcccaatcgtgaagatcccaggtcgttagattacaaaatcatgtgctcgaggttgttcaaggtcttctcttctaggatagttatcgattactcccacaagttgccagttactccatacaatctgcatggaccacacttgcagcaagtagatctaagctctgctgattcctttttgtttactggatttagctaataactacatgcttgcgaattttctattgtgaaataggataaatgcttttcttgtctcgaacccgcatgctgttgttctattaacataacacacggatatggcctacctcctatctttagtcggaaaaactgtctgtgcgagtatatggtatgcatagtctccacggtgcgtctttgcttgatgatactgctgccgcctgccggatatggatttcagcgagccagcgaagcacaggcgctagtgcgtacaagatgaaatcttacgctgacagatattctacacgaatcattactgacccatctgatatgggttctaatataagcctgattgtgagctgacttttttttctgtcttgaggttgaattgcattggaatactgagaattgtgtggctcattaaaataatgtgatctattgacttcaggcataatgcatagatctatgatgacatcttttcctacattttcatataagattgaaaatctaggttgaaacaaattgaagctcaaaacaataattgtgagatgcatggtacaaaattgacgccttccaattgacttatgggcctaatgtaaatgtttgcagagggatgatacacaaaatccttcctcctgtgaatttctctcgcagcttattttcttcatgggttcccttacattttcgtttaactcacattttgctcgcttagttgcatcccttacatttctgtgttatttttttttcgtgtcaacgttttgcaaaggacatagcgctgcgtttcaggaaagggtgttttgattccaaaatgcagagggcgaggcagagcataaacaccctggcaaactactattacgatatactctcagcataaaagttgctgctgcaaggagatcatatcactaaacaacctaaaccatctaattaacaagttgtcaacctgctaagggtgcaaccttagcagagagatcatccgcagaacgtacaaaacatcatgttctctctttcaggagcaagagcaaatccgaccaaggtagaaaaataaatacatatcttaaaatacagatccttaatgttctaatttgacaatttacaaatgaaaaaaggaaaaatgtgaaagtaaatatcacatgttgttatatgtggtttattaatcctcggatgttgattcattcttgcgcaaattaggcacaacccacacgcagttaagtggctctatgacaccatagaaagatggagagtacgtcttcttgttcatatcatagaacaccggctttccatccttcgaatatctaggaaagtatatcctatttccattgccaccatctggcgatgctacaccatatgatgatctgtaatcaagaaacaaggcaccgccaccaatgtcctctacttcaacccatgaaatctctgtacggttaagtttgaacactcgaggcaactcattagcattacgcaagaatacagatatcaactccccatccatatcaaccaaatagcagaactctcttcctatgtggtcttcttcaaagagatccatctctacatggataggctctggcttatcaagaattctccaagtattgcttgttggatcaaagacaccaaggttgcccttcctcccgagacaatagaacttcccatcgaacatgacaggattattgtaccctactgggaacgacacattgtactcgaactcttgctcaatccaatgaggctctccatgctgccatgtaaaagtactgagaaatttaccactgtcactgctgttgattccaaaaaaggcacaatctaaacacattggatttgacgatgagaacgacacaccgttgtagttatataaaaacgcaagcatagggggctccacaatctcctctgtgaaaggatttatgatgaatatatcgttgccatagatcccggctgatgctagtacccaaccatccttggaggagcgaaaaatgtgtcgatcttcatttgtgtcaaatattgtaacttgtatgttgtaattctcactgcgtagaggatcgaacaacttgcatgtcccatcctgctttgagatgtgcattagccaaggccaaacttttgcttgctctattgggttcaacacctcactccatgccttacaaacagttggaaatcgtatgcgatctaccaaggataagtttgagacaattaactctagcaattccacagggaggtgatcccatggccgcagtgaattttcttgtccgtcctctttgtgttcatcaaaatcattgggtggattatcctttgatggctagaaaagaagtaaaaacaagaggtttagttacaatttgctagctagtacaacgtgaataatattttggattgtaacatgctttgcatggatttacaaaacctttctccatagaagattattaggaatggttgattcttgtggcattgaaattgattgggtgctgtaattggatattaggaacaattatacatgaatcagtaaagcatggttcgctggaaacaaaaattaactactgcaagcttgaatgctaaaaattagcaatgtgagcatagattggaaataaaattagcgatgcaagcatatattagaaatataactcaccttgccggaatagcccaaaatgctcgggaccaggattttgtaggttgaggaagaatttgatggaagctaatggtcatgtcatccaagcagaacttataaagcctctcactgtcgcagcttgaccatacaagataaacacagtttccttgcaatacaccttctattgaaggacatgagaaggcataagttccagagatgagaaatgcacggtcgttgccaataccctccaccctctcccatgacaatgtctcaagattcaagcaaaacacacggatggcggtgagtaagccgtcatcataaaagcacccgagatcatctatccacaatagaaataactttccacaggactcgatgatatggtaacggccacatctacggctatcttcttcttcgtccttgatggtacccaactgttgtagctcgatcttgccatcaatcacgtctatcgctatgagattagaagcgaaatcataaatctttcctccatagttgcgcataagagatgagaaactgatgtcgtcatacggggacacagatttggtccacatctcatcgccagggtggcagtgaagaaggtagcattcttcttctgcctctgtcgagctggcaactagtattgtgcagttcgcgctctccggagactcgagcatctcgtatgtggataggaacagcggaggctggtgcaacggcggcaactgaatcttggtccgcgggttggtggtgatgcggaggaggaagcagtcggcggtagactcgtccagcatcagcagccagtcgccgtgcatgcagcccaagcacgtcttccctcgaacctcaggaacaacggtctcgtgcaggctgaggtctgacacatcgacgaaagtcagcgtgtcgccgcgtgatccctgcaccagccatggcctcgtgccgaagcccggcggcagcgaattgtcgtcggatttcgcggccatatgtgtttgtttttctggttttcttttactctccaggtgtattgatccttctgtcttggtggttggctggttgcgttttatgcagcagggagccaagagatctagcaatcgctagtccctttcagtttcaggaatcagagtcgtggtctatcgtgattgcgctttatacagcagggatttcgctcgatctggaaacggatttgattcagaaatccgagttggtttcgtccgtttgctgatcagaagcgtgtgctggccggaggctttgatcgggcgctgggactgggtgggacggcggctgacgtccacgtcgccgcctcagatcgcaaaggcctctcccgcgtcgctgccgccggattactgcctctgccgcgagccttgagctgtctcgtttgggagtccgaattgaagtagaattgtaccctctctttttttttttgtctatagatcgactgaatcggagtccaatcaggatttgtacacaaaatttgactgcttaaatttgagtatggtaattccccctcctatctaattgtccgatcagaattgtacctcttttgcctagcaaactttattactgcatctgaatccaatcagtatttgtgcacaagatttggctaggcttatttttctacaaagtagtgctgctctaagttttgctcgcggctgggcgccgacgtcgcgatcggaagagctagcgcggtcgtgcactgtgtccttcgtatgtttgcctctcaggtgtattctactttggactcctgttcggttcgataataagctataagcagaagaaatccttaagaaaaaaggataaaacaaacagaagatattaggagaatacacggttgatccctcggatataggagtatttgccttcgacgttcattggcaagctcgagattgggagtctatcgtgtgctaaaaggcctatggagtgcaacaacggaagaaaatattgctatgccgtggaaaccacctatttgtagtgaaaacttaaaaactaccggtggatcgaaaaatggaccggcgaaaatcattcaccttattttacctgtgatgacgtggacaaatctcgtacgtctatttttcaatccaacagtactttccaaatttccaccacatatttccctgacaacggtgttgcaggtgaagagtcctcgttgtcacgtggctaattcggcacgaggaatttggcccaagaaaggtttttctttttttctaaaacgttattcttttttttcctactatacagttcaagaaatgcacagaataaaccaatttttttgaaaatttatatacaaataggttatatagatatcatactatttatattattttatttgatttttccttttttataaattctaatttgaatttggatgaaacctatcgaaattccaaacggcttctcttttgagccacgtcgaaacctcggttttccgtggaattcaaccagtttttgtcggaattgtgaaccctactctgaactcccgaagcctgctgctggactcccgagtcccaatgcccactacccctccttgcacgcccgacatctggtttcacccttcacgatgccgatcaacgttcgacgcccctccgccgctgcgatgactactcaactaaggttgtgttcttcccccagttttcccgactcatctctcgttttctgcacgcacgattttcaaactgctaaacggtgtgttttttgcaaaataaatttctatacgaagttgttttagaaaaatcatattaatccattttagtacttaattaatcatgtaataataagtgttttgttttccgtgccggggtcctgctgaacatagcctaagggcacccacaatggttatctataggctctctacaagagatccatgtcagcatattttcctacttggaaggtattaaatgaagagagagagcaaagctatctactaacttagagatagtctatagagaaaaacgaggcaatgcatgagagagctatagataccaatgtagacatactattaaggtggtttactattaatcaagtctattgctgagatgtacatgttttatagatagcaccttactttaccattgcgggtgctctaagagcaagtataatagtgagctataagcctactataagtttaggtggaggagagagatagtgaaaaatcaaaggtgttgactctcatgcaagagctagattatcacaaacttcaagacaaatacattaaatgtataagtgaaaaataaaaagaagagaagaaaattatagccaaccttatagctaatctattatatattatatatgttgacttttaagataagctaataataggaaagtgagctaagcaatcatctatcttgtgggctgtgtccatataacaagccgctgttgtcgcgcctaataatcagcagctcgccatgcatctctcccttctccctattggctctcgcagtcacatcttagagcaggtacaatagcaggctattagccagctataaatatattttaatgagataaacgatgagagagaagagcagcgggctacagatttgtagccagctgcagcacgggcttcaagacgcaatatgtatatgacaggtgggaccatatattaaagtatagtaagcaactattgtatgaattggctattagattgactatagatgaattggagctagtagtgggctatactattgaacttgctcttatagctcggcaccttgcagtccgaaatgactatttagcgactatatatataggacgtccgaatgggactccatggagtatgggctccaaagttgagatccgttggatgtagctggtcagtttgatcatttgagtgtatgagcttaatgggtatagacctgtttagagtgcgggatttaatagtgaatggattccatatatttgaatagattaaaaaaatgaattaatacatttatatgcatgcatgcagtgcggatgagagaatttccataattgtgtgtgcatttcaaaaatagaaacattaaatgctcatgaaattggaaataatatcttgtatggaaacttacgtgattgcacggtgaggtttgaataaatggtaatataatggtgaaaaatggaaactaagtatatggagaaatggactttttttaaaaaaaaaactaggtatgtaatactaaatactgatcattcgtatttggaaacatggaaactaattatttggaaatatatttggaaacatggatactatatattgcagcgcatttatatggtaatgtaactgtacctaatcattacattcatgacaccattaatttagctatttgagtcacaaaatatttaagtttagggtttagagtttagggtttaaggtttccggttgcctaaatccgaatccaaataaaacagcggtttgattcatccctacaacttataattcaaatcaaacaagaaaatccaaatagattttttggcaaccactttctgcattgatgcaatccatcagatcacacacattcatagttcatactgcatttatagttcacacacattcatccatcatatcatactgcatcacacacacatttttttgctgttcttaagtaaaaaccaatggttgatcatttgcaaaatcagaacaaggtgaaaaggcagaaaggggatggatggattgcaatcacgtactccctccgtcccaaaaaaaagacaaaccctagtttccgtgtccaatgtttgaccgtctgtcttatttgaaaaaataatgaaaaaaattaaaaagagaagtcacgtacaaagtattaatcatgttttatcatctaacaacaataaaaatacgaattataaaaaaaattcatataagacggacagtcaaagttggacacgtaaactcagggtttgcctttttttgggacggagggagtacgtagttaacgcacacgtctcctccactgccgccatagtcccttggccacccggctctatcgccgtcccctcccttggccaccgccgccaacccaccccgaccagatctacacggcaccggtgggagcctgatggagagggagaggaagaggtcgcccgtgggtagattgcccaccgcctcccttggccaccgttgccaccgccaacccaactaccccctccccagatttggctgcccccagtgagaccaacggagagggagaggaagagggggtcggatctgcgcctccccgtcacccgtggggaggtcaccggtcgcatgcgtcactgctcgccgaagggaaatggccgcctggctaggagaggggtggagggggagggaagtgcc

SEQ ID NO: 36074 - DNA, 52161 bp, Oryza sativa
ggatggatcgagatcgatccttatctcctcacatgggccccgctagcttgatccgattggctcgttttgttgccggctcggctcgactattaggcgtcggttttttaagaaaaccggtacctgtaatatattattggtgtcggttattctttttaaaacatgtaccaatagtattggtgtcggttttttcttaaaaccgacacctatagttgtttaaaggtgttggttctttattttttaaaccgtgggaggtgggaaaaggttaataggtgtcggttttaaataaaccggtcctatgagggtttttgtagtagtgtttcatccaagttacctcttttttacataggtataataaagtcttcacatactttcttggactgccacaaatgttggatgctcgccggagacacctagttggctaggaggatgacctccaagattatcagctcaatgacgaagattggatgttgatccccaaatgctcaagatcaaaccctagatctcataagcacaaatccccaaacttcattcaaatttcacaagtgtagcactagatcctatgtgggttgagtgaaacaaccctagaaatgaataatatttgaaattaaactgttgaagtttttttttctcaggatttaaaaaataaaccgtcaccgcagttcgacagtgcgaaatcacgacgaaatagcaagactaacgcgcgatactgacgaaagcgtgatgaaactagcaaggcgaaaatgtgagacgaccggcctcggtgtcgctatttggctgagcgagaggactattgagcctcaggtctcgcttgtggcccagcgagatggccacactggctgctaataacgcaattaatcgtactaaatagtgagattaactaattactaatgatattaattaaagaaaattaattaatgaaagtaattggtgactccgctaatctcatgcatgaagcctgtcggcgcgaactcaccgaattttttttgggactgtctatgtaacaagcagctgaaaattttgggtttgtcagccgtttttttggctgaccgtgcgatccgcgcatagatgagcgatgcacgtgaaaaaaaaagtagcgtgactcgtgactctgtttctgttttttttgttgggccatagcccacctctttttgtgaagaaacaaaaggcccatcacaatttgtacacaaaaatacaacaaaaagcccactaagttcacatagcccatagcccgcaacacaccacatgagaaaaggaagtccactggttcgcgtgaccagagcccagagcccacatcccatcacgggaaaaaaaagcccaaatacaaagaaatcatgtacagcacgcaatgtcacctcaccaatcctgcgtgcctgccaaaaatagaaaaaatcgatcaacaacatcagcacaaagaattggtagtgtgtaaaaaaagattaaaatataacagtgaactaaaatggagaaggtaacattgaaccagtgtgtggcatacatgttcaatcctatgtaacaagagcttgccaagtcaatgagcttagctgaacttgacaaaaaatttctaacaaaagaaacacaaaacatgtactactagttggaatttggaattgtcgtttctcaaagtattttaaagctgaatacacagttacacttgccttttggttgcattgtcggccatggcccctatgctcctctttctctgaactcctactgagaaaaacaaatcagaaacttgagcaagaaagcggcacaaattggggaatggttccgagaaaggagatacagcagcaggaagtttgaggcgtacctggccgaggtggtggaggaggcccttgaggaggatggaggcgactacaatgaggacacagacggctgccatgacagggataaaaaactgtagatctttagattaaaatttgaggaaaatttgattttatagttgctatcatttagatagcacaccagcttgattaatatgtaggaaaattttaaaatctgacaaagacaaagacaaagacaaaatacaaacacaaatatgacaaaattttaaaattgtgagatgctgacaaaatatatataaaaaaatgacaaaatgcttaaaaatccgttcgccgccatcgatagcatcatggccacgtcgacgctagttactattatgaagatagagcattaatttgattaatatgtaggaaaattataaaagttgacaaagacaaatatgatagacaaaaacaaaataacaaaggaaaaacctacaaaattgacaaaactacatctacatatatatgaatgtgggtaatgatagaaagtcttataatatgtaacggatgaagtagctaacaaaattgacagaattaggtactgttagtagcataattagttttattgctggtaaaactaaataatgtaagtatatgacaaaaaaaaacttagaaaatttactactgatagaaattttaattcaaaactattttagtagaaattgtacttaattgaaccagagtaaataatctttcgtaaaatgtcaattaattgcaaatctaagacttaattgaactactcatcacaaaaactaaatgattgaaatttactttaaaaaactactcatttatagtgagaacaaaacaatttctctaatagtttcccccacatctggcaaagagtaattactagaagaaggaggccaaaaatacacacactagtatacaaactcgcacgctcaatagttgagagtcagaatttctccaaggataatgaaaaaagaagacaattttcctcatgtcaataaggagaagctggagcacatgattgtaccagctaaacactacactgctcagtgagccatctcctccctggcatatggtgggcaccccctaacactacttttgcgtgaagaaaagcaaagctttgcaaatcaaagagtacttcctagctagagagtctcctctcctctcctcctcgaccataaaaaagtaggtactcaggatcacatatctatgtaataacaaaacaaaatgcggttaaatagtagtatcagactagttgctcttacagtagcatgctaagaaaacttgctactcagatatggagtcactaagctctccttgtgaaaaaacataatgtattacaaaacttcaaaagttctgaagatttatgtaggtttgcgaagttctcttaacagaaagcatatatagatcaatacgtgtctatcaaaatttataagaaaaatccacaattattccttaaatctaatccaaaataaaacaaacaagccaccatcaattccagctgcataatcatgcactgcctccaccaccaattcccgactccaacttcttgcttttcatctacaactactgctattcactgaaaacataattctacccccctatacataagaccttttagctttggataactaaattgataacaatgcaagaaatatggatctacatggccacaaaatttttagaaatgcaaaatattattcacatattgaaccagatcagggcaccaaaaaaccagctatctgaaaaggcacacatatcataaaaactttctactcctccatggctccatccgttcatctactaccaaaattacaataaattgtttctagacaaaatatgcaacatattcaaaatagggaacaaatacaaaaatcatatagcatcgtgctaaaggtaagctcaccgtgtggagctgtgtggccttcgagttgctcgctgggtgagccattgcaggattccatgccgagatccaacagattggtcctattcggctctcctagtgacacaggaagcgttgaggctccatcgccattcccgacaaaaagctttgtagaaacacgctgacgaccatcggagctgtcgagattgcctcccctaccgccatccctgcctcgcagataagcgcaaccgcaggcggcgcgcgcgtccgttggagccgacaccaagctctagagctccacccgccggaggagacgacgatagcatcacacccacgatgcggcatcgccgccggtgagtacccccgcgttatccaatccccactctctctctgctcttcttgcgtgagtgaatgaggaaaaaaaatcgagtctgagtttcgcatggggtccacggtgaagacatgcaacgagccagtgagagcgacgggtccagcgcccggatgaatgtgtgggcctaaaactcctagcacgaatcttggaaacaaatccaacgccctcaaattcagctgatagaacaaaaattctcagcaggcagttgtctagcaattcccattttttatttataataataattaataatatttaaattaaataactagtactccatccatactcataaaggaagtcatttaggacaaagtttaagtcaaaccttgggaatataaatcatgaatctcaaattgttgagtttgaaaatgtaaaaattatatgaatagatttgtcttgaaaaatactttcataaaagtatgcatatatcattttacaataaatatttttatagaaacaagaagtcaaaattgcgttttggataccgtgtcgctatccaaaacgacttcctttacgagtacggagagagtaattctgtgggagaattaaccaaaatagaatggacgttgtttctaacagcgtccagagatggacactctttcaaacagtgtccagatctggatactagtagaaacagcgtccaccttccaggtgcagccagaccatcaatacgccaccaataagttaagagaagtattgaaacaagagttgttcgacctaactagggttagggatcaccgccgtcgtcgcatgcgcctgttcgccttcgatcgggggctgtaatccgtacgcttcaccctgcaaaccacatcgtcgctgtcaacgccggcgccttggatttgtccgttactcagcgccatcaatccagccacggcgtcttcagcgcggcaagttcgttttggctgctcgctggcaacaggtgaactgcaagagacatgtatgtctttcacattgatctgcatatgtctttcggtgggaggcaacaggtgcccatgcatacgtttaactaataattagcattgatcagctgctgtatacattgtgttcatacgtactttatatatcgtcaggctcaggtgcaccctgaccgtagcctgaggccgtcagcgtgctgcggttcgtggcgccgctgccgagcctcccggcaaagatgttagtttacacccaaatttagcatctatgaacgaaataggggaaaattgccaaagtttgaaaagtatctggttttcttcacaggaccggtcagaccgcaggtatgtgggcggtcgaccggctagtagggtcggttagactgcaggtatgtggacggtcagattgttagggcctgagtttaagtttgttttcgtcgggtctcgggtttccttgctcaggaaggcatgttttgtgtttcctttagtttctatctggagttggacgtggagaaggacctgtagagggcaagaccaacccttatttaaaggacaagaccggttcattgtaataccccgaatacaatatacttgaatcgttcttttaccatgttttctactttaccctagttttagtccatctttgtcgatttgcgctgtaaatcgtccgctgcagctacgagagtgcgacacctctttgtaggtttgtcctgaaaaccttccgttttgcctatgagactggtagttatcctcatatcgatctaaatcggcctagaggctgattttgatctctaaatcggctccgctagccggtttagctattttttctacaaaacccatcttgatttggctgtttggctagatcgaggtggttggcgactccatatcaccgcaagacgtttaggtgttgtgatcgtacttgtcaacttgtcaaaaaaattgccaacagatgccggtggcgagttcaggctgccggtgtccacagcgccggcggccagcagcattgatacctccacaggcgctacgatttccatggccgctgcaggccggctcaccgcatcagctactgtccaggtagctcgttcatattgatgaaatggcaaaccatggatgcaaatctcaatcgaattcactggtggataaaccatctttggtcggtccggcaaaatccacaatagtcccgaatccaaatagaaccgggagtaaagattatttttagtcctggttataaaaattttgatctttagtcccggttggtaacatggttcatcccctgtcagatgtatgtcagggggccgaggatctttagtcccggttggtgtaaataatcgggactaaagatcaccactttagtcacggttggtactaccaaccgggactaaagatcaagatgtaccaaccgggactaaaattaaacacatagtatataatccatatcccttatcctctcctccacagttacaacttaacagatcgaatctcaccccctctcctcatatctatcctctaactctccaactcctccccttcctcctctcctcccccttctctccccttcctcctccccttcccggccggcctccccttcccatccggcaggccggccgacggcggggccgcgcactacggcggcgggcggcggggccgcgcggcggcggtgggcgtggcggccgcagcggcggcgggcggtgggcggcggggctacgcccggcgaccggcagccggcggccagtggggccgcgcccgtagttcgtggcgaccggcgggcggcagcggcattctttttttttttaatttgtgatgattcactgagatgtatttgactgagaagttacaaatttgtgattcattgtttggatctgtgatgtatttgagtaatttcttaggatattgtgatgtatttgatttgtgatgtatttatttgtgtgtataagtaactttgatttgtgatatagatttgagatgttacttcgatttgtggattgggggtttgatttgggatatgtatcccacttgatttgggagaaaataaaaaagaaaaaaaaagaaaaaagggatcctctcactgccgcaaccctctctttagtcccggttggtactctctttaaacaccaaccgggactaaagattgatttttagtcccggttatttgaaccgggactaaagataacgatctttagtcccagattcgtagtcccggttggaaaaccgggactaaggggggttacgaaccgggactaaaaagcatttctccaccagtgattagcttattattcagttgtctcgaatctcgatgaatgcgtttgagtattagagatccagagttgtcttgggctcttggccgatgcgaaatttgaactcgaaggaatagttggataaaaacgtctgaatagaacgtactgaaaaatgagtttattccaggtgattaataccatatcatgagttggcaatgctgaaaatcttgtcatgttcttcggatattctgaattcagcatccgttcacctagttcgtgttacaaagctgcaaccatcgtgtaatcaacatgttttgtgtctgaatttctgtcatcaagtttcgatcgagatggaacacgagctgctagtgtcgtcgttgccgccggtagaatgaattagccgccagcgccgtacgtgggcgcgctcggatgacattcgcacggatcggacgcacggcggcctccagccgtccagcgccggcagtgccagctggatatcctccatccgccgccccacgtccccgctccctgccgcccgtcggtcgttgcgcctggagagagagagagaggaggggaaagagataaaaagaggggagatgagagagagagaggaggaagagaagagtgagaatgacatgtgaggcacacatgggcccccaccatttttaaattattcattttaagtataattggcatgtgggcctacgatttctattatttccaaatcaaattgccccactatttttaaattattctttttagtataattgacatgtgggcccacgatttctattatttccaaatcaaattgtcacataagcgtcatgtcaatgccacgtcagatgatgaccgagtcaaattagccacgtagacgccacatcagctgaaaccgacgtccaaactgtatactttgttttaaactgatttttatagttgatggacccattgtatttggtttttcagttaaagaacgaaaatcaaatcggatttgttgagaagttaaaaaggacctgagatgaacttaactctttgaaatacgttgaatgagctagcctggcctggcaggctctaactgcgcgaattccctcctctgatgggccacatggcgagtcaggtcccatccaagtcagtccggaccgggtacacgcagcccagcccgtatggcccgacgagagctcgcagttcaggacgtcatcggcgagaaaccctttcccccacacacacacaagccacccagagaagcagagctcgacgacgccgccgccgccgccaccgccctcctccagactccagtcctccccccgtcctccatcctcgtccgtctgaggtcagatctgatctccagcgatcagggcgtttccatagcaccttatatctgattgaatcggaagcgtaggactgaaaccctgaacactatgcttttgttttgcagcggagcaatggcgggaggcgacgcgccgcagcataagccaatcgagtgcccgaaatgccacggggtgttcaacacccggcgcgagttcgtgaatcataagtgctccaacactcgtctattcatgctcgcccaggccaagaaggccgctaagaaagcagtcctgaagcaggtaaaccatcccccaccctaaatcccctctcctatccaaacggtctttactgcccctccaaatcgtctgacgattaagatgtccaatcgatcgatgaaacaatttgcgatctaacgttgtgaactatggatgctggcatccacctgcatttacaaccccctttcatgcattttattaacttgctgtaagcatcatggaggctattactgtaacatagatcggccgtcgattggattctttatatattcgcttgaatgcagcaataataagtaaatagttataacattgaagatttgaagctgtcacataaacattatactacccgtgatgtcaaataaacattataatacccgtgatgtcaaaaatcaaaaagcattactttttcaagcaattaggatcctgaatttattgtgtacaccgagtttggattgggatcgaatggaactggaaggattcatctgcatttcaaatcaacctgcctgcatgtttgtactttgcactttagatatatgtgttggaagaaatgtttcggaaatgtgtatagaatatacaatgaaaatgtatggtagtgatatactggttacacgacagggatttgatgatacttgtgagatagtgatataccgattacactaaagggattttcggttcataaaatcccttgtgcttttgcactttacttgaatttgatttgcgtaaggatatgtttacatggaatgtgtaattgaggtttagtcaatgaagtttacagatcttgttctggttgggtagagaaaaggcaacactggaatatttattacaactaaaattgtaaggggcgctttctttcatggtagttcattgtggtaatttgcaaggatactcattgtacactaaattactaaataatacataaactgcaacatgtttcaatagataaaatgtactccctccggtttcattgtaattgacgttttggacaatgacacggtctacaagatatatctttgaccttattcttctattataatacatataataaataaatgcatgtttacttttattatagtactttaaaagacaaatctatatgttgttctagttcctttaaactaaatatttttaaagttattgatggtcaaagttataaaagtttgacctcaaccttgtccaaaacatcaattaatatggaaccggcgggagtagtggtacagcaaaaagacttccaacaatatatctgagtgggtgatttgcgcatgaaatggttaagtctctactactcaagtataaaacagttaggttagggaaaagtgttatacatattttatgttccttcttttacacacgaattaaggcttcaatatatacctgttgttatgcagccttcacagcttgtttttcttctccctcttcatctgtattgttattcctgaagcagaaatagacatgtatttattcaattagttgaattcgtgcaaagcatcaacatacctaccagaagaatgttgcattagctacaaagtcattctcatattgagcaatttcaaaaaaggagaatttaaaacacacacataatggtttccttactaaaaggaatgcttgtatccctaggtgtggttttacaccatgcagcaatgagaacgatgcattcatgtggattaaatataatttgcaaagaagaaacagagaatagcaataaactatctgcaatgacaccataggtcaaaatatccattgatgtgggcaataaactttagtatctgtgcatcttaaggttccgttgtgattttgagacaacatacttgcttaatattattctgattttttttgtttgaacagatccgcaacaagggcaacaagtttaactaaggtggtctacgtaaagagaagttctgatgataaggtattgttcttttctgattctgtgttttggatttttgtttgcacactacccaagctcctaaacagtgtgtttcgtgcaaaaagaatatatgtgtgatctaaaattttgttatataatttaataaagtaacttttgaactttatagtagttaatccattcatttatatcttcaaaaggctatcacataaatgacaagttctttaaataattgtctagtacttactgatggtattagtgtttactgatatatatttttatgacagatggaaaaatgcaagggtatctgaaagataactggacctgaaacgttaccttgtttgagagtatatgtgaacttctattatatatgtacctcttacttctattatataacctcctatgattttggggatttagatgggaatcatgacagtctgttttgtttggttcccttgcccaccattatagcattgctatccttttctacgattagtaatggtctgttttctttgcatgattcgatttttatcaaagactgagatcacttagtctatccagcaagtttaaaaggctggcactgctagcataagaaaacaatttgcatgcttttgacagggtcccaaagtagacctcctatcctagtagaggttttcgttgcccaaaccggtacaatgcctaatctttgagcttacaaaatcagaaaaacccaaattatctaacaaaaaccagaaactgaccagatgttgtatcacctggatttttttttaatataaatggcgcctattgcggtggtgagtacactaaggatattgatgggctacaactttcgaagttttcatggcatagcgtgtccaagtccaaccattaacgcaatacagatagtcgaggcaaacgatacagagatgatgagctgcaaatacgtacctgtgattggaaatgggtacttgaaatggcaacaggaaagattgggttaagaacatgtattgaatgaataactttgtccaaggcttgcagaggcgatatgtctctccactccagtgggtaactgggtatagcactcatctcgtttacttcacactcccctatagactattcaccttcaagcgatatatcataattgatttattaaaccaagtagaagaagcaagaccacaacaggcaaataaccagtagcaaaatcattttcaccatgtgctcggaacgctgtagtgattctaatcgttctagtagaagaagatccgagtagaagaggcaataggagaaaaaccagtagcataatcatatatatttccccatgtgctccgaatgcttgtggacgatctgggcaacacaaagaaaatacaaagtgggcaaatcaatggcaacacaaagaaaatacagactggacaaatcgaagcctacaaacgaattcattctttccgtataaactcgtacactgctaccagatcaggtagcacctgacaaaaatttcatagataattgtatcaccagcgtctgaatcctcaccatgcaaattcaagtgacggatcaaccaccaaataatcaggtcggtggcatctcgcatctctcggtcatccagagatcaaaagaaggacctagctcaagctcgtgctcctcgtcctgtctcagagaaacccaaacaccgccacgacgccgcggtcctcaagctcgtgctccccgtcatgtctcagagaaacccaaactccgccacgatgcgatgacagcttacgtgaaagagcgatatgacgaaatagaaacagcggtatgtcagatcctgtcagatctgaaaagctaccggtagaaacaagtatattggctaagtggctaacctcgttctgatgagaaaacccgcaaagacctcatcgccggaggataacctcgccggcatcggagctatttgccccctatatagcgacgctcgcgatgtgccggaccccttccggctgaacacaggtggcatcagccacggcggcgccatgatttcagccgacgaagttcggcggcgaaccataaccttcgcctttcctgacagaaaagggacgacgctagactaaagcctcggcttccttcgtccgtgcgccgacaaaggaggcgacggagcccggccccaggcagctcaagcctcgccggatagtgccagatctgtgcggcggcgccgtcgttgagaacgggaggttagggttggggaatcgattttggagataagagataaggatgggtgccaactatagaagtaactaattacagggagaggggtagacgaggctttctcacgtatagagagagaaaccgcatgcgaggcgttggaataggaataggaaccgccggtccggtgcgtcacgcgttttttttttcgttttcttttcctttcaatttatttatttattattatattacttgcaacaccgggtgcgtgtccagatctagcattggaaaaaagaaagggaatattaaaagttgtaccgtgcgaatattaaaagtcccatctcatcagtataaaggggaaatacacatactgtactaccgaaaaggccccagctcacacatggaataaaacaggttgacctaggggtaagctagtaaatttaagtgaagtaagcttgcttgctacagagcggccgcatggctgtcggtggctcactggctcggtggccgcaggaccactcgctcaacactcatcttttttaagctgtgagtgacatcacgtctagtagagggagtttggatccatcgctggtcctcgacatatcagatatttgatataaagtattaaacatcgactacttatataaaaactaattatataaaagagagctaattcatgagataattttttaagcctaattaatccataattagtacatatttactgtagcatcacataaaccaatcatggattaattaggctcaatagattcgtctcgcgaattagaccagggtatggaataggttttgttattaatctatgtttaatacatttaattaatgtccaaacatccgatgtgatagggattaaaaaattttagccccatctaaacagcccctaagagcaagtttaataatatagtccactatactagctctaaaatttaaaacatcatatatataatcaatctaatagctcgcttatataatagttagctgtagaaatattgggagtacgtcattaatgcataagggcatccacaatgtactttaaaaccagtccatagtcaataaaataatacattcagctacctaaccacattgaggaagtagtccataggagagaaatagcaaaagtcatccataagcatatgggctgcccatatagaataaaatatgtcatttgtctctatttcctctctcctcctcctactacttactaactatatacattgtgaatgttgcaatagttaaagtccacaaatataggtcccatctatatggactactttagctatatacattggtgttgccctaacctacccatctctctcacataggagtagtttattggaactcgtgctgcagctggctacgaatctatactagcccgcttttgttatctctcctccacacaagcacaaatctgatgtgtcaacttctatagcatgcttatgttaccttattgtactcgctctatattttaaaatgtacgacaccattgactttttgacccgcgtttaatcattcgtcttattcaaaaattttgtacaaatataaaaatatttatgtcatgcttaaagaaaatttaaggataaatcaggtcacaataaaataaatgataattacataaattttcttgaataagacgaatagtcaaacgttcatcaaaaagtcaatggcgtcatatattaaaatacggggggattagtaacttttaatatatttttaatactcaagctaagagtaaaaattataatagttattaacaacaaataaaattgatttttcaaactatgtttggagataaataaatttagtagacgttatacgagattgtagatgaaatatgatatcccgcactttgattatatatatgaatatatgttactccctgtcacaccctgaagttctccccccaagcctaaattgaatttataaatggtcccaagaaaatatcggtgtaaaagcgagagtaaaccctaatagatcaatgcaaataataatcggaattggcatgtggaatttttcttgagttctacatgtcgaaatttgctaacaagatttttagtgaaattttcagagccctagaaataattttaaccaattaaaatcgagcacatgcaattttaaatcccaggaaaaatcctttcttccttttctttttcttttccctcctttttcctcttcttgggccgtcggcccagtccgcccgccgccgcgcgcgcccttttcctccttgtgggtcggcccaagccgcccctccctctctctccgggacgccgacaggtgggccccacctgtcagggtcgtccccttcctccggccgcccgccccacgtcggcaaccgccgccgaaaccgccgcgcccacctcctccgcttctcccgcgcccacgccgcgccgccccgcgtcctccccacgtcgccgccctcttccccccccccccccgagtctcccgggccgcgcgcgcgctcgcaaggggcgggattcgcattttgaattccccccattctctctctctctcctccccacgtcactggcggaatcggaggccttcccggccacgttctcctctctcgagcctataaaatcgcttccccgagcctcctcttcccctttccgctctcgccgctccctcccgtgcttcctaccgagctcgcgccgctcgccgcccgcgccgccgcttgccaccgcactccggccgcgtgccgccgccgcgctaagccgccgccaccactagcttcgccgccgcaagatctttctcggccgccaccttgcgtcgccggaatcccaccgagaccccatttcccttgcgtcgccggtgagttccctctcccctccgactccggccggcatggatggccgccgtggggtttttcctccgccctaattcctctcctctcctcccctaggtgtcgccgtcgctcgtccgcacctcggcatcgccggtcttcgccgcctccctcgttttccgccgccggtcgtcgccgccccctccggtgaggactccctcacccttcctttccttccccttcccgcacgcgccgtcgctttaggccgcgccgctgcttcggctgtgcgccgccgccggtcgccgccggtggtcgtgcgcgccgccgcctctagccatggccggccggccggctttgaagccgagccgagcccggcggttgctccctgcaccgtccgatcggcccgaggccaatccggaccgtcggtcccgtggaccggcggtggaccacccgcgtcgtcccggtccacggtggaccggccgctttgtgccgctgatccatggggcccacgtgccagcgccccctccctctccccttgcgccgctgacatgcgggccccgcatgtcggcgctgcccgctccctttgatgacgtcagccctgggcatttattgcgcaataattcaattaaggatttttctgtttatagtaaaaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgtattgtttgctttgtatgtcgcttagattccggctcttccgacgctccggtgtacttcgagatagtcgccgaggttcctccagcagtagagcaaggcaagtcatggctgttacttgaacatgttgatcctatattgcaaatgttctaatgtttttcttcaaatactgcattgttttacaataatactatgggatgtttacctactgttacagccatgctattttggtaccatgctcctttgttagcttgggttataacatgactagacattggactagggattgcttagccatgcttagttcaactagcacacaatggggaaaatcctattaatgtatggactgtaggttctaatggtaatgttggattggtgccaccgcttcggtgttggttaattaaaataaatcacatggtgggctgtgggtgcatggttttgttggtcgcgcccatggcagttaaggaccggttcgcgggatgccctggaagaacttatcgtacttaccacaagccagcgtgggcaacggctgggcttgtagtgtagctttcctctagctgacgcatccaggcaagggtgggcgtgatggagtttggatgggccctgcgacggcctatgcggcttccggattcacctaggtacgagagaggactgtccgctgccttgcgaggagtggggggtgaaaccttaggtgtggtgtgcttggttagagggggttatgcgacgggtcctgtcacggcctctttccggtatgtcgtggtggcatgccggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtataggtggatggttgggcctgttgcaacgtggtatagcgttggacagtggatgattaatattgattaattgttacaactgttttacttctctgaatttctgtttataaatgcccgttttatgcaaatgaaccgttatagctatcccttgataattccctgcatcataccccttttccggtatgacttgctgagtatagtggttagtactcagtcttgctctattttccccaaaccccagaatttgagtatgcgtcatatggtgatttctccgaggagtaggcttcgtccgtgccgtcgaggatgcctgtggagtggtgttcccgctgcagatcaagtcaaggcttagctccagttatcttttgtttttccgctgcatttatgtaagacttttataatgtttgtaagacgtggatctgtatatcaactttgtcgtttgtgtaccccggcctgtcctggatggggattttaatgcacattctgcttggaattctattcgggaatttctgagcgtgacactccctctgtcccaaaatataacaactcttagcccttcggatttgtcccaaaatataacaacttctccaccaacattctcttcccaaccaatcacaaccctccaccattcacttttctcacctacctccgctacttatccaatctcaaccctccaccatttacttctacctactttcttaataaccgtgtccaacaataaaacttcttatattctgggattgagggagtaagtatcataaaaatgaaggtagatgattatatattgatttgtataattcaatgaattgtaaatggtgttgtatgcttggatgagttttgtatgtaactattgctagtagatgagatgatatgtttgcacgttaagctttagaattagtgggttgtaactttataaatagtatagattgtggaggcaagtagagtagtagaagaagaggaaaggggcatattagtcctaaaaatcttcagccttgttaggttgagatgatttttgtaagaaaaaaatgtttcattagttcatttgaatgtgttgtaggctaagggagtgtttggatccaggactaaactttagtccctgtcacatcggatgtttggacataaatgagagctaattcatgtgacaatttttttaagcctaattaatccataattagcacatatttattgtagcatcacataggctaatcatggataaatgatgctcaatagattcgtctcgcgaattcgttcaaggttatggaatgggttttatcaatagtctaagcttaatacttctaattagtgtccaaacattcgatgtgacagggactaacaatttttagtcccatccaaatagctcctaaagattatcaccgatgtataaaacgagacaagttgttggcatatgattaattgagtattaactataataaacttaaagaatgtatttatttgattttttaagcctaattaatctataattaacacatatttattgtagcatcacataggctaatcatggattaattatgctcaatagattcgtctcgcgaattagttcaaggttatggaatgggttttatcagtaatctacgtttaatacttctaattagtgtccaaacattcgatgtgacagggactaacaatttttagtcccatccaaataacccctaaagattatcaccgatgtataaaacgagacaagttgttggcgtatgattaattgagtattaactataataaacttaaagaatgtatttatttgattttttaagtaacttttatacaaaaactttttgcacggaacatatcgtttgacagtttagaaacgtgataaaagaaaaacgatgaagatgccagaaaacaaacagcacattcaaactacccaaagtatagaataagtaataagaggtacaaagtctaaattgttctctatatagtggtggttcggtttacacctaaagtataaatccaggcatcatacccctttaaattctaaaattattttccaaaatataatgcaagccgaccgccgctgccctcctccctcatctacgctaacaaagacggcggcagggggctccttctccccctatgatgcagctatggttgggcaccaaggcaacctggatggtggtggtcgcgctgctcagatcctaacctccacgatcagattcggtgaggccagcgagcggcgcgccaacgatgtaggcgacagccggctgcaggcagctgtgggcgacggccaactacaggtgtggtgatggaggcggcagctgggtgacctcctgtgggggtgatggagatggtcatgaggcagggaagcgacaacggtgtggatcaggcgtcatgtggccaaattcagcgaagggagaactagtggcgtcccagacggtagtagatggaggtgggaaggtggcggcaaggtggatctagcgtcccatggccaaatccgttggatctggtgagcgcgggccagctggcgtcccgtacgcgaacgttggcgcgagctgtccacatgtggtggcgatgacgcgagcagcgaggctttggcgcgagctccacgcaaccagaggtgtcgtggtgacaaggagctgacggtggggtttaggcgtaggcaaagctgcggtagttgagtgcgtgagcttgctacctttggcggtgtgcggggagatggtgacgacgatgtatggtcggctcgccggaggtcattgggctgccaaacttcgacacaaccgagagccgaggtgacggctctcgtgctggtcggttggcggtggggcgtcggtacgatggacacatgacgaaggtgttcaaaggatggcggctgacggagacaatggggatgcgacgcgttgtgagggtaggatgtgctttcggacgaaaactcggcctggtttccatgtcgacaacaacaatgtttcgaacaccgtttccccgttggtggcgttttcgtggcatcctcccctccttagtggaatccttcggtgaaaaaccaaaggcggtggcatctttggcgtggtgacctccttggaggcgtcgatttaaagttgcatttcctcctaaatctcttctacatgcgctttgtacttttgcagtgacacttgtatccagtacaagttggccacatccacagcactgtgcgggggaaagcagatcctttttctgtcgacctctctccctccaatccaaagacgtgaatggagatgagtgtgttcaggatgtcatactcttgtctgctagtcagtaaggtcttttgttgtaggcgcgtggtgtgacttggttttctttttccttgaccatagccttccagggttgtggtttgtaattttttttcctaccatatcatataaaacctcatactatcttatgttttttattaaatcttatgcaacatgatttggatggaagaaatattaacaaaagaaaacagtaagtttgggacattgcaacgttcaataataataatccctccatcccattttgatcatcccctaaagtttttgaggttttcccaaaaacaacatcatctaaatgtgcaatgagtaaatgtgcatcattgaatgtgtggtatgcaaccaatcaagattacttttcattggtgcaatatttaaaacatgagcagtccacgagacacgaagcgatgaagcatcataactgatgaggattaatttgagaatgctgaaaattttagtgtccttgatcttggtgtcatttagttaggagatgatcaaactagcacggagggagtatctactatctagcacaacagctatctagcacagttatattacagcctccttgcgaatggcgctcccacaacaattcagagtcgtgtgttcgttcgccgcgctatccacgtcaccccgaaagccacaagcagccggaatttgcgagtgagcgtacgtggggagcatcggctctggtcattttgcaaaaaaaaaaaaaagccattgatgtaactaataatttgtataggtccctcatcattcgttcctcacttttgtattcttacgcaccgaccttctaaaatgtaaaatattttatggtaagaagggaaaattaggaaaatataaccgcgctttggaaaacataaatattttatgtcagatgtgcgtcaatcgtgccaatactgaggcctgggagatctacttagctccagtataggaccgtagatcttaatttgatgaggtacgggcataccagttagtttgatcctacaagatgttgatatatcagcgattagccgataggttgaatgatcggttgttggagacttggagactcgaatgctgacgacgatcgcaggctcgaatctcaagtgttttggcatgccgatagctaatagccgatggcttggtgtagaatcggctgaaggatccagtgctagtactaatgctgaacgcctttggttgttgacatgaaaaaaaaattaacacagtaatgtaagggatgcaactaagcgaacaaaatgtgagttgttaaacgaaaatgtaagggaacccatgagaaaataagttgcgagagcaattgacaggacgcagggctttctgtatcatccctctgcaaacatttacattaggcccttaagtcaattgaaggcgtcaattttgtaccatgcatctcacaattattgttttgagcttcgatttgtttcaacctagattttcaatcttatatggaaatgtaggaaaagatatcatcatagatctatgcattatgcctgaagtcaatagatcacattattttaatgagccacacaattctcagtattccaatgcaattcagcctcaagacaaaaaaaaagtcagctcacagtcaggcttatattaaaacccatatcagatggatcagtaatgatttgtgtagaatatctgtcagcgtaagatttcatctcgtacgcacgagcgcctgtgtcgctggctggctaaaatccatctccagcaagcggcagcagtaccatcacgcaaagacgcaccttggagattatgtataccatacatccatacaaacaatttatccgactaaaaataggaggaggtgcgccatatccatgtgttacgttaatagaataacagcatgtggggttcgagacaagaaaagcattttcctatgtcacaatataaaatttgcaagcatgtaatatttctataagcgaacaaactttaaaaaccgatccaaacgcggatggcgtaccacaatactggtaaaaacatatttaattttaaaatcattagtagagattacgacgaaaacgttttgttctttttgtttttttaaggcattttttcttttttttatttttcttgttttttcgccctttttattttttggatggacttttttcacggatttttttggttttttcgactgccttttttaaacctttttacgtattttaggcctttttttttactttttatataaatcattgcatacaaatcccgattttttttccttacgaacgacttgttttcatcgttttaggggaatcagacttttcttttggtggacttttttcaccttttttttcattttttatggacggttttttcaccctttttacggggaatcggaatcggatttgttcgcccttttttttaattacgggcgacaaacacgttcccaattaattcgcgtggatgaaaatataaaattaaaaccgatttaaacatggatgacgtaccaaaattctaacaaaaacatctttaatttttatctctacctctatctctactacttaaaaaattgaagatgtttccttcatctgtccaaataaaaaaaaagcgaaaaaacaacctaaaataaaaaagtatgattctcctaagaagtggcagaaaaaaaaccgtagatccgattcccctataatttttgtccattttattttctttttgcgtttcttactcttttttttttctttcaccgttttttccttttccttttctctttcaccatttttttatttgcctccccatatgtttcctcctccaattcattgtaaaaaccgattcctcactactcattattttccccttgaattcccctttcaatttggctttaattcaccgaattgaatctccatttcatcgtcattattttttatctcgagttttgtggattgcttcaattttgataaaaaacggaaaaaagagatcgattagatcaaaatctctcaacaattttgatttgatggagaggatcaactccattatcatacgtgcacaggttatgcgagaacaattttggagatggagaaagattcaactggatttgaaggagaggatcggctccatcatcgtacgggcacgggactatgcgagattgagtggattaccagattttatgggaggatcggctccgtcatggtacgggactatgtgagctcgagcggattaccggatttgatgggaggatcagctccgtaatggtatgggtacgagactgttcgagctgggcctatagctccacttatgggttgagccgaagagaggtagaccaagcagagggaaggaatgagcgttcggtccaaaaccaagaaagcatctggtccaaaaccaaggaaccaagggagtataatgtataggataataaacgtttttacccgttgcaactcacgggcattttttctattatactctccgtttctaaatatttgacgccgttaacttttttaaatatgtttgaccgttcgtcttattcaataaatttaagtaattattaattcttttcctatcatttgattcattgttaaatatacttatatgtatacatatagttttacatatttcacaaaagtttttgaataagacgaacagtgaaatatgtgttaaaaagtcaacggtatcaaatatttagaaacggagggagtaatataatagtagagataagccagccaaaacttgtgcactaacttactgattggattcagatgcagtaacaaagtttactaggcaaaagagtagcacaattctgatcggacaaatacaaatttaccggacttaaaattaagaagtcaaattttgtgcacaaatcctgattggactccgattcattccgacaaaaaaaagctacaattctactccaattcggactcccaaacgagacagctcaaggctggcggcagaggcagtaatccggcggcagcgacgcgggagagaccttcgcgatctgaggcggcgacggggacgtcagccgccgtccctcccagacgtcccagcgcccgatcaaagcctccggccagcacacgcttctgatcagcaaacggacgaaaccaactctgatttctgaatcaaatctatttccagatcgagcgaaatccctgctgtataaagcgcaatgacaccacgactctgattcctgaaactgaaagggactagccgattgctagatctcttggttccctgctgcacaaaacccagccaccaagacagaaggatcaatacacctggagagtaaaagaaaaccagaaaaacaaacacatatggccgcgaaatccgacgaccactcgctgccgccgggcttcggcacgaggccatggctggtgcagggatcacgcggcgacacgctgactttcgtcgatgtgtcagacctcagcctgcacgagaccgttgttcctgaggttcgagggaagacgtgcttggccggcatgcacggtgactggctgctgatgctgcacgagtctactgcgattgcttcctcctacgcatcagcaccaatccacggaccaagattcagttgccgccgttgcatcagcctctgaattttctatcaacaatcaagatgctcgagtcaccggatagcccgaagtgcaccatcttaattgccagctcaccggaggtggaagaagagagctaccttctatactgccgccccggtgaagacgagtggaccaaactggtttccccgttcaatgacatccatctctctgcttttatgtgcaactacgaaggaaagatctgttctgcttgttctaatctcgtagtgatagatatggtggatggtaagatacaactacagcgagtgggtaccatcaaggatgaagaaaaatatgcccgtggaagtggttgttaccatgttgtcgagtcatgtggaaagttgtttctcttgtggatagaagagctcgggtgctttgggaacgatggattgctcaccgccattgatgttttttgcttggatcttgagttgatgtcatgggagagggtggagagcattggcagcgaccgtacctttcttatctctgaaaattacactttctcatgtccttcaatagaaggtgtattgcaaggaaactgtgtttatcttgtatggtcaagctgcgacagtgagaggctttataagttctgcttggacgacatgaccattagcttccaacagattctttctcaacctacaaaaccctggtgtagagcattttggactgttccagcaaggtgagttgattcagcacacacgactattttttagcattgtctgcaatagttttttttttccaaaaagaccacattttactgaatcatgtatgagtatgactattgttaatatgcaactacagcatcgaatcaatcttgcccatggaaatatcagacaagccaaatagtcttctatcgacaaaggtttgtaaatccgtgcaagtatgttgcagtgaaaaactaattccctttatactagtaaatacggagtagtaactaaaactattcttttttcttctttttagctgtcaaaggatattctactcaatgaccttgatgagcacgatggactggggaattctttatgtctatgggaacatctaccagtagacttgctagagttaattgtctcaaacttatccttggtagaccgcatacgatttccaactgtttgcatggcatggagcaaggtgtcgaatccaatagagcaagcaaaagtttggccttggctaatgcacatctctaagcaagatgggatgtgtaggttgtttgaccctctacgcggtgaggtgtacaacatgcaagtctcaatatttgacactaatgaagatcgacacatttttcgctcctccaaagatggttgggtgttcacatcagctgggatctatggtcacgatatattcatcataaatcctttcactgaggatattgtggagcctcctatgttcgaacgtagataccactacaacggtgtatccttttcttcaccaaatccaatgtgtccaaactgttatttttttgggatcaacagtagtctcagcgggaagtttctcaacattcatacgtggcggcatgaagaaactgaatggatcgagcaacgctttgagtacgatgtgccattcccagtaggttacaataaccccgtcatgttttgtgggaagttctactgcctcggaaggaagggcaaccttggtgcctttgatccaacaagcaatacttgggagattcttgacaagccagagccgatccatgttgagatggatctcttacaaaatgatcataggggaagagagttctgctacttggttgatttagaaggagaactgatatctgtactcttgcataatgccagtgaggcgcctcgagtgttcaaacttgatttgacaaaaatgtcctgggttgaagtagaggacattggtggtggtgccttgtttcttgatcacaggacatcgcatggtgtaggatctcccgatggtggtcatggaaataggatatacttccctagatattctgtggatagaaaaccagtgttctatgatatggataacaagatgtactacccatcattttatggtcacattgagccattgaactgtgtgtgggttgtgcctaatctgcacaaaaatgaatcaacatccgaagattgacccaagcgtgtgtaattgagcatatagtgcttcttttttttcttttttttttttgcaaattgtcaaatatggaaccacgagtacctctatttgcctcaatcgtattgctccacaaatatggtttttacctgtttttacatgatctctgctagactgctacagtaagttgcaggttttacaattcatgtacggggtcaagtgtggtataattcttccttgatgatatgctataattggatctcgttgcagcagctatttttgtgctgttagagatattggagttactttaattattgtgtgcatggtgccacacgctgcacatattcaggcgttcttgaatggcgccacacgtttaggcgtagttgaatgatatgaagatttagcaaaactatcgatatcctacgatatttggatagtgataacttgctagttcttgtgggaatcaagcaatccatggtatgaaaattttgcttgaaccatcaagcaattaggaaaaactggggcaagatttcacaggttgtgaaatatattttgtcaaatcaggttttagagcaggaaatatatgagataaatctgtaggggcttgaaattgaaatgttgattgttcgccgtgattttacagcataagaaatataatgctgctagaaatttgatgaaaagtcagggattataactaccaagcaatcagaacaaggtcttgcaaattacatgcttgcttctcataaagtgtccatgattctcagatgggttatcacaaagagatttgctccggtccggcaaaaagtatctcaagatactggtacctcattgtactaaatcattttcggtcgttggatctagctgggtagaatgagaattgttaaatctaacagtcggaaacgaggtaccataaggtaccggtatttcgagatattttttttgttggaccggatcggagcaaacctctatcacgaaacatatactgttcaggtgaaccattgatgcactgcttttcttgaaaggaaactcccattttttttaactgaacttctcatcgatgcacaattatacttactcccgtttattacccgaacttgtcaatataccaactgagccataatccataaatataccggcgcccaattgatgcatatttttctccgttgcaatgcaccaacatccaagtagtaattcagtattccttgcagaaaaaatagtactccctctgtttcaggttataaaacgttttgactttagtccaagtcaaactactctaagtttgactaattttataaaaaaaaatataatatttttaacccaagataaatatattatgaacatttatttttattcaattatagatttaatgaaactatactggtgttgtaaatattactatttttttctataaaattagtcaaacttagagtagccatcttataacctgaaacggatggagtaattcagtattaaatatgaaggggatttttggagtacattaaagtggacactagctatttattgggttagatccaacggagatgctgtcctactgcacccggtagtagtgcagtagaattggtggaggggtaaatttgtactccatgtggtatgggtatgtttgtgttagattgatctctggccatcgagtcagagaattgctctaatgggcttggcccaccccaagcccacgcgcacctaacgttaaggaccgattccctcggtcccgaatacacgtcgctctttctagcgctatgatcggaagcgtttttttcctcaagaagaaatcgcccccgatccccttaatacgcatataaagggaaccttgactcacgggtacgagggtctactcacacactctaagccttcccaaaacccctaagattaccctcagactatcgatcttaaggcgtattggaggggagcgaagggcgaattcccatcgccgccaccgcacggtgatctccatcaccggctcctcacggcgactacaccaacgcatctaaggcgatcaatggcttcttcatccggttagtataccaccaaattccgcatatgagatattaggtgatcatgcatagcctaggtttatgaatttaagatttaagtacaatattgtggtatcagagccttcttaggcctttgcatgttccatcactccggtggtgaagccactaagccgcatcaagtctccctaagcgccggcttgttaaagttttagggtttatgttctgttaggttttgttcatgtcgcaattaagttcaattttgtgattcatgttctgttgatcgatattagactaagttttatgtttagattgctatccctactcagtttatggcttgggcagcaattggaaggaggggactcagatcggggttgagattaagaaaatccccaatttttttccccaagttcctaaaacccgaaaccctaatttctgaaatttccccaaattaagaacaaagcatgatgaattctcgaattagattgatcccgattggcaatttcccaaatcatgagaaaaccctaaggaattgggactcaccgatttggggctcaggtcgtcggagtctcgccgcgcgtggcatgagcaccgccgtgcgcgtgtgtctccgagctcctcactgtcttcatgcgaatggcgcatggcttcacgcgtcgccgtgcatccccttagccgccatctcggaccggcctcacgctcgcatcagtccatcgccgcgtgaggtcgaggctcgcctcggtgtggctccggccgcacctaggaggaggaccgaggcgggaggatgagacgacgtgcggcatcagcgtcgccgcacgtcgccatcaagcacgccgccgactggggcctccgcatcgccgctccaccggtgacccaccgccgttagcttgcacggattttgctccgccggtgcgccgtggttttgaccgccgcctaagccgtgcgtggcattagcttgccgcgcatgcgggggcctcagcgacgccgctccgccggcgagccacccgccgcccgtctcttcccaccagagccgtgcacggcattagagcgccgtgcacgggggcctcggcgtcgccgctctgccggtgagccgccgccccgctctcgcctcttcccaccggtgttcgtagatgtctcgacatcaccggaacagcatgtgggttgattcgtgttgccgcgaatcgcgtggaacggcggcgctactaccaaccactgccgcgacgccgtcaccgccgccgctgccccaacccaccccaccaccgtgccgccaccgccgccgccgccgtccccaccgttgtgctaccgtagagagttaggtttggggatggatccttttgaatcggggtcctgtgctgttgaacaatttgagggctgagatgctaaagtttgtcactaggcggggtgtttcctgaacatttcaacatggggtgacgtggacttatctggaacctacattttccatccaagtgtggtttctatgtttgcactggagatggtgtttccactatatatcttctcgaccaacgtggcctaaatcataaaggaagttggttggtgcgcatactcaaccgatgcatgcatccgaacctagctcggtcaactcgacaactcgacgctgggctgcggtgcgcgcgaccgaacatggcattaatggtcaggatttatttcacgcggcgagcggtagatgatcgagcggcttggcccgctcgtcagctgcacgcatatcatgcaccgtccacacgaatggaatcactagtacgagtcggcggccacgctcgcctgtgcagtttaaaaaaaaatgaacggaaaacagcactagagtgccttttcatctaagagcaggagaaaatacaaacccctaggggtaaaaggaaaacgaagaaccactatagctgtacactatacagagtgcgggattaactcacgcaaccgcttagctcctgctaaagcccaaaggctcgcctcctctttgattttcattagtaggaaattcgttgccacctctttgtgatcaaaaatccgccgatttctctctttccaaatttcctagacgactaacagaatgagcgatcgaagtccttttttcgggacactaggcgtgtttgcaatgttctcccaccactgtatgactgactgggcttcctcccattccgttgggtccatctgctgatagcccacccatgcagagacgaggtgccagatcctcttggtgtatctacaagtagcaacgaggtgcaatgccgtctcagtctcgcggcggcaaagagggcaacaaccattgttctgccatcccctggtcgcaagctggtctgaagtccagactctgttctgaatgatgagctaagcatgaaatttgcatttccccggcgcgcaggctttccaaatcaaggaattgagtactcggcgccccgcagcactgcgcatggtaggccgaggaggaggccgtgtaggcctgtgcagtttacagttacagttgggtggggggagcttttaattggctcacccaacacatcacatgcacgacgcgcacatgcgcgggcgcgtgatttttcggtgcttctctcctcgcccttccgatcgcgacgtcggcccagacgagctagacggacacgggggacgagccactgtgcgccgcagagatgcaaactgtcgcgtcggcgtcgaaccatatgcgccgcgtgtttaccgccgtctaccgcgaggggcctgtgcggctgtgcctgtacgcacgtgtcggtggtaagctgcagtgcaccgtacacgtacatactccatgacgtgccagatctgtttcatattataatagatttttaaccttttttaaatcaaagttcttaaaagtttaatcagattttaaaaaaacatagtaccatttacaatatcaattttatgttattaaatctaataccgaatatattttaatagtctctttgttacgttgaaaatagtattatattttcctctaaatttggttctaaacttgaagaaatttggctttaaaaaaatcaaaacgatttataatatgaaacgaatatagttacttttcgtaactttagctttttttttaacctcttgataggtttggtgagtgcaataaatcacaagtagatcggcccaaacaaatgggttttcaattagaataaatttaggctttaatcgcgccaaaatgtgtgtatacttccatcattaatgtgtcatgcgactcggcgaggggtgtgctagcacgaaattttttatttaaatttcaaaataaactttttaaaaacttaaataaaattttgaagtttttagtcatgtcaaaacaatattgtcacgccggtctaactagtgtggcaatattaatcacgttgtttctagttggcatggtagtggtcttattacatcattgtagctggtgtattaggataaaactgacatacccgttgcgggtggcgtgtcagtgttattttgtcacgctaagcgagttgcgcatgctaaaaattcagattttagaaatgagttttggaatggtttgtttttaaattaaaattaaaaaggttcgaaaaagaattctgccggcactaagaacatgcccagcagatcttccatccggccatccatcctatatttagcgtatggaggtgaaaaaataaggtccaccaaagtctccatcacacacgccatctttagatgtcatccaaaccgagctctctccatgccaaatttggtgtttctctcttctcacgctatcctccctctgacgaactcgcgccaccatccagactgtaccgtggggaatggagaggatggacataccgagtatgccgttggagtttgctgaagaggaggccccgccgtctgtgccgcccccatcgggactccacccatgccgctgctcctccgccgcgctgtcgcgatgcacgcggccaccataggcgtcctccgcctctcgcacgtctgtcggcggctgcctcatctccggccatccgcggccctcgcctgcccagttgctcgcctccacggccgccgcgtgcatcctcactgccagtcgcctatccggtcgtcgtccgccgctgcacctcgcccgcctagccaccgccgcccctcagctgcacgcccgccgccgcctatcgaccgccccgctacaaaccctgcagagaaaagtagtactagcagagaaggcataaaaggtagagaagaagcagttaaatgaggagagaaaatatagttatgttaattccttgggttatcattttaatatattaattaaaaactacccattaaaaatatatccattaaaatttactcatttcaaaatattatcgcaataaataacaccgttaaaatcaagtcgttcaaaatatatcccttaaaatacaaatgtaagattagttggaagatattactaaaatataggatgatgtaatatggatgatctgttggagctagaagggatatggatgatgaatttttttggatgataatctataagggtattcggaggatctgagctccaggggatgctctaagcaactgggctttactgaaaacagactctgatagcgcgctctccgctttaaagtctttttgcataagtacttgaagcacatggtggcacacaggcttgctgatcctgacttggataaaggacacctttcgatgggcctcaatcgattattccatgccgctgccattactgccttgactaccaggaaaagcagatttaatccatttagtgttttggttgtgagagtgagtgtcggtctggcatgaacaacttgtactatatccaatctactccagctcgaacaatgatgtgcattactgatgtttaatttggtcaattcacactcatgtgagtggatcagcgtatgtgtgttccaatgcaaagttgaagtagctaattgcactggtggatatatcttcgtttggttacctgacgaatactgtattccaaaacaactaacgccaatataaacacgaaaataactgacgaaacaatgaaacatcttggagacaatgagctgcattctgaaactgtgaggtgagcctgagccaggagcatcgatctccagttggtccatgtccaccgccggagagaatcctgagcacgaggcgcgtgtaccacagaaaagcagcgagcttcccgtgctttacacgaagaacgcagctatcacgtatgcataatttgcatatgcgtccaacgagccgcgtcggcgtcgctggcttggcccggtgctcgatcggtcgatgcttcatggctaagatcgaacatgagaacgttcagaaagagcaaaaacgcgttagtatcgactcgtagcacatggcagccacaacccttttgtatgaaagaacactttggcgttcccacacaaaaattttacaccatgtcacatcgaacgtttgaacacatgcatgaaatattaaatatagacttaaaaaataactaattgcacagattgtgactaatttgcgagacaaatcttttaagtctaattgctctatgatttgacaatgtggtgctgcagtaaatatttactaataatggattaattaagcttaataaattcatctcgttgtttactgacggatcatgtaattagttttttattagtgcctaaacatcacatgcgacaccttatataatacccgatatgacacgctaaaactttacaccctggatctaaaaacacccctttgtgttagctgatgcgcacacaataggatgcctgcctgctgcggcagagattctcgaagaatatgtcctgattagttctggtctactggtatgctgtttgcaaaagctaggatggatctgtgtataatgccggtcatttccttgtcccaaactggacggagctgcagtgccagcaaccgacgcccggcctcacgtgaaaaagcagatgttttgtgagttgtgagtttcattcctgtccaaactcttgaccttgcctgacccatctagcagcgagacgcaccaaactgtggttaccaactttactccacagtacctaccatagacaccacagaagcagaggccatcacgcatcactttcttctatcacatctaaagatcagagtctcccggagatctctctatgtccctgaccctcctgagacactctttttacaggccaaaagttccggtactatttgaattttatcaaatttgaaaagccattcaaaatacaaatgtgttattcaaaaaggtgtcggcccccctcagaattttccccgaacctgattatgactgtcagtgcatgagttcaaaaagagtgtcatgtgaaaccgatcaacttctctgtatataaacccttcagtccacggcccaaagcaaagcacacgtacagctacactttgtcactagctaagctagcaagtgcaactgtgcaagccatggcgtcgatgtgttcgaggtcgataccccagctcatcctcctcctctccctgaccgtcttcctcctcgccaatgcgcatcccatggccccgccatcgccgccgcggaaggcggccgcgcctccgacggcggcgaagggggtgaccggcatttcgccggtgctcgtctccacgctgcgcgagacgctggacgcgatcaagaacgtcgcgtccatcatctcgtcgttccccatcggcggcatcctcggtggcggcgacctccgcctctcctccgccatcgccgactgcctcgacctgctcgacctgtcctccgacgagctgtcctggtcgatgtccaccacgtcgtcgtcgtcctaccagcccaccaacgccggcgccgccacgtcgtcccacgtcggcaccggtgacgctcgctccgacctccggtcgtggctgggcggcgcgctgagcaaccaggacacctgcaaggagggcctcgacgacaccggctccgtgctcggctcgctcgtcggcaccgccctccagaccgtcacgtcgctcctcaccgacggcctcggccaggtggccgccggcgaggcctcgatcgcgtggtcgtcgtcccgccgcggcctcgccgagggcggcggcgccccgcactggctgggagcccgggaacgccggctgctgcagatgccgttgggccccggtggcatgccggtggacgccgtggtcgccaaggacgggagcggcaactacacgacggtgagcgcggccgtggacgcggcgccgacggagagcgcgagccggtacgtgatctacgtgaaaaagggcgtgtacaaggagacggtggacatcaagaagaagaagtggaacctgatgctggtcggcgacggcatgggcgtgaccgtcatctccggccaccggaactacgtcgacggctacaccaccttccgcagcgccacagtcggtgagtgcatccacgcctccaaactagcttacaccaacatatcctgttcgatcatgaactagaagttcattacgtatgctaattagttaggttaattaaacttaaacggtttgatcgatcgtaatgtcgtcgcgtgcttattataggagtatagatcaacgagctctcaagtgcatgggtcaatgccatgcatgctagttttagtagctgcattgcacctcgcgttgtacctgtatgcgtgaggcttgggcaagctaagactcatgcctaggattagctcatcatcagaaccacgatgagacggtcgtgtcactgggagtacttacgtaagatggtcaatataccatcattggaactgtgctccgtggggccgtgacaacgtagggtccagtccgtatcttgctctgctgggcgagatacataggagtacaccgtacccaaaaccccaagggcagcagagcacatggcattaaacatggacaagctagcaacgtgccaacatgtttcatgtttggatgtactaccagacttgctatggtagacggaactcggaagcctccgagaagtagtagtagaactgaagaagggtgtactgttcctttcatcttagccgcgtaagtacattcaagtccgaccggtttaccaccttcccagccttaaatacacacatgctgcattaacgcaactccccagtggttgccgtgcaccagcaacgaattcaatgaactagctgagctgagccagcggcgatctgcctgggccgccgggccggctatcccaaactacaaagtcctccttgtttttactactacatgtcaatgccacttgccacatgctgcggtgcatttttcatctggtccggtccacaaaattcgtgcatgtggtgcaccgtgcacggtgtgggatttcgtttaatagtttccctttgcaacgacgaccctatagtggattagtggtacagtgatgttggtgctggtgccgccaggactgacaactgacaagtgacaggagtactatcaagccaaatgcatccattagtactgtagctatgagagtaataaaggtaggagtggacatagatcaccgacacagatgatcttcggctctggtctcaaagctgctgcgtagtactccgtatgctgctaatcttttttacttcgtctcgtcatatccgggtgccatatatgaaaccgcgttgtttcgctgcttgtcagcaacttgtgtgccaaaacaatgatccaactcgtggttccatcagccacctgcaccctcatttacgaggttgttaacaaagtcttgtagtttcaactaaagtagcggtatgatctgcgggcccttgtgttttcctaaacaagtcacgagacctcacctccctgtctcacactctcctgcacggcatgtactcaagcaacagttgcagatcacatgcatgaagtcatcaatccctctgaccattcactcgattcaatcatttgattgcatttttaacagcagtaattaatgatgtcagactgttaattactagtagtgcctgacattgcatgattgcatccacctcctctgcagctgtgaacgggaaggggttcatggcgcgggacgtgacgttcgagaacacggcggggccgtcgaagcaccaggcggtggcgctccggtgcgactccgacctctccgtcttctaccgctgcgggttcgagggctaccaggacacgctgtacgcgcactcgctccgccagttctaccgcgactgccgcgtctccggcaccgtcgacttcgtcttcggcaacgccgccgccgtgttccagaactgcaccctcgccgcgcgcctcccgctccccgaccagaagaactccgtcaccgcgcagggccgcctcgacggcaacatgaccaccggcttcgccttccagttctgcaacgtcaccgccgacgacgacctccagcgcgcgctcgccggcggcggcaaccagagctccgccgcggcggtgacgcagacgtacctcggccggccgtggaagcagtactccagggtggtgttcatgcagtcgtacatcggcgccgtggtgcgccccgaggggtggctggcgtgggacggacagttcgcgctcgacacgctctactacggcgagtacatgaacaccgggcccggcgccggcgtcggcggcagggtcaagtggccggggttccacgtcatgacgagccccgcccaggccggcaacttcaccgtcgctcagttcatcgagggcaacatgtggctgccgccaaccggcgtcaagtacaccgccggcctcacgtcttgatcaccaattcaccatcgagtacgtgcttcttgtgtgcgacagtagtacagcacatgatcatactacactttacactacgttggagggaggtttaattaaggatctggtgtataaaatctttaggaattatggcattctgggagctatttagctgtttaattggtggttaatggaacaagtttgccttttgtttttgttccatgcttctctggtggtggtgctctgtttttggcacaacgaatggttgaaatgtgcatgcacggcgcacaagtaaaaatcacacagaatgtacatgaaacaggcaggtatcagatattcacattggaccgtctcctctcgaaagcatatgtacatggcgcacgcatgcaggtgcccgggtgtctgcacaaatatttttcacgcccacatgccgtacttcaccggcgtgccggtcggcttgatccatggctcggcgtgcaagaagttctgcacggtgaacttggtggcctccttcttgctgatcaccttcttgtaccccggccagctgacgcggccggcggtggcggcgccggcgcccttgttcccgtactccgcgtaccagagcgtcttgagcccgaagtcgccgctccacgggaggtagccggccttgtctacgaaggcggggatgtcggagttcatgatgagcgtgcgcgagtactcgcgccacgggcgtgcgaggtagctgcggacggcggggcgggaggcgtcgccgagcgccgactcggcggcgaagcggtagtgctggagcacgaagccggtggcctcgcggcggtcggcgcggccctgcgccgtggcgatgttctgctggttgtcgagcgggcggcggagcacgatgacgcagttctggaacaccgccgcggcgtcgccgaagatgaagtcgacggtgccggagatgacgcagttgcggtagaactgcgccttggagtgcgcgtagagcgtgtcctggtgcccctccatgcggcagttgaggaagatggacttgtccgactgcaccagcagcgccaccgcctggtgcttcgccgcgcgggccgtgttccggaaacccagcgcgacgcccatgaacccgtcgccctgcgcgtctacgtacatgcacgcgtcagcctgtgcaggccatgtaaatcgatggagaagctagcgtgcaatgcgtgttctggctcttactgaaggtcgccgtcttgtaggtggtgaggccgtcgacgaagttccggttgccggtgatgatggtcttcttggcgccgtcgccgtacatggtcacgttcgccatcttcttggtgatcgtcacgtactcctcgtacaccccttccttcacgtagatcacgtacctgaagaacacgattcatgcccaaagctttggttagtagtactagaattgatgagagatgttgaacattcaggtcgatcgtgcaggcgcattcaccttccggtgtacttcttgggcatggcggcgagcgcgtcgttgatggtcttgaacttgccgctgccgtccttggccacgacgacgttgggcttgagcttgttctggaacttggccttgagcagcctcctctcctgccggttcacccagaccaggacgtcgtcgtcgttccctttgggctgctttggggcgttctcgtcgaaggcgaagctgagaagtcgccggaggctgttcccggacgaacggttcacttcgggctgcttcgtggcgtcctcatcgaaggcgaagctgagaagccgccggaggctgttcccggacgaacggttcacttcgggctgctttgtgacgtcctcatcgaaggcgaagctgagaagccgccggtggctggccgccgaagacgctgggaggtggagcgcggcgaggaacgaggacgccttcccgatgagggccagcgcgttgctcgtcagctccttgccggactccatggcgtccctcatcttgtccttgaggtcgccgtcggggaagccgtcgatgcacgtctcctggtgcgcgatcaccgcgctcagccacacgcggagctggtacccgcccttggtgagcccgtccacgccgccggcgtcgatgcctgcgagagtgcggtcgaggtcgtccttcgcgttctcgtagatctccttgcaatccgcgacggcggccttgacccgcgggtcgtcgctgacgatcacgctcgacttgtcgaacgccttctcgatggcgtcgccgatcacggccacggaggcgcgcacgacgtccttgggcgacgacgacgacgacgacgcgctggcgttcgcggcggccttggcgaggctcttctcgcaggtgtccttgtagtccgtctgcgcgcacatcgccttgatgatcttggacacgccgtgcaggctgggctgcgcgccgccacctgacgctgaaccggaggaggaagaggagccaccatcaccgaagctcgcgttgtaggcgacggccgcgccgcccatgacgatgatgataagaatgaccgacgcggcgccggctgcaaccatgacgcgcctgcgctcttgcctctgcctctcgacatggcggcgctcagtgatcggatcgaagtccgagaaggtcgttgacatggccgacgaccttctcgccctgcctgaagaatgttttcggcgtcgccgccgccgctctctccctccctctgcccttaccacgatcggcaaaggcagagagagaggatcgagcgagagcgagagagtgaggggggagaagagcttgtttattcagaggattcaagggtggagagagattttagggagtcaggttaaatttgggagctggttcgttctcgtttccttgtcatgcaaaggcagcaacgcccgcgcgggagctcctgacgcggctgccgatttctcgcttcattcccagcaaaaacaacgtgactacacgggtgtgtttgcaagagcaagttcccaacactccccacgcgtacgtttttcaaactgctaaatggtacgttttttacaaaaagtttctatataaaagttgttttaaaaaaaatcatattgatccatttttaaataaaaactaacacttaattaatcatacgctaatggattgctccgttttccgtgcataggagatgggttcccagcacccacctccgaacacagccgtacgtgagcactgagcagtttgattccggcgaagtagaccgtttcaagttgtaatgggccgttgagcccgtggtgtgtgtcaactttgtttcctcgttgggcctggtggttcgtttacggcttatctgttgttgccttgttggagacgagatgtgttggcgtgtgcgctttctctcccacctttcggcttttcacggattccaggcctttcgttgaggaggacattgtagatttgtagactgtagtcttccttttttttgttcaaccacgttgaacaagcatggtttgtatcggtataaagtggcaaacacgcgtacttgagccaagaaaaacatgcaattagaccttttccggtggcacaagcacagtgacaaaaacccaagtggcaaccaagatttacaattccgagatggccttccgttttaggttctgacagaatgatggttttcgtgaaatccggtgaaaagccgatagattccgaacaaatttcataaacaaaaatttgaatacaaattccctgagtttaccgataagcttgcgaaaacatgtcggctttggcaaaattccgagcgaaatcatcgaaatttcaatccgtaactagaaaaagaggtaaactaagggtgtgtttgaggagaaggggattgaggagattgagaagatacgcaaaacgaggggagccattagctcatgattaattgagtattaactattttaaatttcaaaaatggactaatatgattttttaaaacaactttcctatataaatcttttacaaaaaatgcatcgtttagtagtttgggaagcgtgcgcgcggataacgaaacaaactcactcactatctcaccctctcaaacgcagcctaaaattgttttcctttttttaattcgctattcttttctttcttactgtaaattttagtaaatacatggaatacatcgtttttttgaaaatttatatcccaataggttctatgaatatcataatatttataagattttatttgattttttgcttttttcttaattcaaatttaaatttggatgaaactcatcgaaatctcatacggtttctactttcgagcctcatcaaaacctcgaaatttcgtggaatttgaccggtttttgtcggaattttgtataccctggtggcaacagtgccattgacagagaattatactcctctctgtgttgatttacgtaattttaaggagtcaggttgattaaagttagtcaaactatggttatatactaaagactactttatacagctataaatattggattttaagatttaattaaacttttaatactttaaatattaatttaatattaaaacaaatttataatctaacaagtttttatatcacgatggtccttgaattaagtataaacatgtatttcagcacatacacatagactcctttcagtagagtatatctctattaattgctctaatgtaatccaacatagtcgttatcggcacatcgagtattaatttctcgagttaaaattccacatccataatttcccgtcacgctacaacacaaatactttccacgctgagtcaaataaataccatattatataaatgttacaagtcatataaaaaaagaaaattgatatgcatacgatctaactgtccgactcacatacgattgaatttaatcaacacatataaaaggatgtagtccatgtaaacatgctctcattggattgatttatggttggatgtttcttgtacatgagcgtatagcagtacttataaaaaaaaaccagcacgtataactataagctgtagccttggacgtactctctctacatggtacgcgcatatctttggacatttcctgtcaagttcctatcgtccagatgatcgatgttccaatgatatatgcagtagcaatcagccaaaatataagtgtagtactgtagtgtaccaaactaatttcttccgttcctttttagggataatgcagaggaatcatttcattttcgtgtagcgaccaactgacgaccgtcgacatgattcctgatttctgcctatcatacttcaatcagaatgatttggttttactccaccgattcgatgtgacatatttttatgttttctagtatttcctccatttcaaaataaattatttttgaagttaaaattttgttctataaatataataagttaatttacatcattttacctacttaggatctataaatcaagaagtatatcattcaaaactctttacgtacctacccaacaatactatttttttaataagcgacactttggttattttctctccctactaaaattgccttagaatacaacatatgcttttatttttggatagcaggagtagtgcaacgtacaagaggatttttcctacaatagaagtagaggatttttattgtaaatctaaaaatttacaatagagcaaactcggtctcggtccttggtctttcagtaaattctaataatctaaaactggaattgcaatatccgaataatttgagtctcggtcatgaccaaaatttcataaagatcccaaaattaacatacaaatcaccaagaaactttagcggatctaaaaaaaatcatatccactatttgatcgttcgctgccatcggccaccgccagcgtggaggcggcatcgcaaattcatcgtcgctaccaccgttggagtggaggatgcaccatgacgacggtgcagcaggacggtggagcgggctcaacggccaggacctctagcggtgcggctatcagcgtaaacggtcagcatgatgcgatatttgtggtgattgcgagaatcgcatgggtatgggtatgtgtgtggtgattgggtgcacggggtctgactgggagtagtagtaggatttgttgccctattgggttattttcggtatattcaatcagttcagttaaccgataatgattatcggcacggcactcacctcatctgcatgagcagagggtaagatgcaggaaggagaaagaaaatgattgaaaaaacggtctcagtctcctgacctttagttttggtctttcggattcggtcaattttacctggcaaaagaagcgagagagttataagagtttgtcctatgatgagtaagccagtaggtgaatgatctacaagactcggggcttgttcactttgctactattttcaaccttaccaagttttggtgttgttaaattttagaagagttaccaaaattttagcaaaattgccaaattttggcaagatttcgtatgtacttaataaaatttaacaacaaactaacatagccaaaattttagcaactttaccaaaaataatagtatggttaaaaattacatcaaagtgaacaggccctagtcggtcttaaaaaaacaacacagccagatggctccatgcaaaccagtgattacaaaatactactactcctaaacactgtttagatctgtcacttgggcacttggcacacatgtgcagacagcagacttgcaaagcttgacctgatcaacctattttaacttttccttgtggaaaaactagctccattaattaacctattcatttttccctctcgtttcgtgtcgagtcgccgtcttgttcccatcacgctatacgcgcccaaaccgtccgttctcccggccatctcgacagcgaccccgcgagtccgcgacaccctcgcggcctcgcctcgtcggacccctgggcgtacgaatcgcgcgcgtgatctcaccccgaatccaccggtccaaggctccccgtccaatctccggcctccgggtcaccgggtggcggccggcgggtggtagctgcgggtcggctcagctcgctgctcgcctcaaggccctcgcctacagcacgggccacggcacgacacgacaggacggctactcgtacttgcttcagcccgggtggaccacatgtcgcgcccggcgcccgcgccgtccgtcgctctccgcccgttcgcgtctctgtctgtccctggcctcccacacgcttcgtcgacgcttcgtctcggcgattcgcggcttcgtgcgctacgggagaaaacggcaaagccgttgccgccgaaacaggacacatgcagctacagagctactgttgctgctgctgctgtgctggtggtggcacagcgcggcgtatcgtgctggtgtattctattgctatcatcacaacggctgtgagtacaaatttcgcggcgatcgagaaggttccacggttgatggtgtgacatgtgcgcgtatgcatgtgtgggttagtgccacatggggagggagggtgacgagagcgagacaggaatactcttgtggtgttttttttttctctgttcttttctcaaaagaagagtttggatgaagattaagatttttatgccatgctttttaaactgctaaacggtacgtttcgtgtgaaaaatttctatataaaagttgctctaaaatatcatattaatctattttttaagtttatatcaatcatacgttaacaccacctcgttttgcgtaaaaaaacttaatcttcatttttatccccatcccaaagataaagatgaagattaaatttttcacagaaaataagatggtattaacgtatgattgattgagttttaattattacaaacttgaaaaatagattaatatgatattttagagcaactttcatataaaaagttttaacacgaaacgcaccgtttagcagtttaaaaaatgtgccataaaaattttaatcttcatcaaacaaactcttgttggagaaaagaacgggccctctatatagcgaaattgttgctgttttcctggagtgtggtttggtttggtgaagtatgcatttgcttcgctgcatgattcgatcgatcgtccatctgcacagcgagatcatcgtggtcggtcttggtggcccacctgaaagcggcactcacggtcacggagaggtaacaccaaacaagctatataacagaatcccgttttaaaacgggatgattctgaataggtatcaggtgtgatacctatcaggtatcagacgattcgacacaacaggatgattccgagtaggtatcaggtatcaaatgattctacacacgtttcaagtgatacttacaagtatcatgctatttctaccacgtattgcgtgatactcgcgaggtatcatgtgaaacctgtcaggtatcagacgatttcaatcacgtatcgcgtgatactcacgaggtatcatgcgatatctgtcatgtatcagacgatttctaccacgtatcgcgtgatactcgcgaggtatcatgtgatacttgtcaagtatcagacgatttctaccatgtatcgcgcgatacttgcgaggtatcggatgatacctaccaagtatcaggtgattcctactagatatagctgggcatcccgttgggggaggagcacctcgacccgcgcggtcggccccctgcagccgtcccttgtagatgaggacggcgacggcggcggcaggggacgggcacgacaacggcggtggtagcgggggacgggcgcggcggcgaaggcggggacgggcgcgacgatggcgggggatagcaatgacggcagtgggggatgggcgtggcggcggcggcggtgtcgatgggggacgagcgcggtggcggcgggggacagcgacggcggcggtgggggatgggtgcggcggcggtggcggcggcgtacggaggcgacgggggacgggcgcggcagtgatgggggacggcgacggcagcgagtgagcagaaatcgcgttgtggaagaggagctattccgttgggggacggtatcccgtcccctagcattccaaaaaaaaaagtcactgggagaaacgatcgaaataggttggatgtatctttaggccttatttttttttctctaataaaaattagataaacttttagattctcgtggcatgcttttcaaaccgctaaacaatgtgtttcgtgtgaaaactttttatatgaaagttgttctaaaatatcagattaatccattttttaaatttataataattaaaactcaattaatcacacattattactatctcgttttacgtgaaacacttaatttttattttcatctttatctttagaagattcaaacaccaccttagtacgtttaagagaaatggatgggtgaagaagagaggagagaaatttaatgtttacttattgcttattgcttattgcccggcagcagagctactatccagatgataccactacatgatgaatcatgtaatagagctcctttactagttaatttttaagcacattgtgaatggcataatgagcgatcgatgatttttttattaattctttttaataagaaatcctttcaaaacttgttttttaagatatgaaccttttggccataccagcccatgctgatccgactggcatggcaacgttatatggccacgccgctctgactagcgtgacaacattattttaccatgccacagtgacagggtaaaactatcacgctcgctacatgtggtatgttagtattgttttgccacgctagactgggctaaaaggttcggattttagaaataggttttggaaatatttattttaaaatttaaaaaaataaaaaggttcaaaaataaaaaatctcggtaggtcccaacagcaatcgtttttattttctttttcagagtacattattatatgcctcaactttatataccggaagtttacatactcgatcaaattcgaattcagattcaaatatttcatacataatatttttatacataaagaagcttataggtacaaagtttataatgtatgtatttctatatataaagcatacacacacgatttttcaattttataagtacagtatttttttctattttctctcttgttcttgaaactatcttttaatggaaaaagtataaaataccccctgaactattattgtcgaccgaattaccctctaaatttgaaaactagatatttttacactctcaactattaaaatctaacaaataattaaccccctaactcaattcggagtaattttggtcctatgtggtatatgcataacagtccagtcaacaattattttttaaaaattagtggtatatgcgtggcagtccggtgagatctctcccctctcccctctacctctctcttctcccggattcctcccgggttccccttgctaaatcacgaggcgggggccgaccgtcgaactcactggctaggcttcctcctcttcctcagcacaacaagcatgccgctctccctccgcttgtgcttacctgtcgcatccttgcgttggagaccaaggaggaggcgtgttggcggttgcctccttgagctcgagctcaaacgctccaacatccttgtgccggaggatgaggaggagatgcacatcgacagccgcctcctcgagcgcgagctttgcagcttccctgcattggaggctgccgaggtcagggaggatggggagaaacggcggagttcggcaacgaagcacgacaatggcggtgaaggagggcgaggtcgagatgctaccagatctattcgcgtggccatcctgttttccctcctccctttttctaacaccccctttcctccaggccaatggttgtagtcctggtagagaaagtggtgacggcgtggagaaggcggcggtcgtctgtgtagcgtgaagggagaaaatgtcattgagggagctcgagacgacgtcgggttcatcgccaccttcgctacttcactgctaccgcagctgcctctgtgcaagcttcggctctgccaccctctccaagtgacgggggtgacggactggtagttggggaggcaatgctgctggcctccggtggttgtcgtcaagcatctcgaggcgctcgatgctggtggacgtcggaggcctgacacgacggtgacctcatggatcctgtctactccctccgtcccataatataagagattttgagtttttgcttacactgtttgaccactcgtcttatccaaaaaatattagaattattatttattttatttgacttactttattatccaaagtactttaagcacaacttttcatttttatatttgtataaaattttttttgaataaaacgagtgatcagacaataaaaaaaaaactcaaaatccataatagggacggagggcgtacgttggcgctgcagctcttttgaatttgatttgaatttttgtaagtgcacgtggaaaggggagtcgggggcagagggaggcacatgcacgctgattagactgactgaaatgaaatgaccctctcgatatatcgtagatacggaatctacagttaaacaaaaaagatactccctccgtcccatataaaatccaaccctaacatctcagtacaaaattagtgaagagtgaaaataattaaaatatctcttattattttaaaaaatagtaatagtgatagatacgtaaaagttattgaaaaaataaaacttatcattttacatgttgagagtacgtagaatggtagaagttgattttttatacgtaaaatttaaactccagatattgacttttttttgaacggagggagtaactaaaaaaagcaaaacaaaagaatacgcttttgtccattgtgcatatcatactgctcggtgaaatttttatttggaaaagagtgaaaaaggggtgcatcgtcatcatattcaccaccacgtttaaggcatcttgttcaattggattcttaacgagtaactaaaaaatgtaaaaaaaaaaaactagaaatcttatgatgtgagaattgagtttatgcccttatcggttggcaatacattattataagcagtaacggcttattagctacttaaaaacaattttaaagtaaaatttttatatatttattgttaactacttaaaaataatgctaaaaaaatagtgttgaaaaatactctgaaataaacttcaaaattaattcataaatttaaattttgacaatgactcatgggaaacgagaagcccttaaagagagtcgaagtgcttgcttgcatgtcccaccatatgcaatccctggtgaatataacatcgtccatgtaaagccatacaaaaccatattacagtttttagtggtagttttcttcatgccagaaaattcttaaatggacattttttgagtttatttacctaaaagaaatgattttgtggtccatgagaagctaccatatatagcttttaatatgttaatttgcggtagctcttgataccttaaggtgctaatatctatgctaaacttgtggtgcctccttatttaaggacatcaaatcctttttttattatcagtttatatcctatctatatctatacattgtatataataatagttacacttcactaagcatttaaaactcaactacgtgcaaccctagtaatcacatctacaattatattacattctaaaatacaagcattctaaaccataattgttcttcacattaatttaacctaaaactatttaccatttctataacatttaaacatatattcatccgtatatttcgcagtaaaacacatgacgtcatcatctaattgccttagtacacaatcctatttaatgggatcatccgatggagaaaataatcaccatatgatctcatgttgtctcggtaaatatcttagagaaaagcaatcgtgtcaagagctacaatcggaatgtcgcaaacgagaaaatgacctataataattacggacgtgcatatatgtgagggcaacaaacaattggtcaaacattgcacaaaataattgaagatggcgctacaacgtaccatgtgtccattatatagtcatgcttatgatcgattttcaaaacggaattgctatatgtcattcgaatgaaatgttatagattttggatcattggatccatgccaagattcgtgcatctgcttctctcctccaactctggcgggctccccttcttctccggtgccggcgacacccctaactccggcagggagcatacgggttagggtttggagttggggtgagggtaggagaggggttgggcgagggggaagagggggggttaatttcctcggggcttcgagggatggccgtgggcagcggaggaccagcggtgggcggtggactttggcgggcggcgaggcggcggcggcaccgccgaagccacggggatggaggagggcagtgggccggcgtcggcggcggggccaaagcaagcgtgcggttaggaggcagcgggcagtggttgcggatccgacggcagggagccgtcggagacagggaagatggcggggtaggggcacctcgccgtcgccgccttgaggagaaagag

SEQ ID NO: 36075 - DNA, 7254 bp, Oryza sativa
attcaaaaacttttgtgaaatatgtaaaactatatatatacatataagtatgtttaacaatgaatcaaatgatagaaaaagaattaataattacttaaattttttgaataagacgaacggtcaaacatatttaaaaaagtcaacggcgtcaaatatttagaaacggagtattatattatagagatcaacaagtatgtgtcaaatcatcttcctcacattattttctcaacattttaactttcatcatttcgataatatttatcatattcatgaatcccgcagcaaagcgtggggcatcacctagtttagagaatgcatgtccgccgaaaaaagatttaaaagcatactgcttgttataaatataaaatgcctacgaaatcatgtgcacaacccattatttcacattttttttactaaatatattcatattttatgacaaaatagagaatattatctttaccatatacgcaggtgaccaaattgccatacgaggtaaaaaagaatataccatatggaataatatgatttggtctttaatctgccagaaaccttatagggtttcaatttaaatagatcaaaggctattacccacaagtcaaggataagttaacccataaaaatggtcgatacatcatcccgtacttgttgtactgccaacttaattaaccccttaatatggtcaaacactaatgcaaggtctgttaaataggttacttgtttgtcacgcccagaaattcacgaaccagaatttctaagctgaatatgtattaaacccctgtccaggaccagccagggtacacaaacgacaattgttgacatacagatccacgtcttacaaaaatataaaggattacaaatgcagcggaaaaggtaaaagcgagctaagcctgaagacttgactcctgcagcgggcgattccattcctcaggcaacccttgacggcagcgacgaaaccaatctcttcaagacatctccaactgagaagaacttcaactctggtgtgtgggaaaagagcaagactgagtactacccactgtaatcagcaagtcataccggaggaggaggtatgatgcaggatataaccaacggaggctacggggttcatttgcataaagcaggcatttaaaaccagtagttgaaaacagaaaaaaacagttgtagtaattaagcaatattaaccagtcactgtccaacgctacgccacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacccacaagacatagccccacgacacgttcccgtgcgccgacatgccaccacgacataccggaaagaggccgtgacaggacccttcgcataaccctctctaacgatcgcaccacaccttagggtccgcccccgtccccagcaggcaacgggcagcccccctttcatgccgcggtgaatccggaagccgatcaaccggacaccccggccgacccaactccatcacgcccaccctcgcctgggtacgtcggttagagaaaagctacactacaagcccagctgttgcccacgctggcttgtggtaagtacaataagttcttccagggcatcccgcgaaccggtccttaatcgccatgggcacgactagcaaaaccatgcacccacagcccaccatgtagtgtattttaattaaccaaccctattgcggtggcactattccaaaactattgctaataatcaaagcctatgctttagtgtgatccccttttgtgcactagttgaactaagcatggctaagcatctcctaaaccaacatctagtcattttaatacccaagttatcaatggcgtaagggaaacaacatatagctgagtaataggaccaatcccacatgatattgtaaaacagtgcaatatttaatagaaatgcgggacatttgtaaattgggtacaatatgatcaattgcaatgtatgacttgccttgctctcgcactgatggaaccacagcaacgtcttcgagaaaccacgaatcgacgaaacgggcgaaatctacgcgacaaacaaagcacacaagcaaaacatgctataagactactgaaacaggaaacaaaaccattttttatggattctatacatttttatgaatttactgagacttgaatggacttaatcggagctcggatgaattagttatgatttttagaagattatctgtgtttttactaataaagaaaaagccttaatgcatttattgcgcaatattgccccagggctgacgtcagcacaaggaggggtggcgctgacacgcgggacccgcgggtcagtgactcaaggagagagaggggcggctggcaagcgggccccaccgagcggcggctcaaggggaggaggagacgcccggtcggctcggctcggcctcaaaccggccgaccggttatggcgagggcggtggcgcgcacgcacggtcgccggcgacggcaaccggaggcgcgggaagcggcggcggatgacggcggcgcgaaggcggcgacacacagccgaagcggcggctcggcccggcacggcgctaggagggagagaaaggggaaaagagggggaggggcgcctcaccgcgagttggccggcgtgggggaaagacgacggcgaacggcgacggcgagcgaccggggaacggcgacgataggcggacgagctccgagacctcatagggaacaagatgggagggattagagggagaggggtggttaacggcgagcggattcgccggtcgaaggcggcgtccatgggggtactcaccggcacgcgaggagaagcaagctccggcggcgagattgaccggggaaacggcggacggggtggcgcacaagcttgcgaacccggcggcgtcgacggcgcggtgcggcgacggctctagcggtggcggagtgcggccggagcttggcggcgagcggcggatggcgggatgagaggcgcgggagcgatggagagctcgggagggctcggccgagaaaggaaaaagagagaggaaggtgcgggcgtgcttaaataggaggggggcggcgagttgtggccgggaacggcgcaattttgccggagtagtggaggaggtggaggaggagagagagagagaggcgggattcaaatttgaatcccggccatctcgcgggcgcggggtgattggagtggggcgtgggcgcggggagggcggggcgcgcgggggagtgggcgacgtggcccggggcgcggagtggggcgcggaaggcgggcggcgatgggtggtggtttcggcggcggttggcgcgggcgtgggcggccggaggttagggaaagggctgacaggtgggccccacctgtcagtgcccgagagggagaaagaggccaggtgaacttcgggagtaggagggaggagcgggccggcgcgggaggaaatgggccggcggcccaagaaaaggaaaaaggagggaaaagaaaagataaaaaggaaaaaggattttcccagggatttaatattgcactttgcttattttaattgattaaaattatttccaaggctctgaaaattccactaaaaatcctgttagtgaattttgacatgtagaactcaagaaaaattccacatgccaattccgattattatttgcatttattaattagggattcatctctaggttaaattaaacaatttcttcggatgatttattttatgaatttagagcaagggaggggaacttcagggcgtgacattgttgaacacaaaatctgagttaatttatcatatttggtttaagctggttattctaaccccaaactgaactcatcttagatctttggtacaaagtggaggcaaatagtataacgacaaatctacaatcatcacaactgataaaggtagtttgagaaataaataaaatgttacagttctttcttttgcttctaaaggtaatactctatccatttctttatatttatcacagttgactggtactgttacaactttaaccactaaaaaaatttaaatgaaatcttaatatttatgtttattatgctatacattttgacaatatgacatctatttaagtatgtagaatttctttttgcaaaaagaaagatggtcaaagtttaaatgtgaatattgcttggtgataaatataagggaacggaggaagtagtatcaagagttagtatttgatgaggacttaattgggtttagatgatatttttatgagagaatctactcaaagacattgagtttgttctaatttaataatttttcattgacattatcttttcctataattaccattattttaaaatgtaccactggggtcggtcttttttttttctaacagacctattacccgtaagatgcaaggctaatatttatctcattagaagtttcaaaataatatatgaattttttatgtagcctccttatacaatatagaaatttgcatataagttccatttttcatttttattttttaaaagttatttttgtgcggtatatgaaattgtttacgcaaaagataatgtcacacaaatattttgtgtacaatataaaagatgatttacattaaaaacaacaactggaaaattctatttatatatatatatatatatagcatctaacaaataaattacattttaaaaaagaaatgcaaaaatcttttatacatatcaccctatgctaatgtttagcctaccaattcatgactaaacattagctctcaaaattagccatgggctaatcttttaaacatggccttattcatgtatgaaagatacacaaaacaattatttgttcatgaaaggaaatgaaaggaaaccatgatcattctagaatgattgaaagaaatccagaaggcatcaaatatgctcatacgctttaaaaagttgtaacaacatcaataaaaagaatgtagaataaatatgttttgacaaaattaatcgattggagctcatgtcctcgagctacatcacctggtgagtggcgactgcaacacaaaattatagtctgcttacgacaatgaagcatacgcaaagatatcctatctaaaccaacgtactgaaatttgtctcctttttataaaaaggattatcaaaatttacttctttaaagggaaaacatcaataaatcgtgacaacgaagtcgatgaaagaaaatcgtgaaagaaaaccacccaagcgtctctttcacacgcctgtgagatgaggtagccggaggcggcaagaaaaaaaaagaagcaaataaccaaaaagccgaggaaaagaacagaaacaaacaacacccaatcaagaaaaatgaaaatgaaaagaaagaagaaaaaacaaaagaattatctgcctgaaaaaagatttgaaaaaacccggagacgcgttggtttaatccatctccccccctccccttttctatccctctcctcgtgaatcctcgcctctccagccgtcccgtgctccgctccactggcgcccttctggaaccctcaccccctcctaaatccaaccaaatttccctcttctcttagcccaaatcacttccccttgttccaaatcccgcttcgatccagcagccgcggtcgggttcgtggcgaggttggagtgctcctgccgaattcgggcggttttgctgggggcaccgagagttgctgccatctgtggtgatctgatccggcggcgcgcggcgggagtggtggtggtctccgttggttctggaagtggtggtaagagctatgtggattgaggcgtcgccggattgagcatgaggggtggggttgctggtggtggtggtggtggtggcgcgccgccggtgtgcgtggcttggatgatggatcaccgagggcggttagtggagctgtttggcgcggtgaagtcgtggatgccgcggcggggagatcactctccgcctccgccgctgccgccgccgccggcgtcgcaggtgggtgctgggggtggtggtggcgcggcatcgccgcagccgcatgatttgtcgagggacttctggatgccggaccagagctgccgcgtgtgctacgactgcgacgcgcagttcaccatcctgaaccggcgccaccactgccgccactgcggccgcgtgttctgtgcccggtgcacggccaactccgtgccgcgcgcgccgggggacgccgcgcgtgaggacggcgagcggatcagggtctgcaattactgcttcaggcgctggctggaggaggaggcggcggctcggagggacgtggcgcagccatcgagcccggtgctgagcccgtcggcgtctgccgtgagcatcgggagcgacaagtccagttcgactgcgcgtagcagcgccgggacgaacggccagatgtcgtcttacacgaatgttagctacactgacttcccatctatggcagtcgagggccagggtgagtgctgcgagagggaaggttgtgcagagaagcagctgcctgcaatggagccggctgggggcgtggagcctgcgacttatgtggacaacacatcggatccatacaattttggcataaataggtatgcctttatgagctttttgctttgctcaataagaaaatgaagcctaactagttgtactgccatctaggaagtaagatcacatatatgcatggttgtctgatattctgataggaacttgcattcagcttctgagaacattgctgcatatcatgttggattttgttaaaaggcattggacaaaaggtagctgctaatttgttcaaaatatttttgttttccttctggatgcttggacttgaaaatccatgtagttgcgctttgatattttatattggagagcttgcccgctgacattgcttttgatacatgcgcacaaatgctatctcaaacttagagtatactcgttgctttcatttggtgttcattatagggtgccatcaaattagtctcaaatctatgccttatggtgctcatttatgtttgttcatggtagtgtaatataagcaattaaaattaagcataggttatgggctggctggtggttagccaacaagtgtgattggaactagttacacgattttgctcttaatcatcagcattgaaacagttgtctggaaggtgcagacgggaaagtatggtcacatgctattttccatttttcaatactccaattgtgtggtactacctccatttcaggttataagactttctagcattg

SEQ ID NO: 36076 - DNA, 17465 bp, Oryza sativa
caatgctagaaagtcttataatatgaaacggaggaagtattttttttttcaattcatagacataaagatttacccagctttatttagtaagcttagtgccttataacttccaactgacaattgtttaactcattatggtgacattctgttttgcttttcctgctgatatcaacatgtttcacactctgtgccaatttttattgtctaattgcatagctgccaatctgttattgctcatctgtgccaaaaaccatgtcaaattgttgcatattctgtagtccttttttttaatgagatgccacaaagttacttgataatcagtaacccagtttttgcactagtttagcattagcacttaatttcatgataattagtaccccagtttttgcactagtttagcattagtacttaatttcatgctttattctctggaaatatcttgcacatgaatcaacaaatgaaaggaagatatgcattattaaggttcaaggagcattattttgacaatccaacacctgttttgtgccaggagtgatgatgaggatgatgattatgcagttttccactcagattcaaaaacacaacacttgcaaaattctgatgagtacttcaaaactgtgtgttttgatgctcatcaagttgattgtagtcatgtaaaagaatctgtttctccgatgcaagatacggaaaattttattggttctgtgggagtagataagactggagatcacatcatggataatactgaggaatgcaatactcgatcttcttccttgtatagcatggaaatgctagaaaatgagcctgtagattttgaaaacaatagctcactctggctgcctcctgaacctgaggatgaagaggacgaccatgatggtgctttatgtgatgaggatgatggggaggatgccacaggagagtggggatatctacgctcaaacagttttggcagcggacattgtcgaagtagagataagtcagctgaggaacacaagagagccatgaaagacattgttgatgggcattttcgggcattggttgctcaacttcttcaggcggaaaaggtacagttggttgataaatctggcaaacagagttggctagatatagttacttctctgtcttgggaagctgcatctattctaaaaccagataccagcaaagggggacggatggaccctggtggctatgtgaaggtgaaatgcttggcttgtggtcgtccaagtgataggtaaacaaatttacccttctgcagattatggtcaaactgttatgattttatatctgtctgctttggagtattcattttccttatagttaaaaaaatatgaatacgacagtgactcagccttttgtaattcaaattcatgatgcaaacttgctggcaattttgttttatcaagttattggcctttgaaatttcacactttattactttttcgtatcttattagtgctccatgtaagagcttcattttggttctttatttccagttttgttgtaaaaggagttgtttgtaagaagaatgttgctcatcggcgcatggcgtcacggaaagaaaagccacgcatcctgatccttggtggtgcacttgaatatcagcgcatatcgaatttgctttcaagttttgatactttactgcagcaggtattgccattaatatctttttatgcatatgttgtaaagccgaagttcattttaagggcggtatagattgaatgttatgttgctattggtgatgcgttgtcatgtcctttttgctccaggaaacagattatttgaaaatggcagttgcaaagatcaaagcccaccaaccaagtgtagtgttggtagagaaatctgtgtctcgatatgctcaggatttattcttggagaaaaacatttcacttgttctgaatatcaaaaggccacttctggaaaggatatcacgttgcactggtgctcatatagttccgtcaattgattacgtgtcatcccaaaagcttgggcattgtgatctattccatgtggagaaatatgttgaagagcatgggactgctggagaaggtggaaagaaaatgctgaagacccttatgttttttgaaggctgcccaaagcccttgggttgtacagtaagtattcagttgctaactcagtatctcagttataacacttaccatttgtcatatgttgcagctcctttgctttatctatttaatccttagtctgtgaagcattcctttaaaccataccgtactttattttttcctccctaaaccctaatatgagtattcagctgaaatataacaatggaaagggggaaaaaacaaatcaatgcatttcaaggatacagtgaaggttgaggttgaatcaaatcaatacattgaaaaataacctgcaagtgatcatgtattaatttctgtgcaatatgatttgttaagaacctattccttcacaaacaactaatatcatttggtattaccctggcgtggatgtttgctccttgaagagtgtagcgcttcacgatcaacgttaatacttactctagtactttacgaaagaattgaataataaaattgaagtcaatttcatgtgctaactattcctaatctgtagatattgctcaaaggagctaatggcgatgagctgaaaaaagtgaagcatgttgtgcaatatggagtctttgcagcctatcacttggctctggaaacatcttttcttgtggatgaaggtgcaacacttccagaactccctcttaagtcaccaattattgttgctttgccagataagccttctagtgccgatagatccatttcaactatacctattttacaaatgcctactgcttcatcaccaaacgatagcttgcaagcatttgatgtgcaaacggatggttcaacatttaatggttttcaaacaatggaccaaacaatggtaatgtgctctcctgagtataaaagctgcaaaaaactgggagctggttctgcccaaaccgaatctgcccatttcaatggccaggataaaaatattgcctgtttgcatggtatggttccttggtcatctactgatcccttggttcagcaatcggccagttcactttgtcattgtccttcttgttctagagatgtagttaataaaaagcattttgaagaacgtcaacctgaaacatctggacataccctggataatgatttcaatgcgttgtctgcacatcgaacaaatttggagtctgttgagagcggtcacttatttgcctataattctgagaatggtgacaagataagagctaaactgtctgttcctctcaatgtgcaaatttctcttgatgatgacagttcaaaggatgattcagtaataaaaaaagatgaaattccggcatctcctgctgacaaccagagtatattggtttctctgtcttcccgttgtgtttggaaagaaactgtttgtcagcggccacaccttctccgcataaagtattatggcaactttgacaagcctttaggaagatttctgcgtgaccagctctttgatcaggttagattgtcattctcgaattcaatttatagaaactttatatactgcttaactttgacattttgtttcagaacaataattgtatctcttgtgagttgccaccggaggcccatgtttattgctatgtccacccgcaaggcagcttaacaatttcagtgaggaaacttgcagtgaagttgcctggtgaacatgatggtaaaatatggatgtggcatagatgcttacgatgtcctcgtgttattgggctccctccagcgactaaaagagtagtgatgtctgatgctgcctggggcttgtcctttggaaaatttctggaacttagcttctcaaatcatgcggcagctagtagggtagccagttgtggccattctcttcacagggattgccttcgtttttacgggtatcccctcactcctcttcaatttcattaaattggtaaatactatggcttacatgtttgtattttagctttggtgaaatggttgcttgcttccgatatgcatcgatcaaggttcattcagtgtatttgccaccaccgaaacttgatttcacttctcagcaccaggaatgggtagagcaagaagcaaatgaggtaggctgtttaattttgtgagcaattatgtgataatttctggttgacgctaattgtctatgattcaggtggttgactcagctgaacttctgttcactgaagtactgaatgcactccaccaaatttcagagggaaggccaattacaggttcttttgatggcaacatgaaaatcctcgagttaagaaggaacatcatggagctggaagagatcctgcaaatagagaaagcagattttacggtaaattattatttttatttatgttttgttatggagccatggctccatttggctctgttcaaaaaaatgacacattattaaagttgtatgctaattattggagcattcacctttaggaatcattgaagaatctactgaacaaggagatcagaaaggggaagccattcattgatattcttgaggttaacaaactaaggaggcagctactgtttctgtgttacctgtgggatcagcggctaatctttatagcaaattcaggtggcaagtactgtgacacactaggaggtttacgggttgggagtaggagttctgactctaacgataaatcagttgataccaatgcaactacaaaactagagaagagctcaaagggctccgaagttctttcaaatgctaaggaaggatccttgaagcagagccaaagtccacttcatgctaatgacaaggagcccaaccaacctgatcaatctaatggaaatagttcaaggattggtgcagggttgaatggcatggaagatgcgattgccaaaatcaatcattctaacagcgcagatgttaaggataacctggatcatcaagaatccagtattggtgttcgtagggttctttctgatggtcagtttccagtaaatgctgatatttcagacacattggatgcaaaatggagaggtgaaaatggaacagttcctgatacaagtatcctgaaaccattagctctgctagaaggttcagctgatcttaaaaaccaagctaaggcagtgccaaccaatgcttctttatctgtcaggtctggagatacagtagaagacttatcaagctggctcaaaatgccatacatgacattctatgactccttaaacacaaattctgggacagcaccgagatttggggccctggctgactacaatcctgtgtacattacattgttccgtgagttatcacagcaaggtggagcaagactttttctgccaactggagctaatgatgttgttattccagtatttgatgatgaaccgaccagtataatttcttatgcacttgtttcacccatgtactgtcaccaaatgttggatgagaacagcaagaacaaagatggtccagattcttcacttccattgcctgtatatgattctggaaattttaatccttttcatttatttgaggatttcggatccgctgatgatcttgcttcgtcaatatctggaaccagagggtcatttgttcccgatctagttcacctaagagttccctttgaggatggtggcccactcgggaaggtgaaatacacagtgacgtgctactatgcgaaaagctttgaagctcttagaaggtcttgctgtccatctgaacttgactttttaagatctatcagtcgatgcaagaaatggggagcacaaggtggcaaaagcaatgtgttttttgcaaaatctctggatgatagatttataataaagcaggtcacaaaaacagaacttgaatcattccttaagtttggactagattattttaaatatttatcagagtctataagcaccggaagccctacatcccttgcaaagattctgggaatctatcaggtatatccctttgaccttctgttttctgttttattgatcactttggttctaagaagaaacttaattcttttgattcaagagaaaaatagctaggggcatttggctatcaagcagagcctcgattttaaatgtagctctgtctgtcactcatgagtagtgacaaatctttgggccacagccaaattgtacagcaggtggaagaaataataaaatgtttctttccatccaagcaacttatgtgatactcatatgttgttaacttacttgtgggttaacttatgtactagttcctattttacagggaaaaagcaaaacctgacttttctagaaaaaaaaaccacatttatgtgatactattcgagttatcagattaaaatagtagcatttgtaggaaatctcactaaagttctatgttttatgtgtctgatattttctggtgtttaggagcacagtttttatttcttatccaattatccactttacaatcatattttaagtttaacatggtacaagttgtaactggaagggatatgtatttattctgtttacatttgcttgtttaagttacattcagctctatttctttatctttaaacatgatcaattgcaaatttcattaaatatatgtaagaactgcgatctatacaggttttggaggtctatttttttcgtacaacttgttaggcgactacctgcaattgcttaatttgatctagtatgtgttccattaaacgctccttcagaaatctcaacccataacccagtatttggaggaagtattgcaactttggaccgatggacctatttttctctctctcagaagctcctggattaatcaagagcaataatccatgatttatatagtcatagcattatgcatgctgtattgatgatagatgctcacatttattggctggaatggccttgctgaagtatctgataggtagattttccactatgaagcttacttatactaaaaggtctatgtttttgcttaggttacaattaagcatgtgaagggtggcaaggagtcaaaaatggatttacttgtgatggaaaatcttttatttggacggaatattacaaggctctatgatctcaagggatcttcgaggtcaaggtataatgctgattccagcagcaacaaggttcttcttgaccagaacttgattgaggcaatgccaacgtcaccaattttcgttgggaacaaggcaaagaggcttctggaaagagctgtttggaatgatacttcctttctggcagtaagttcagattctgatagtgagaattatctcattcatacatgaatccttgagctaagacttaaaaattattcaatattttcaaatcttcacctttaactttggcctcttacagtcactacctaaggtgctctttttttttttttcagtcttcatcttgatttatgtctaaaagttgcttacaatttataagagggtagggaatgttgcacagtttccttaaagatctttatttttcactcacaaaaaaaatctttatttccttgcaaattattcgttttcccttactagtatgaaaataatcaggagaggagccactgcccgggctcagtggcaaaaacaccattaaatttatatgttgttgaatgaatttaatgttcattcaacaataatcttgtgttgttttgtcagacaatatatttaggatttagtgttctcatgcttgaagccttgaagatcatcctgtcttcaggcctgttcactttgatgtcattttcaacattactaaattttggtaaaattgtcaaaaaaagtggctgcatttagtttgctgccaaattttggtaactatataagaaatcctgcaaaaattttggcaacttgccaaaattttggcaactaactatgccaaaatttcggcaatgccaaaatttggtaaggttttttttggcatcaaagtgaacaggcctttcgatgttttggctgtagcacctgaagctaaggtttataagttcctagcagaggcatatagaatgtttttttttttttttcaagaaagaggcatatacaatgttaacttcatacttgccgctgttgtctatttccttaatgtttttcattctcttcaattttggtagggtttatgagacaggctgataagatttattgcaggccagtagcagcattcgatatatcttctcatatgactcattaatgaagtcttgtcctcttgtagggaattgatgtgatggattactcattgcttgtgggagttgacgaggagaaacatgaattggttctgggaataattgattttatgaggcagtatacatgggacaagcacctcgagacatgggtcaaatcgtccggtattctcggcgggccgaagaatgcccctccaactgtgatttcacccatgcagtataagaagcggtttagaaaagctatgtctgcttattttattgtaattccggagcaatggatgcctgcaataatcaatccgagcaaatcatcatcaaatctttgccaagaagatcctcaaaatgcttcacaagagtagtacaatattcagttcattatgccaggcagagagcacctggttttttgtcttgatccaatcaaaagcgccaaacgatcagtctggatgctgcggcatcaatgtggtattacgactgcaattatcaaaatgcttggactctcatttgcacagatccgattgcagtggagtcgtcttggctcaagaatcatcgggtgtatatatccttgaaactgtaattatgcattagtttttttattttctttttgatttattatgtaataatataatgtcgtcgcttctctctagttcccattccattttggttggatgtaaacaatagaagtggggcattttttttttgtaagtgctcgttgtatattattatatatatatgccatgttatttatttgggggggctattgccgtctgtaataacaaaaataagagtagttcatgcaaatgtcctgcgtccaaactcttctggcaggagaatgttgaggtctggaataagaaacagaaactgccataaaagagaggccagaaagctccttctgtgtgcataacagctactgttccgcttatgtgcatatgtttggaaacaatggctatatggcttgcctaatttcgcgctctgaagaataataacttcttttgcaagacaaacgatactgaattggctagactggtcgaatcagaggtttgaagacttcagatatagtattccacaaaaataaggtttggataatttcactatcctccaccgactttatagtacaattatacatgatgggattgaggttgaaagacaatatgaacattttcatgtgtgttaccggaaaagttcatttcaattccacctgcctccatattgattcgaattgaaatttggaagtaagctattcatttttctctagcaaccagtaaccctctcccgatccttctttatgccattagataggccggtagtgccatatattggaaatccatccggttttgggttgatttatttcctccaattatcccatccactttctttctatcaagatttcaatccactttctttctatacatttctctgattcgtgtagtttatactatattaacagcagcttttgtgtttccaaaaaaaaaaaaagtagtattgggttcagcttaaccccatgcctccacacgttaactccgcccctgccgggatagtttgagcaagatggcggcggacggcggcgacggcagcggcggcggcaggaagacgccgtggacgcaggaggaggacgaggcgctgcgtcgcgcggtgcgcgagcaccggcggcagaactgggcggagatcgcgctggcgctgccccggcgcgggcccaagtcgtgccggctgcggtggtgccagcacctgtcgccggagctggacagccgggtcttcaccgccgaggaggacgcgatcatcctcgcgcagcagcgcgtgcacggcaacaagtgggccaccatcgcgcgctgcctccccggccgttacgacaacgccgtcaagacccgggggaactcggcgctccgcaagctgctgcaagtgcaacacgccagcggcgccggctccccgccggccgctgccgccgccgccgccggagacgaccgggacgatgccccagtctgcctccagctgttccccgcgagggccgggggcgtgaaggaggctggcttattcgccggtgagaaggatgtggaggaggaggacgtggcgaccagcctgacgctggggttgccggtgctgtgcgaggcggagctggagctcaggctggggcctgcgtggccggccaccgcgtgaacccgtttcgtggctggccattgcgaccggcgtcgaaccgtgcatctagctagaagtttaaaggtttactatggttcaatttggggacatttgtgcgagtgcaattcatttttaattcccaaagctaggagaaatcccaaaattagctcttccaccgtgccacgtcaactactttctggaaaatgtcaccggatccacctcctgattcggccggggtaaaattctagcgtcgcaccaaggctaaaatgcagcccagtagcccaccaaggccatgtttagtatgggccaaaccatgtcgatcctcccgagagaaggcccggaattttgaactaaataattcggcctatgccaaacaaggccgaagtgaagcctcaggtccattatggaagcccataatctttagtccactcctattacaggccgaaatctaaaaccacaatgggccgaagatgtgggctgccgaaacaggccttacaaactggtatggtaagcccataaatgtaagcccgtacgtggcccacacaacacgtgaagttgggcccaagtcccaaaattccatttgacacaaccaaaacaggccctacgtttctcgctcttccagtctttctcctctttctctctctctcgcaagtctcgattactaccgggaaggccattcccagtgctccgaccgccgcgccaatcaaccgccgtcagccaccggacagccggccgccgccgccgcgcgtcccacttggcccgcatcgcaacgccaccaggggacgcgaccgccgcctccccacccctccggcaacgcccgcccggggccgcggccgcatcagccgcccgccgccggggacgcccatggcgacgacgccggagacgctgcccaactcggaggccgtctcccacgcctacaagttcgcctccacctgggagaaggtcggtttcctcgcttcgctgcgcgtcgggtgggtgtgtgatccagtggtagcactggtggatctgatctgatggacttgggctttcgctgctgcagaacgcgccgctcacggagcagcagaatgccgcgatcgccgcgctctcccgcgccgtgtccgagcggccgttcccggccaacctggtgaggcgccacatctcgggattgtgtgcgatggtttgatccataggccctgttgcttgcgatgactaaatgttgtgatctgatgctaccatggtttggtttagtttagtttgccgtgctatgctcgggatagactagcccgtcaattgtacttgaaggatttgagatatttcattagttgcaacacagcatacatactccatttggtagttcagcggtagcggttagtttggtttataattgacagtacatgagtcaggtgaatttgcagttctgtttcgttggtgatgtttctgtgccactattagctcactctccacaattcaatactctagctagtgctggatttgtgatgatgtttgatgtttcaattgggtatcaaatgggtttataagtgcgttgtttttatggtcttgttatgttatttcattggagggttgctttttttaatttgatagaaggctgtattttgaggtctatttcccttccggctttatattattgcttgacattaaaacatattgctgggtgttacatcaggagaaaagtttagtgaaggatgggggtgtggttgtgccagaaaaagaggctgcattagaggagggtgcaatggatgcagtcttggtgaatacgcatcaggttagtttcataatcttgttgatatatcacttgtatgattgatcagagaatttcggtattctatctattcaaccttaagttgtgtcaggatagaaggtaaactatttctgcaggttgagctaatacctttattacctcctgtagttctacaaatggttttctgaactggaatcagctatgaaatctgaggtttgtgcatgttcatttcttttgttagtgatggcaacttgtggtaaaacaatgattttacccctctagtttatttgacagacggaagaaaagtatcgtctctacgagagtacattagaggaacgtgttaaaacatgtgatggtattcttcaacaagtaggtttatgaacccttttgtttgttaatatttgcaaaatcttttaaggaacatggatgctcttatccttttcaatataacatatttaaaatatgtccattcaggtggatgacacactgaacttatttgaagaactgcaatcgttgcatttgagtgttgccacaaagacaaaaactttgcacgatgcttgcgaccaacttgtatgcacccttttctctaagattctaaatacttgcacttttgctattctttctgttatttttttggcattttgtcagattagttatttatagtgaaacttccactctaaaggactgttactctgccatgtgcacataaaccacttttaagaatgtattcaatattagtgaaacttaacagatcgcctgccttgtattgtgcagctttggtaaatttacaatatggcattttaggtgcccaaaggaaaaactcattggcctgtttgtcatcttggacctcatgttaatgatcttattagtgatatattttgtatagctcttatctactcttttagtttgaacagaattacaaaattctttgatgcagtttcaacacatatagatttaacattacaaaactgttgcattaataaaaacaaatcattctagtaatcttttgtttgtaggaactgtattatgatctacaagcatgcttcatttcatatacccctgtttgagataattttttgaccagattattgctaaggattatctactttaaaagcagggaaaaaggaaatattttgagaaataaacttaacaaacagcttagaacaagtgatctaagcaatgcagtagttttttttttggaaaacgtatttttcgaagcatgaagcaaataatccgtttcaacaatctggtgaataatctgaaaagaacagggcctaaatgaacacatgagttaccttttaactacccttttttgtgtagtattctcttagtttattcatgtcgtaaatgcaaatatatattctcattttgccatattgctggtccctcttccgtttttttaatgaagtgtttcagtcaatggactatcatttctaaattcgaatgtaatgcagttgttggagaaacaaaggctgattgagtttgcagaagcacttcgaagtaggttgaactactttgatgaattggaaaatgtaaggtttggcatccctagtttgtctattgagcattagattaataaatttgattaaattaatgcctctcctacaagttctacatctcacacaagcataatgaattctgccatacatctactttgaaatttaattgttgaacttatgtgaaaccttattcaaaatttccaacgttatctactacatcctaatgcttgcatccttgatcattttgttagttggagaggtcagcatggtctccgtggttcatttgttccagaaaatgtttattccatgtttcggaggatatatactttagatttgatcccaatggatgtcttagatctgaattttgagctgattcgtattgtcaccttgtggttagtgctaacttgtacatgatgatgagtggcttgtatttttgaagatcccactgtttgctactgttctagtatattctgtagctgcataatcttgaacatttctggccactaaccacacttattcaattctaccatccaagtacacaatgtatcctgatgatctcattcatacattatctgtaatgttgattacacaatctgttttttttaaaatcctattttttctctggttaacctgcttcatatggtttaaaatactgtctccattttgcaggtctctactagcttttattctcaaactatgaacatcggaaatgaacaatttcttccacttttgaaacggctcgatgattgtatttcgtaagtagtaatagacaatgctctgtgtgtagttttagggtgctgagatttaaggagttcatgctgtatcctgtttgggtgcttataggtatgttgaaaataatccacaatatgctgaatctgcggtgtacttggttaagtttcgccaacttcaggtaaaggtctacttgaattgaactacatggatagtcatcacaggttagatactttgacctgataattatatgcttcttttattgcagtctcgtgcattaggtatgattcggtcacatgtcctgtcaatacttaaagccgcttcatcccaggtgattttcagttgaactttggtaggtaaatgcgatatgactactaaataccagataatagcttgattttatttcaggttcaagcggcgattcgaggtaatggttcagcaaaaaatgttgttacagagggtgtggaagcatcccttatctatgttcgcttcaaggcagctgctagtgaggtataccttttcatcaaatgatctacagttatatagaaaggcttaaacaaactgtagctatgtgatctatataccagtaacacctcaaagttataactctgctgcctctggttcttgttttccagcttaaaccaatcttaggtgagattgaaagtagatcttctaggaaagaatacacgcagattctttcagaatgtcacagcttgttctgcgaacagaggttatacttggtaagatcaaacaattattggttttatattttccttttttggcatggacctgattatttcttatcacttgttatgcaactaaagatacgaggcatggtgcagcaacgaatttctgaatttgctagaaaagaagctttgccttctctaacaagatctggatgtgcctatctgatggaggtaactgcatgtttaatactttctagttttcttattttcatctgtgttgtaggtttctctttccatattcagaaagttacatcttacagttgtacacgatagcattctgtaatgtagaagaattgagcaacacattgtatatttagtttcctaatattacgtgctctgcttactcctcatgctgagtatgatgcacttatcattattatttttggcatatttattctaaagcattgaaagttcttgatttttagttttatacaactgaaagtctcggggttcacttattagtatctcaaggtcacccaattcctcattttaccatttccatccttttgaggccaatagaagttagttatgatggcttcccctcaacctgggactttcaatgtcataaaactgaattctgagcctttgacggcacataaccaattttatctaatctccagtattcatgcttttatttttctctcctcttataatattcagctgattttgactgcaagacatattttactacttttcctgttgcttctcaggcatgccaatttgagcaccagctttttgctcactttttcccggcatctgcatcagatgtttcaagtattgctcctttaatggacccactgtaagcttttagtccctctggttcttatactgcaatgtaagcatctgtaatttgttctgcaaattcgctaaaacctgactttagacttgcataagtttttttattagctaaccaacaatcaaggaataggctttagaataaataggattttcaggaactagaaattatctggatcttaatataagaccccccaaaaattcctcaggcctataccagcttcctattagtgggctagtcaagtataaatgtgtaatcgaaccttaaattcctatgttaagatgagtttacagaagatttcatcaacttaagaaatagatagaagttcctttcctaaacaagagagatgattattgaagttctgtcatacaaaaagtttagaacctatagatatgttgacattgtaaatatattttcttgttaaaacatatggaacacagattatttggttagtttctgcaacacccttgttgtatgattcaaatttatattgacgtgtgtattgtgtagcgttcatacttttatgttatcaacttttcatctaaggtgattaactgaatatctgatatgcctttgtattcaggtgcacgtacttgtatgatactctgaggcctagactgatttatgagggaagcattgattctctgtgtgaactcgttgacattctgaaggtcgaagtgctaggggaacaactaagtagacgaggagaatcagtagctgggcttcgacccatattgcaaaggatacttgcagacgttcatgagcggttggccttttgtgctcggactcatattcgtgaggaggtactatttaaaatatgccccttattggtgacttcatgtttttttttcagtcagcatgttctcgtttgagtacgtggtgcatatttcgttcatttgttcgcaaataatgtatggttccaatgttgagaacagctgtcatgtggacttatgtcaagtttgttgtagaaccggcaatgcttttggggaaaacttgatggttaaatggcacttaaaataatatattagttatttgaagtgcttgacgttcttcactggtgatctgaatgagattcttttatgagcattgctggatgttgcatgccaattacaagggaaatggttgattattgtgtcatttgaagtttttgatagtgaacatattgttagcaatgtctgcagaactagaatgaactagccatgaattgaaaactgaacttgaagatcccctgacttttagttattatttagacaatcttgagctcaggaatgaaggagacttttcttatatattgtttaatctatttcatctttttttttttgttaattttgttttcttactattgttcagattgcaaacttccgcccttctgatgaagatctggattatcctggaaagcttgagagatccgtagatgcaactacaagttctaatgttagttttgttcttagtttaatgaaagttcatttcaatttaactcttcatggtcctagtcattcaataaaaatctgtcctaacagttggttcacacacagttttactggctcagatgtgtgcttaagatggtactatcagttttatagattttgtaatttcttcactcccttatgtgctaacatcatttttctccatgctgtcatctgatgttaaacaaagcacatgttgcttataactgaatccagttttaatcacgagcattatgaattatcagtgtagttaaagcatta

SEQ ID NO: 36077 - DNA, 709 bp, Oryza sativa
atatacagagagctaatttatatgtgcttagttatatttttattatataatggaattagattaattccggcgtttgcttcaacacaatctacagccaattattacaaagaacgaaacacataagactgcggataacaatttgatatatgtcaggattccaaaaccaaaagaccatacaggtagttgtattagctcagtagttgttccttctttgtgtaggtgtgtggttttgatcttctaaggtgtgatttgggggaggcaaggtcttatgtatgtgatgtcaatggctggagttttgtgaaaagctcacacaagtaaatctttctcactctgttggaacaattactgtaacagtttaatgcatttgtagttttctatggtcaaattcctcgttatatcttgtttatttggtgaatgccttcataactccaggtactacgatgatgctgcatgcattctgaggaaaatgtttctcgatgataaagctccacatatttcatccaccattcctgctaatcttccatggaaagtcagtgagccagtccaaccatttgatgctgtaagagatcgagaaaggggaactgttggcatatctaggcaatcagaagagctgcgctgtgtcatagctgttatacgccagtaaggataatcttatgatctctaaatgtatcatcatcaaacttgtttttgacactacaaaaaatgatat

SEQ ID NO: 36078 - DNA, 622 bp, Oryza sativa
gagttgttgcccaagttctcattatataatctaacatttgattattatgtgcataattttacgtgaatgtcattcatccatatgccaatgctaactttacctttgttgcagatgtttgtgatgaggatcaatttgagtgtctagactccatgggttatcccatgccatcaataagtatggccaacggtgaatcggtgcttgtaaattaatctgcagatctttcctacataatatgagcacaacattagctaccctctgatggttgtgtatctataaccagatggcatggttttggtcaacacttttgaagagacttttggcgacttgtatgatgaaggtgtctggagtgagctcagcaaaaatgtttcttcaagaatatctcgaaatgttgtctcgcttgcttcattcaatggtaagtttacatttgctattcactttcatatttgtatttgtttcactaataatcaaaattacggtatatgcaggagaaacaagatattttgcatgcacaggtttttttattgaatggaacggatgtacatctattctgacttcagcgagcttagttagaaaatctggcgatcgtagcaagattgttgaaaatttgagggtagctaacgtt

SEQ ID NO: 36079 - DNA, 686 bp, Oryza sativa
ctcagtatttgacactttgatggatatttaacccgtttatgttctttagttaccattctgtgtagatatatagtaacacttgttgtataatttgtatctaacacttgttgtataatttgtatctttcttgaaggtgcgctatcctgttttactaacccctactgagaaacaaattgcaaggaatatttgccaagccttcggacaagcggtacagaattcttttagttattatttaattcctactatgtcggaagcttacactatttcagaacttaggatgtatcttatattgtgtatttatgggctgtcacctgtcaataccactagacataatggatacagttagtgaaaccatcatcgtgttaagtcatctacagcatataagtagaatttgtttccttcaagattaattagcacaaggtcaagtagtgtggaagatcaagaaggtattgagcatccaactccatagtgatctctgttgcttggattctgtggaacgagaattttcaataggatcaatgctgcagtggttcaagtttggttgatcaaggagtgcatgaaatggcaccttgctggagcaaaatgcttttaagagcttatatatgtagcttaaattttcctttgttggtcattcttgaccttattctgctggcgcatctgtactaaatgagttccttgattttctt

SEQ ID NO: 36080 - DNA, 3475 bp, Oryza sativa
tgctaacaaagaggaaaaaaatttctaacttcaggtctggccgtgaaagtgatagtgatgctgaaattgagcatgcagagaagctacgccaagttagagcagttctagaagaggtaaaatagtgttcaagtattaatagggctatatgtttggcatggcacctaggatgaatatacaagcataagaatggtagttgtacataaaccttgaagagccatgcacaccaactgggttaaccctgtaaaatgaagtgaggattaaagcctaaagtgttggttttggttggacgtactttggagtggcacgaaaaggtgttcactggtgcctggtatttaggtcagctaatttctactacaacgatagcagcatgcttcttgtgatcttgtcagtgcataatgaaagcattcccttcatgttgataactgtatatttcccgtggatctccatcatgcttattgttgttctacctgttcttcaaaaatcatttttccatctataaatgttaaaaaaaacataaaattgttaacagtttgtatatacataaatagcttatgtggttcagcagttactgtttacatatctatggagctccatgcctccattgcagagttcttgtagattttcgtgaagtataatcaaataccacatcactatttacaaaatgttttctgtttaattaaatactacatataagattgtttatttatgtacttgttcttgctgagacaattgtgttgcatgaatagaaatgcgatacaaaggcgctgtctagacatttccttttgtttactgccatatataatctgcatttgtcctcattgtcaattttagttgcaaatacaatagattcttaggcattaagtattagtttccctatggcctgtagggtggacatttttcaggtatttataggaaagtgcagttaaagccatccaattgggtccatattcctaaaagtaacggcaacgggaaggaggagtatccaattgaagcactgatggttctcaagtacggtggagttctaactcatgctgggagaaagcaggttgctttcatttcacctattgaagattttattatctgtcattattataatgagcactgcgttgccaatgaagctcatttagtttgatgtcggtatgattttttggggtttatggatattttatgttaattcaacaatctccaatttcaatgtccaaatattcaacttattagtactatggacataatctaagtaaacatgattaatgatcagtctgttcatttcatttaagttcttatcgtgtcccccctttgtgtctctcagatgcttttgtttgatcatgcaggcagaagagttgggaagatacttcagaaataatatgtatccaagtatgccttatcctaaacttttccgcttcccgtttagaactttctatgtgtggcatcaagctgtgggtctccaacgtgatattttgctgaaactctggttttaactaaattattgtatgaactgcatcactaaacaccacaatagtctaatccatttcagaccttcggtgaagtcttcactaaatgtttatattcagtttcactgtgccactttgggtaccaatttgaaataaaaaacttaactaaacaaaataatcgtagtgaatttttcaataaaatgtaacttggtcaggttcagctatttcagttcagttggtttactgaaatggtatctcaatctttacttttagtgaaattactccagcaatcatttcacaaaatggtttattatccttcacgttgatattttgtgccctacttatgtcctttctttcctttccctttgttaatttggctgccatttctgtctagatgtcagttagatagcctcccattctttagatagcctcccattcttttctctaactgtctgaaaacagcaccatttatttggcttttgtgtctcatgtactattttggtgtgacttcggtttatttaggtgaaggaccaggattgcttcgtctgcacagtacatataggcatgatctgaaaatatacagttcagatgaaggtcgtgtccaggtaaatggcagtatttcttcttacaggcttgggttattgaatgtaaaagaaaatgaaaaccagccattttttgggtacatcatgtccatatcagggttaggattttagagtcgggactcaggattgaaccgcctgctctgttcctctgaaaaccagccattttttggcagctatctgaaaaactggtcttttcacatgattacacatgatttgatgcatcacaccttcaagtgggcaaaaacccagtattaagcagaactggtagcagatttctggaccctggtccatataatcaatagtaacgtaatgtaataacttattcttcttcgtagtaattctctaactaccagaaactatttagttccattctggattcactgaaatgtttatgttttttgtacatttatgccttctgtgacatgccattaaattttttaggcaagggatatttcattaagtaatggaattacatcaggcagggatgcacacagacaacagagaaaataaaggagaaaatccaaagacaacatgaacataatgacatgccatcaaataattttgcatttaatatgtaaaaaaagtaatgattgctggggtttcctgaccttacatcctatgtcattttcttgtactgggtaacggtcctaacggatggttgcttacattttttttcttgttgttacctaatagatgtctgcagcagcttttgcgaaaggtcttcttgatttggagggggagttaactccaattctggtttgttcctattacggaaatatatccagttgaagacttgacagagctgcaattcattggatttactgtctccaggtttcacttgtcagtaaggactcttctatgcttgatggacttcaggatggctctattgagatagatgaagcgaaggtcgccttcagataccaatgccataactcatacttatgaaaaaaaatatttgtttgaaacttcaaaagtttctgtcataaaatgtcagatctctgcaggctcgtttgcacaatattatcctttcttcaaaaattgcaaatggtgagactatggagttcccatggatggttgatggagctggagtgcctccaaatgctgctaaccttctcacaaatttggtatatgcattagatgtatttatttcctttcccctttgctttctataccgtatacttgtgagttgtttctgcagaaacttgcacatctaaaacaaccaaacgttaagataattacatctataatggtgacaaataagttgcccttatctcaactgtccaatcaggctcaattgaccaaggaaataactgcacaagtgaagctgctttctgacaatgaagatgaagaggctgtgacagatagtgactcaccaagtcatccttatgatcaagcaaaggcactagggaaaacagcaattga

SEQ ID NO: 36081 - DNA, 6374 bp, Oryza sativa
ttcctgcagccctatgtcctgtagcggcactgttcacgtgaccctatctaactttgtcagttcgacatgttcctgctgattcctgactgttcacgtgaccctatctaactttgtcagttcgacatgttcctgctgattcctgtagccgtacttttttatatttttttagaccaactacccagttcgacagatggctgtcgaaccacggttgttcgacagggtgctaaacatgcgatttcgcctaatcgacctatatttttacaatttttcattaaaatcgtattatttccaaaaaaattcgtgtttaaaatactttgaataataaagtaagtcaaaaaaaataaataataattccaaacatttttaaataagacgagtcatcaaagcaaacaaaaactcaaaatcccttatattatgggacggagggaatactttgaaaactatatagtatcgttttttttttcattccatgtttgcattagcttcatttcggttgtaatcccagagtttggccaccgttattttaagactagccactggaattttagattggaaaagaacaccggtccattttgcaactattgtgaagtttgccggtttaaagtgaaaatctgcaaactagataaaaatttgttcccaatatgcaatttactcttattataatctttcagaaagactggtagaatgctggcaagtgcttaaacagccggtttcaaagtctttccaacatcttgatcaatagttgacaagagtaatgctatctgaattctgaaggaatgctcacacttgtataagaatgaacatacagcagtatcttctcaaaaaggaacaatacaacagtatcctcatttgcggcttaaatagcatcgcaaattcgactgctgttcatacaagaacctcattggacaaggcaaaaacgagcacatacatttggctcgcaaaatgccacataattggctctggaaaccgagaagataaagcacttcccttcagaacatgtgtgcttctgattgcgcagatacggatgagctctgaagtctgaactgataagccctgcagctagtagtagtgaatggcagctacctcagccgtgcttgcactttgggcaaaatggaatgcacttttattgagagcatttgttgctggatgattctgttgaactcagatcatgaacgcagacagaaggcatacgcaaatccaaacatgctcagataaggaagctggcaggtgcatccacaattttgtgagaatcagctccgagaggttcgtctagctgcttttagtgctgcacctgaaaacttgctcccatctgaacgtctgacggcgcttttcatgggtttatattcgaatgtgctaatatcaggagggctgtccgcagtgcacatagctttgcgcgtgttttcactctgatcaaaacggctggtggtagatcttgttggtgcataagcaaatgttctcaggtcaggaggtccagcagcagcatctgtagctttgcttgtgatcttcccctgatcagaatgagcagaagcaacttatgatgtttctcatgtccttttcttcagattgcacgccgtttgttgggcaagattctgattgacctgcataacaccagacgagaggttgctgctgctggtggtgaatctaatgcatgccatgatccaacaatagtgccttcttcaaaacggaaggataggggttactatggggatgttaagaatgagggttttgatagacctaactcaaacaagaagtcaattgatcttgatgattcgcacaaagaaaccaaatactgcttggatccaaagtaagtacgaaattccagttaggaatcttgactatgaagaatacaattgatattcaaataattttgttgtagatatgccaatgtgatggaacctgaacgacgtgttcgaacaaggctctattttacatcagtaagacaaattacattgagttttcatattccccttgcaaattgttaagtttatgctttcttgatttatggtaatatatcaatataactatagaagtatacagaaatttcaaaaaaaaaaaaccctaaaaactaaggctctaaaaagcatacatcatcatggaaacgacaatttcctatatgacatttctttggagtttttttttaactgaaattctttgtttttgttttcttctccctgataagaatgactaaggattattttgttgtcaggaatcacatatacattctctaatgaatgtacttcgatactgcaattttgatgaatctatggatggagaagaaagtcttgtttgcaaaaatgctctagataatctgtttaaaacaagggaacttgactacatgagttacattgtattgcgtatgttcgagaatacagaggtattaaaaaattatagtgtaatcataagcttttactttactaatactaccggtgagaagtgatattgatcttgtcattggacaactattgcaggtttctttggaagacccaaaaaggtttcgcatagaaatgacatatagtcgtggtgcagatataagttccttacaggtgagtttggtccccttcaaatgaaatgtaagatgtttgttttcaacatttctggttattaactcaacagttcttgaaaaatgtatccatacagagcgaacatggaaaagattcattgctacctgatgatcacactatgaaaattatggagccagaaagattgcaggaagttggatcatatctcaccttggacaaatttgataaaatggttcgtccatttgcaatgccagctgaagatttccccccagctgccccttctcaatctttggcagtccgtttctgcaaggataatggattgcaaggcgcaagattggtaccctatcctgttctttatcatagaatgattctgcccttctattttagagaaaatagcatctaatacttccaatgttttgtcagtgccaaaaaataccaccaaaacattcttctccaatcttataccacagagtgagcctgaaggtttaagaaatgtcacaacattgtatgaaccagctaagagaggggatcaatgctggaactatcgtcactgcacgagtatataacgctaatgaattaaaaattgactagtgccaatggatactccattaatcagatagcgttatgaggctgtctgcttctgcaatcaatcagaaatcattagaagactgcttacgtctgggaacaatcagcttaactagtcatattgacacaatgctatgaataatcatcaacaaaccagtcagatgtcactgtacagccttttcctctttgtatacatgattgatttggctatatctttttaacctttggcgataatgacctaaaatttcttattttattacctcctcctgttatattaactacatattttcctttttgaaatttgacagcaagataagtcagacatggtgagtggtatgccaaaaaggaagacaaaaaagcttcaagaatagcatgttcaacacgcaggccagcaagataagtcagacatggtttgatatttctgttaacaaaagtctcaggtaaatggtttaccaatagaatgttgataaagcacttgccttgaagagaggttaatagtgagtctgcaaaatgctgcatgagtgccaagcactgaagatcatgcagctggaacaattttgtcagttctgagaatgtaacctgatagagctgttttgcagacagtgtaattgcgtaaataataggttacacgtgtatctggataaaattttccgtatatatacaaggtggtcatattatgtgcctttaaaattatagtgtttccgtcttcagaataatttcactagaaaattctgctactttaggcgtttgctaagagcgttatttttagagctttacaggttggagcgttttaatcgaacatgtttaacaaaaagtactcgctgaacattcccggaataataccttgtatatttgtgacatgccagtgtgatatattcgatttacttttgctctatttttactggtatagactgatgtgatacgaagcacaactcccagattccttttttttcacctctttgatcagacggttcttctgccttttatgaaacggtgtcaaatattgaatcgatcaaaacacttttgatctttttttttttgctaaatctttttcaaatgttttcaaagtagccacgaataatagtcgaatgcacttgaatagaaattttgagaagatggtaaggcactgtcaatattaacaatctaacatacataaattctcatgttttgatgataacttccacaatacatgctgaatacaagaaacacctacccatctgaaggtaccttcacacactaaaaaatacccatagcttactcacctaaagaccctagcagtgtacaagaacaaacctgaatggttgtctcacctcctccctaaagaaggctggttattagaagttcagaacagatcatcgtaggcgactatttctctagctttgtaggttccttctggagccgctttcgtgctcgagaacgctgaagattcgcttgcattcctcttcgtcgcatcatgcgtattctcccccactgggttggcttgagctgtacttctcaagtcattcggcgcctcgcttgcctgtacaactaaaacctgcaacccatgaaagaaccagcaatctgagtatcgaagagcaagagtaccaaatggctcaaaacatgtgtagcatgctatagcttcccctgaatctgttagaaattttgttctgtttattttgtgcctgctgcacaaccaaagtgcagatgcatttcgactaaaataaagtgcaaaataagtttattgtttattttttctaaactaaatctgtattctacttggttttaaacgaccgttaacatgaacaaattgtgacagcgaagataccagcacagtctggatgtaaacaagatcaatattgaatataatttactatcttatagacttgtaccagataaaatggttgactgtaaccttggactgaatttaaggtagccagttcatcacggaattgagtaggttttgtagagcccagcaaatgtgtaagttaattgaataactagcacattaattaaatccaaaatgctagaatgaaacagcaaatgcagagtataaaatgagatgaaaaataattaaaaaaagcattcttttcctctcacggatttttgattattgcgggcgcacttcccaaactcccaaacggtatgatttttgcataaactttcttcatcggcatttcttagagaactttttaaagtcaacctttcaactttctaatactaaattctctcgtctgtgccctcaaataattttcataaactctgtttgatccataatccatcatccatcagaactttaaagtcgagataaaaggccggatgtgatgccaatctataaaattctcaaatctagcagcgccttcaaacaattctcagcaaagcttgaccctgtacaggctgtactgcattcctctacacgcacagcaagttgaaatcgagctcatccaactgcagcacgcagatctccttaccttcttggatccgacggtgacgccaccgtcggggtcgagggaggcagcaatggcggccatggcggccgcggcggagcggaaggtgacgtacccggtggccgaggcggcgtctatgcgggtgcgcgcgatggggccgtacgccccgagccgcgacttgagctccatcacgccgcacccgggcggcagccccgcgaccatcactagcaacggctccgaagccgccgccgccgccgccgatggagcctgtaccggcgccggaggagcctccagctcgtcggcctctaactccggcgggccagggccgtggccgtggccgcggccgcggcggcggcgcttcgccggagggtcggggctcgcgcgcccgcgcttgcctctgcggtgacgggtcatgatgatgtccaccgaagtgtactccctggccgggatagtaggggaatctgcacggctgattgcgcggagattcgtgcagtatcttcaattgttatatggagtatatttcaatggataagtaagaaattgaatattaattactccctccgtcccataatataagggattttgagcttttgcttacgaccacctgtcttattaaaaaaatttatgcaaatataaaaaacgaaaagttgtgcttaaaggaaattttttttgaaaataatacgattttaatgaaaaatcgcaaaaatatagatcggttaggcgaaatcgcatgtttagcaccctgtcgaacaaccgtggttcgacagaggtatctgtcgaacaaccgtagttcgacagccacctgtagccgcaacctgtcgaactttgaaagttcgatatgtcctgt

SEQ ID NO: 36082 - DNA, 8332 bp, Oryza sativa
agagcatttgttgctggatgattctgttgaactcagatcatgaacgcagacagaaggcatacgcaaatccaaacatgctcagataaggaagctggcaggtgcatccacaattttgtgagaatcagctccgagaggttcgtctagctgcttttagtgctgcacctgaaaacttgctcccatctgaacgtctgacggcgcttttcatgggtttatattcgaatgtgctaatatcaggagggctgtccgcagtgcacatagctttgcgcgtgttttcactctgatcaaaacggctggtggtagatcttgttggtgcataagcaaatgttctcaggtcaggaggtccagcagcagcatctgtagctttgcttgtgatcttcccctgatcagaatgagcagaagcagttgtaggcctgtatgcaaatgtgctcagatcaggaacgtcagtgctgtttgtagcatcacttgagaatctgctttgtagaggcactctagtagtcttcttagccgtacaaccgaatctctgttctggaggtctgagaacagatctgcaattaatgttataaaatatatcaactcattgggacaactgtgtccccctcttaagttctgataagtaaattgtgtgaacttggtgcaattgaaattttctgaagctgcagacctgacaggaagagtgttcttcacatcctttaaaggagcgcgaagaccactggcacgagagcctgcgtatctgaaagatgatatcagcgcagcaaaattatccattgatttctttgcaatgccactgtatttatttacatgggcgacattgcatccaaattttccttcagaatttgtgttgataccgtcgtgggaatcagagtcacagcctgcattagtatcagacattcagaagatttccctcagcaacaaaaaaaaagggaactacgcacactcaaacattggcagaaccttctgttgtttttggaaaaactgaatttcttgtaatcgtcacaagtttatctatagagaaatggaacaaggaaaggtgcacattctcacagagaataagaacagacaactaggtggaactattacctttatcagcaaccggtggactttcatgaggactagtgggttgaaacattccctgcacaaatagtacattcaagaccagatagtagaatgatacagacagttcactgcgatatgatgatagaataacaactcaaaaaaaaattgcttacatcttcaaaattttggggatcactaaattttcttctcttcaatatacctccagagcttctttgttgatctccaggaagagtgtaattaccagtctcgcagttatcttcatcatggcactcatcttctccttgatttgtgcaaactcttttatttactgttttgaaatatgaactcctcacagtaatatttctattggcagagaccacattgcttttttcagcataacgtggtgcagctctggatggctctgtgttgtgtgaatctaaaaatggatctgatatcccaggcaaagtccctagaaaacgaaaataaatgcatacaaaacagaaaccaagattattttcattttaattagatataccagtacatgatttgcagatcaagtcatgcatcaactacaaaaaggtagagctcttaccctctaagaaagagcctgtcggtattgtacttctgttgcagaagttgactttcacctgtatagcagaagtaaaactataagaatgacggaaatacgatattgttgtagaaaggtaggactacgagaacactgaaaataaggcaataaagaaacgtgaaataccttgttgccttcaatgtctgggtcctcagcaggatcactaccaatatcatgagaacactggggtgaaacactggctgaatcatcccgagggatgtcacagcggacacgctcagaactacattgagaggcggtattgattgaatcatctagaggggttcctgagctaaaatgctcagaactacactgataaacttgaatgttatttgatggcaagctagtatcttcaattaaatcaggggtaccagagtcttcaattctgggactgggcaaagacccattaagtacttgttgcttaggtgtaaccttaggtgctctgaacttccgttttgcctcaagcgatgctaagccttctaaaagtcaaggattcatccaatggacagttgaagtattgtttacaaaacaagcaaaataccatgctaagaatcgcacatcaccttagacttcgtaaataagtttatggggaaattattagttcttcatttgatcctaaacatgtttgggaacgagaaagcacaataactgaactatcttatccaaggcattcccataatataagctgcaacaagtagttcatataataaagttgattggtatatatattgttctctcaattaaattaaaatgtgttgagaggatacagaagtaatttgtcaatacgtttctttggacaggtagatcaagctttttctttccatttgaaggagcactggactctctgttcagatgcactttatcaaaagcgagtgcgctactctctgttttgccctgcaagtcacatatacaaataaaacatatataacttcttagtaagacaatccacaaaagataaaattgaatgttggtattcgcatgtcagcaaagcaaatgcttgcatactggtgatctttaataaaacagagtacatcagtaaaaccatgatcacttacaatgtactttcttatttcagtgaggaccctacatttttttcttacaaaatattttatggatttttatctgtttttctctaatgagcttctgtaatgctctgtagcctctgattggatatttcagtgagcttacaaccattttcaagagcccctcgtttgtatttgcatattgatgcttgggtatgtttatacatatgcagtgcacagaatcagagtaggatgaaattacattcaaggaaacaaagcaccaagaaaccaaaacaaccgagggaagatcggtagtacctcaaatggttccttggtaatcggatcgatattcccttgggcaatgcctttagcaacagtctgtggtagccatgtataaaccaattaaggaaaagatccaatgcatgcaagttgagattttcttcaagtaacacaattcggtattactgagaaatggtggcattgaaaggccgttagcttactttctaacgcaacttgtataatggccattagacatgaccaaacaaaagtggaaattcatccttatggacttatggtggataaaacaacaggttatcatatgaatgagctttagcatctattgtacaaatataagtttggcaaggatatgggcccaaaaagtccaagtcttcactactgccatggggaatgcctgacaaatgaacaatatcttccgtcacagggtcataaactctttggaactgaaatgcccagatcgcctttctgaagttttcttcatattgaggtggaacagaaacagcactgtacctcaggtgcttgattacctgaaattatacgcatcatttgctcattatttttttttctaatttgctaagcaagaaagtgattgcacatcgttgccctacaagctcagtagtaactcaaatcatgtcctgcatgtatgacaggctatggattggctaatgacctaagtacaagacggtggcctcataaaagttgaagcaatcaattttgtgttgaggccttgccttctgtagttatgtctaagtagaactgcattctggttctactatccagccttttcttaccatgctttgtaggtcttgaacactatctcaggcatcgttcatgttagttcatgaatcagttctttccaattccaactaggcctaaagttagtatttgatacaacagatacagggtttaccttttcatgacccttgagcttttggataagtgcatgagctcgtttcacacccattccaggcaatgatggaagataatcacagccacttaaaatacacatctctagtagcatttgcatagtgaatccattaagatcaagctccctgcatcgctgcaatcgtgtaatatgaaattcaacaccttgtccaaacttgtccatcttgaaaataatctgcacaatggaataagatgcattttaattagagaagttacaacaaactatgaacactaatctagctgagcagcaaaatactatggggtacgtggaggacaaagataaagcgttttaacactgtgcttactctagaacagccaaatggtatcagatcagaatcctctgtgataacggcatcaacaagtttgttcacagacaagaatgtcatttgtgcatctgcttcataaggcgcaacaatataatcaaccttttcttgcttcaatacctgcattgcaagttttggaacaataatcagttaagacaagccaaatgttcctactcctgactagaactgcttcaaataggtggtaaatatttggtaaaaatacatggaatttgctcctttacctggatcagttcaaaagcaatcctaggtgtaatgtcaacagctttctgataacactcaaaagcagcacgtgaattcccagcagattcatgctccttggcacgctcaagattttcctttcgtgacctacaggatgtcatgcttacttgcttagcatccaatgactcaagaaacatcacatagcaaagaatggctggaggcctttagcttatccactagtctgtactaataatgcgactgctctatatcagcctaaagccacagttgtccataactatagccgtatgtaaaatgtcaaatcacaattttttttaatgttctgtaagggtaatgtagatgttccttggcaactgaaacatgttaggctctttctggagccctaagaaagaacatacctttcacgtttagtctcttgatcacccttcatcggcagatgacctccgtcaaatacaaggattggtttcacgccatggtgccgcaacatgttaaccctatgcatgcaatactcaatatgcctggttcagattcaggaggggaaacacaaggtgtaagttatggtgctcaactacaacggtgataaatgatgataaaaactggagttgcaaatctatggccctccgcattatgagttcacgacatcaaaaatgcagcaatgttagaagatatcccatacagtaaaaagatactactaacaatgctaagctattgttaacgtttattgaactattcatgtctaagctatttccaataaaaattccacaaactaaaatggtgaattctctgaactaaagcggcaccagatgccaagcagcggatctctcccaagtgtgtattttattcaatgcaacctagacatacaagaatctgggcactgaggcggataacaaatttcagtaaatgtactgcccctggaagggggcgaaaacaaatgccgcacatttattaccttaatcctgagagagactgaacaaacaagaaatccccccccccttcctacacccacctaaaaaatgcggaaatctctcatccgaagcaagacgtgccttttacccctcctccgaaatggatttcaccagtcgggaccaagaaaacaaaatcggaagaaacccctggtaggaccagcagctgtcaatacgctcgtggggaagaagtagatttcccggatccgtcgatttaggtctcaccaatcggcgaaatggattaagaaaccctgggttccaagaaaaggggggaggtcaccggagccgaacctggtggtgggtaggcccttgcagaggcggtcgccgcaggagagggcgcccttgtggagccaggagtaggtgtcgacggccaccgtctggcccttgagcgcctccaccccgatgggcgccatgatcgacttcagctgcggcagcaatccctggatccccattgccgcctctctctctctctctctctctctctctctctctcctctctctctcgctctctctctctacttgtaggttttttcttggaaggggagaagtgaagggcgggaagcgaggggttggagggagggagccgagtgaaattggcggacggcctctcgttttttctcttccggcggtccccaccataaatctatccgaaccgtcggtctcgccatccaacggctgtgctacagtgttttgctccgtgcgagtaggccacagcctgagtgggttccagatccgcgattgtgagtgtccaacattagttgggccctaacggggttccttacagctacgtgcggcctgtccgtgttaggccggaacggaattcccatgggcttgcagcccatttaagttgggccgtaacaggatttccgccaacgtgcgggccgttggttttgggccgtaacgggatttccgccaacgtgtgggggaggggggtgggggcggactaattcgagaaaattaatttttcatttgaattttaatacctttaactcaaatttcaaacttttcatctaaaaattgaatactttcatatcaaatttcaaattttcaaatcaaatttcaaaaacttcccgacataaattttagcgataatttataattttcagacccacctataagtgataaaggtggggtgcagtcgactgcaaagatcctgacagccgcctgccccgccactctgaccgccagagacggcgcccaccaaaaccagacagttacatcgtcatcccaatacggaaaaatataccgtgaaaattccacgtgtggtgtaaatccagaaactaccggtagtacaaaagaatggacatataagatttataactttttactaatgctaacgtgaacaaatctcaaaaatcaatttgtatatgctacgatatatggagattgcacgacatttttcccttccaacgtgtaggtgtgagacagtgagagcgacaaaaaagaggctgctccatgagcaatgaactcttgacatttcatttttttttctccttttccctatctgtatgtacagtaagaatgggtcatgctcattcgctcgtgggggggaaccggacgcctgaatgcaccaacaaagaatggaatcacaatgtcacatgtcgggagatcgatatcggttagcccgtctgctatctacgtgagaagccgccaaaaatgagcgcgacggcgaccgctacggcaggtaccaggccgctgtacggcggccgcggcgacgctccgttcacgtcgaactggcccgtgttcacgtactggttcttccccgacgacgtcgtcacgttcaccgacgtcgaacctaccaaaagaaagaaaaacaggcattcgttagttgttcacttgtttgtcacaacgacgacgaagaagaagaatcggaaaacgtgatgaatccatggacaaaatctgaaaattcgggtgagcttacagtcgtagtcagtccagcccatgcgcatgttcgccaagtcatacacaaaaatcttgtccttcaaaactagatctgcgtcaaagtgggaccaaatagttagcaacaaagcatcaacatggagaaatgtgtgcttcaatcatcagcataggactaatagatcgactgttttttttttatggaaattgaagtgttcagggtcaaggaaaaacatatggggtcaaaacgtaggattaatctgtcaaggcctcaatacccttgaaagaacttgcagattaatgtgcatcgatgtgattattgagaatgttgttaatcattgaaatttttcagacatcagtggtgtgatgtgatggttgtctcaagtcttaatagtagttgcgggttagacttagacgtgcaaccataattagctaattcaatcagagctagttaactaacctccgagtatggttatttgttgaccctggttcctttgccaaccaatacaccacaatacattgttgtcctgaaaagcatgatatggtattaatatgggcaggaacaagtcttttcagaaacggttaggcagatatacaactgttaccaaggccagaaaccaaatatattaaaaaaaatgcaggcttacaatagaagcctgctgcaaaagatagttctctggcttcaccgtcattgcaacaccacccataaaatatagtgacacggtaggaaacgacgagtcaacgctggttgaaaagcgaaaatatctgtaagtaatttgacatactgaagaacatgagctgctaatttccttcactgaaacaagaagctaacctgctggaagttacaaagcattggttccccttgctgacaagagagcgcacagatggagagactgcagcagttatctgcaaaaacaaaatatgaggactaacaatcatgtaacaagattaattactatcgtaggcttatca

SEQ ID NO: 36083 - DNA, 14535 bp, Oryza sativa
ttccttgagtatttgatgtcgtaaacaaggaggaatcaattggcagcttctgtccattgacaacgatactttccagattcaaattgtaatgaggcctatatttcattgaaaaataaatcataaactgacgtccatagaaagaaattaggaggaagaatatcaagttactcatgcagcaatattgttagcctctcacgcaaggttaatgaatgtgcatacacttattggttgaaaacttttctacaaacaaaaaatcagcagaattctgaagttatacaataagtaattctagtaagagactcactgtgatgggacgagtggagtatagactaatcctggctcgacaatttcaccaagaacgagaataccaccaccattatctgaacctttcaggcaatgagagaacacctttggggataccccaagagaattcagttgtgagacaacagacagctgatgctgtccaaacccaaaaatcccatcaactgccctgtctgtctttgtcaagtctcctgactgtgagttgctacatctgtttcaaaagaattaacatattcatcagacaatgaataatactgatcatgcgaagcaacaaagttcactgttagggtaatgaaaataaaaaaatgcacagttaaactttacagcaaagtgtcaccaggcttctactgctaaaagatccacataaggctaagcttttgttaacataacaacaaggccattaacaggatgaagcatgcatgccagaggatagtagtctagaagcatgctgaatttcttttgctccagaatggcatggaaagcaaaatataaatataattttattcaggttgaccattaaggatattgacaactttttctggtggcaactgttttcagggatgacaagaactttattcagattgactattaaggatattgaaaggaagtttgcttgcaaaagtaacaagaagactgttggtttaaggacattgggagtttgttgccattaggtccatcatttgtaccaactcaatcagcaaaaagagccaactttgtcacacatgtgcaacaaactgtcaacatgtaaatggaccacatcactaacaaggtttctaatggtatcttactatccttaaagcacagtttagttgtcgattgcagtttaaaattaactaatgtaaaatttagaaagatacagggcttcaagggaactgtacccaaaaacaatagaggctgaagaattggcagtttgctcatttcccatgacagtgtcaaaatacattgtgtcagacacgtaataacctgatgtgccacttccatcaccatacgtgaaagtgtaaccacatgggctgttgtctgaagtctggcagactgcttcgcttgtttgaagggcagctgtacacctatcatctgagcatggtattttggatgatgttgatgaagtgtcaggattgaagaactccaactggatctgaaaaacatataaagtaataatccaatcagaatgaatctcaactgataggtaagtccatctcaagggataacaatgctgttgtatgcatgtcatagagataaggataagagcgcaaagaatgagatgtctcacattgagcccacttgaagatgggcaaccggtgcaagggctgcacgctacccataagatgtcactgccagtgtcaatctggacaaaatattcttttggtgggcttcccaatttcacacgcgtaaaatagagcctgcaaattcaaacactaggaattaggataaagtagttgcaaaaaggtctcctaatttcaaataacaagccaaattgcaaaatgaaaaatggcatcagtcctacaattcttctgattggaacccactaactgcaattgataactctatgtattatccaaggttgagtcacgtcatcttcaaaattatatccatcagctgacaatcccccaacccaacaaaaggacatgtatcctttcagtccttccatccctgctgaacgtcccctttttgctatctgcattggcgagcatgcttccctaatcatgatatgatatcatctttacattagcatgacactaatccaccctgcccatcagtagtaactagttatagtcatgtttgtcatttttaacaaaaccattgttaatacatgtatagatgttatattatatccataattatggaaaaattgcatccctcaaattccctctacaaagtagtatccactactagttgaaggatagttccaaaacggaggttgggcaatcacataacatttctaaatttggaaacaaactgaaacgttcatcctaacaaattcaaggattcacttaaagatgagcatgtttacaaattgccgcccatcagtaaaggtttaaacacatgatactccaatacctcaagggagttcatcaacaccacagattgcagatggtaactaactaactatagcctatggcacaaaaccatgaagtggaattcagcatgatggaaggtgtgatagcatataaagcctacaggtattggtgaaacataattgctccccttttaaggctcgcaaggggcaattaaaaagttccgtctagcagtccataatatatcgctccctattgctaagatatctctaaataaccctgtcactaagcttacaactggtgttgcacaaatttgaattgattacacaaacaaaagttaaatcatagctgagggtgacaaattcctaaccgcagctaagacaaataaatatcttttttttcctaagaggaattgaccttaagtaaaagcaatcgaggaaaatgaaagaaagcaggtattgcggccaagtgaaactgtgacgggcaaccaaatctctgtaaacactcgatccagtagaagcaaggtacgggctaataaatgaattctttcttctttcagaaaggaaaaatgaactctttctttacatatgaatgcatttattttattttaattggagcaagcaaacgcatcactgcatcagaattgggctcccgaatgaacaagcaattgagcatcgacattgaaacaagagaagcaattgaatgcatataaagaaagagcgaagtcagaatcgtcgcatcgaaaaagggacaaaaacgaatctaagaatccgaaagaaaacaagccgccgccatctacgacgaacaattcggccaaaaaaaaaaaaaagaaagccaaaacttcgaacaaaacagaacgagaagatacttttcagaatgcacacaaaaaaacatcagcaagaaaccgtcgagtaagggcataaacacttcatcagggttgaaccttcatccgagaaacagaaagaactgaagcaacaaaagcccacgaacaacccagccatccaccaccctgaaaacgaactaccattgtcgatacgtgagaccaatctaccttagcagaagcaacaacctcagatcaacgccgagacgaacaaacccagaagaagaaaagaactcccaaatttctcgatcacacacaaccacacccatacaaaacacagggaaaagaaagcgagaggcagctcacccacccgaccatgaacgggttggcggagccctccacggggaagtccaccacgccggcgacccctcctcctcctcccccgagcagccccctcctcccgtgccgcgccctgtcccgctccctcaggtgctccaccgccacccccttgtgcggcagcgcgcgctccagcctcagcgccgccggcaacggcgccgcgcccgccccagccgccagcaccagcgcggcgacgaccgccaccgccgccaccgccgcgaactccggcggcctcctcatccggcacgccgccttgcagtcgccgacgcggcgaggcggaggggtggcgcggaggctgcgccgctgcgcgtgtgcgcgtagcagcaactttttttttgcgtttagggactcgaaataaccaggatttagcttgccagcatatatacccccctccaacttgtcctggattgtaaataaagaaagtttcaggggtgagaggtgaaaacgcggggggacgggcaaaggattacgtgtgggctctgcggttgccactcttctgctccgccgctttatagcgtgtccagcattttttcctccttttctctcctcctcttggggttttcctttcttggttttcctttgcttctttgctgcctttgacccaaagtgatgggtttggtttggcttagtttattcaaacagaggctgccatgccaaattccacatgaattttggggaaataagttcaactcctgcataaaccatggcaaaagaaaaatagaattccaattgtcccctaatttgatgatgatgtcagtagtgagagctcttttgttcttccttgtgtgttccattttcttgattggatatgatggatgatgatatattgagatatctaagaaaattcttgttgcacatactatgggtcccactgctagtctaatgatgcttttcattagtacaattgtgcaaaaattgcatttggggaaagagccaaagaggggaataagattactagatactccacctagtttataaaagtattctcttgcatctttgcctttagcatttctcctgcgtccaatagtagcagctaaattggcgttcaaaaaaaaatactagcagccaaatctgccattcaatttgtcaagtttcaacaacgatctacaaagaaagaaacaaatcaacaatggacttctataaatacaatattttgataataatttcttttttcttagaaaatggagtaaaacccattctatgcatccaaagcggatttacgcagccaaatttgatgtaatttaatgggtgtatttagttcacgctaaaattagaaatttggttaaattggaacgatgtcacggaaaagtttaaagtttatgtgtgtaagaaagttttgatgtgatggaaaagttggaagtttgaaaaaaaaaagtttagaactaaggccctgtttagttcacaccaaacttcccccaaactttcaacttttcatcacatcacatcacatccaaaactttcctacacacataaactcctaactttttttccaaactaccaactttccccaaacttcccaccaatttcaggaactaaacacaacctaaggccttgtttagttccaaactttttcttcaaacttccagcttttctatcacataaaaatttttctacacacataaacttccaacttttccatcacattgttccaatttcaaccaaactttcaattttagtgtgaaataaacacaccctaaactcggcctctatcgtggacaatcacagtaagaagaacatcagaaaacagtagagcactgccacctgacatgggacattcattttgtgaattctgaacatgctaatctatctatactgtacctaacaactacagtaagcttcatggatacagtatatgccctgcatctcgctaaattatactccagttgcaagtatgcaacctctaatgtaatgtagagtactcctacctaacaatctggatgggaccaatcattttctctagaccgtttgacaagccatatcttgaaaacaatttctgaatctttcaacgtgtgctcatcagcaggaactatacagcagcaataatagaaaaacgtgcatgagtgagtgggagagaaacttctcccctgagctacgaatgttcctacccaatgatcataacatatcagaaagaaaaccttcatgtctgaacaatgactcgatcaagggcatcttttccttctccattgatggggcaggtagaaatcttcatccagttaggtggcatgcctttgttgggaagctactcccccttgctggatgatcaagtggttcaggctgaataaatttgggaaaatgcttttcccatgctactgatgtaattggtgctttgcaaagggagtgtcagtgtcatccttgatattgcacgcgcattggtatgatcttgtccaaaaatatttcctgcaccaaatgtgtaggtacgccattgattttgatatgaataaagggaaattaattatgtggcccagtcctggctcaggtacatagatttggcgtttcatatatcactggtttctctatagttgtaaacttttttttttgcttaagttcagttttgcgtgaggtatttggcgtcactgtccttggtagcacaaatgcaatgattttcatagtgtatttatgaaattcaacaggaattttcttgggagcataattcaatgcatccaaaatacgagtactacttttggagaagcctgtctgtctgctttctggcacggccacatgtgattagcaaaaaacaagcagataatggtggtatcaatgtcaagaattcccttatcaaaagatgccaaatgactccccccaaggttcacatttcttgtgtcatgtgccttactaatcggagcaaagaacaacaacctcatcagaagattggccagataagtaggtcaagcaatcagctaatccagctttgctgcctacacggcacctagctagtgcctgttgccttgcgtcgtcgccaacacagatctctcctgcaattgcctaatgccaatgcgacatcctattaaaatctttaatattgtgatagcacaaagcctctggttcattggggtagttgattagattggttaggataaagagttgacaaaaagatccaatcttttgatctctctctgcctttagcacagatgttgtttattgtgtgtggtacagcatgacaaattcccttcagagattccctttaggcctttactagtattgtactgtttgttttataatgatataatgattatgatgatcaagtaaagtactggttcaatgtcattactgttcggttgaactgtatactgtactatttatattgcttggtctaccaattggttttgagttttgacgcattcagataccgtgcttgaacaagctaaggtgtctagcaacaacgagcttgactagttaatcaacatgaatgtctgttcagttcagctgtttactaggaccatcttgtcgcgaggaatctaactggtaataatgaaatgaatcttaagccattcaactcaaaacttggaacagacaacagagtatcactgtccagcagcccctagaatagttgtgcccactaatgttgcttgttgaactttttatgtaaacaaaaaagtgtgttgcttgctcaatctgtcgttctccacttaatttttttccatgaacatattttcaaggcaggtttaaaatactattatctccctcaaatgtaaggcaacttgttctggtccaatatgctgtaaatttgttttgtttttttcttgatgcctctcattttatctacttgttgtcctatcacccacagtcaaaaaagttcgaattttaatatttagttttggagttagtttagaggatttcgttcatcaaaatttactttccagcattagtttttaaacatgaaataaattatatctacgaatatatttttggttgcttaatttattttaacgagctatagatcaaacaatcaatctttatctgaagggaatgtatcatgttgtaccacgcacaataaacaacatttttagtacacaaacacacacacacacactcttaaagagtgattttactgccttgatccttaaggaggtatgggtgttatataagtactgcattcgtcccaaagaaaacttaacctagttcctagtacaatgaatcttgtctgtgatatgggcccggggtatgtgaagcgtgggggagttaccttcccatttagccacgtggccctacagcctggtcctcctcccacacctcggaagttgcggaagcagctaggaggcctcggggtgccaagtcacacccctcgggccctcgcgctgcctcgccccgaggccctcgggcagccgccatgtggcgaggggagcgagcggggaggaggcccaggctgagccgccatcaatgcgcaacaccctaaccgtctaaatgcggtaggggcggacgtgtggtgcggtccgattgacccacgtcaatcgggcgtaaccagactgtgaccggcctgttgccggtcacgtctgatcggacgggcgaccgtgcccccacgttcgcccctgtacccagcggagtggaggcaggtatgccccgtcccatcaaaccatcatctgcagctccctccatgcgagatgaaccgccgaaagcctctactcatttaagagggaatgacagggctgtcccccatgttgagtggggggcggcgttgggtcccactcaaggacggactgctgcttgacttccgggcgaaggcaaggatcgtggtccggtcaaggtaaagtgggtccccctcccgtgaaagagtaggtagaagcggtgcatgtggtatccccttgaactataaaaggaggaccttgcccaccgagaaaagggacgactctcagttagcctaagccccagggaaagaagagggaattcctcctagagcttaggaacctttgtaaccctcaatcttaaatcccacacacaggagtatggtattacgctcgatagtggcccgaacctgtataatcccagcttccacgtgcgatctagaagcactcagggcggatacacgatctcgacacgcgagccttttcccccggccgaactcacaaaagggggatctcacgatctcccgctagagagggtcattcctcgacaaatctggactatcctttgtccagattcattgtatgagtttttttgacagaggaagtattgtataatttggtacctagaatagatagctgctctttcttttacaactattttgtctgcgctgcttttcctcaaaccatatcgtcatctaatataaagcgtattataaggaaaaaaaacacacacactataagactatactccctcaattccaaaatataaggcataaccacctttaacccaaagatcaagaaacaattattatcatctctttgtttgaatcaatccaattaatacaatacatgcacccaatagaattaaacatctagtgagtgtatgatttaaaaaataataatttaggagagaagagatgctaattaattgccatgcatgcatgcatgccttatattatgaaacacctttaaaaagtagttgtgctatatatttttagaatggatggagtatttcagtagataagactaacctcaagttaaacaattagctttgcccttaagtaacctgaggggggacaatggtttggaaaaaggaaagatcccagaaagggagcacccacaagagaaaaaaaaaactaaaacctggccagagatgtagacctatcactaccgccttttaacacaaacaagaacccatcagagcgcctgcagccaatcacccaacaaaaggtgtcccctcacactctcacgctgcataccccacagggagaggggaagaaaaaaaaagaggtaaaaatcaaaaggtacggagaggtatagcagcggtactttggtacggctgtgtgttgcaaagatgtgttacgaattcggagaccggcaaggatcggcagcacatgttcaatgctagatcttgtggtgtagaaggaggagagatgtgtgtatcgtgtactataaaatgcatcacgtgtggtggcatgaatatgtatcatgatgtatacttggagagagattctatgtccttgtgagaagatgctgggatatgatagctttaggggatattaattaacattagagaggtgttagttctcaaattcacacttaaaaatagagtatcattggtaaggtgtcataatttgatatatcgtaattttagatcttaaccctatagaggtattaggagataccaaatttatatttaaaaatagtttaaccgtggtatctcctcgatggcatagatatagtatattaagactcatgctaaatatgatggattatcgtggcttgctcaagctcctaaacaatgagtgtgttcggaaagacgagtttgtggctgcggcggcaataaccatagttcctctactacttgtggcactattgatgttggttgcgccgcaaccgcaaccacgattgctgaacaaacccaatgttttttctaaaaaaaaaataatcaacatttttttagatttttttcatcatttttttggctttctaatatctaacttatttgtttgtgccctcagaaaattattataccctcaatttcatccatcatcagtgagcactttagaactggaccagtgatgtttcaaatgtaggaaagttcaattctcatgataattagaataacttcgatgattatccacgacactgttatggtgcataaaacgatagcaacaggagataaacaaaggtacatgccatacgcgagtggcataacactcacccaatagcccataggttaagatccccagcctagtagcagctctcctaggtcctagctactccacactctacttgcaccctcttcaccctcttttggctcttcaaaaagagttcattcgtgcgcttccctttttgaagttttgtttggacagcaacttgcactccctccctccactagctctcaaaccgaatagccaggaggcccgaactcactgcatccactcgtgaggcaggcaaccgaccaccgacccaacccaaagatttattttaccagaacaagaggttgccactctccgacaataagcacattcatctcagtaaatagtaaaaaaaaaacaaacaaaatttattttggaaatattcttttgaattttgttgggaatgctacgaatcgggatgccgacgtttcagacgaaccctctccgaaaatattgtttcttctccttaaatattttttctactaaactacttatctgaccaaaccattatatccgttgtaattaaatctttatgacaagatatcatatgattatattatgtcaagagaaaaacatgtgtttcaagttgttaaaactcaatgttttatatgtgatagtaatatgtttcaatgcatgtcttgagtgtatttcataaaatttcaaactacctgccaccactctctctccacctttattcatgcatgcatgcatacatttaatgaccttcaaaacgttttttcgctaaaactatttatctaatacgtgatccgatcacaccattatattcgttgcaattaaatttttacaataagataacatatgattatattctgataaaagaaaaacataagtttcagtccgttaacacgcaatgttttatacgtgataatgacatgtttcaatgtatgtctttaccgtatttcacaaaaatgttactaaatgtttcaacgattgatttttttatcatatataactcaatgttttattggtggtcaattataatatttgaccgaccgaatttttttaaaaaaaagatcgggcgcccgattcaaatattcttccgaattttgtcggtcatcaagttcttaccattaccgtatcctatcactatcggtaccgcccggtaatcgtgatagttccaacttcatatatgacagggtcatcgcgtagtcaagtcaattaaataacactcctaccgaacatttttttctgtttccaccagtggagaaacagaagagccctccgagtctgcggaaacggcgcccgcgctttccccgctttccccctcctttcaacggccgtcgcacatggtgaacgcagcagccgggtcggggtcgcgtacgcagccgcattcgcatccgcatcggcagccgcagccgcagccgcagcccggtaaacgcacgggtgggtcgtgggtggaacgccgcggacgtccgcgattcttccgtccacgcggttgcagtacacacactctctctctctctctctccccccggctcccgcggaatgccgcgatacgagtttgggagcgtgcgtggcgtgggcgcggttgcgttcgcgtgcgtgcgtcctggcgggggagatggcggcggggcgatgtagtcgaggcgaggcacggcacgtaaaaggttcgtctagaagcagaagcagctgaaagtcatggtagcccacgcaagagaatcaacaacgtgaggacgagacccgggggctccgttcgctggatgggaatatatcatttcgggtttggtacgacgtgatgcttgatgaggtgatcagggagtaaaataatggatcttcttgaatcttgattgaaaatggttaaaaaaaacaatcgactgagctcctgtctagactctagaggcatcttggtggtgtaaattttggggagaattctaacaggagattaatcgatatacattcgactaaccggtagtgactcaaacgtgggtattcgctcgttttcgaaacagttggggcgagtggttcgcggttcgctatcattgtgtgccatggtccatggatcaccgcacacaccaggtaaagggcaaactctttccgatccaaagacttcgccgtccttgacaacggcccatgtcaggcgagaccatcgcgcacttattattacgagtaacatctcatcctcctcaaaaaaggttttgtaacatgaacatctcagccaccatatcaacgcaatgatgctgagcacacttcatttctgacgctggctgcactgcatttttcttcatggtcctacgtaccgtattagcatgatccttctgccttttagttcaattaggtacagtacacagaatcagtaaccgtgtgatgtacagaaagaagtttggggttaccatgtagacaggcacagaaaatggaacgctaaacatctgtggtttaagggaaaagatacacgctttattgatattttcaagtgtacagatgtgtgaatttaccctcaagctttgaaagccatgatcgctgcggttcaggactgttcaaatctaaaacatcttccaaacctccgagccaaaaaaaaaaaagagaaattaagaaaaagaatgaatggactccaaaattcttttgcacgaatacatgtggcctatccacaacttgatcgagcccccacaaagagcgtactaacatcagtagtaagttgcacttgcttcccctatataccctgtaaaactgcaatcatgaagcacaccaaaactgcaccttaatctccaaatcgcgacaacttccatatctgtagtgtacataggcagaactagcgagtcgccaattgagcttcaccattgaagatcaatcacgtaaaatgttaaggggcgctgtaggtcgagccaagttatgcagtcccaggttcccagctgtggcatacttctgtaagcaacagatatccaatggcgcagatcatgttgtccctcgacagtttagccattcacgcatgtcaatttgtattaacatataggatggggtgaagatcaaggattaaacagtgactatggatcatatcgagccccagatgtgaaagatgagaagaacccagctgctggtccaggaagaatgtcgctgagtttgccaacctgcccatcagagattatggacccccatcttgaagtgttctccccaaatttgctcccaacctgataaatgatgcaacatggagctgagcattgctactgaattagggaaaaaaacgcatcacaaagctgctcaatgaaggactataaagaaacaaatagagtatatatgttttcagtgccacctgctcaatgaaagactataacaaaaatcaaacttctagataaccgataaggatttggttgacttgaaacaaatgttatgcagtagtgataagtgatactaatcaagacatggaaccacctatattcagtccatagttattttttctgtgttaaaatgaagtaaagtcttattttttctgtgttaaattgaagtaaacttttgagtacttcctaccaataccatgcttatgccaaaaaaaaaaagatgttcagccaatcaagaattaatatatagaatccatatttagaaatatccacatgaaaggtctatattttgtttcagtaatctaaaaaaagtaaatgtgaatttctgatttaatgtgatactgcaatccaccatttgattttggtactaggcatgctaaaaacctgccataattgacagtacattgcctatacaagcttatgcagatatgctggagatggaatgaatatattggaagagaaataggcaagggccttatcagatggcttttggctttaagattctctatgaggagggtcaaggagattttgttcttttatttaacattgatcgacctttggttgatatatatcctaatttcatgtactccataggcacaacaaaaaaggacatccatatatgcgggattatttctttacttttagtttttactattttttactatgattactggtcactggtcaaacaagggtaaaggcatatatttgcatagtataaacctattagatatactcaacttagtgtatgcaagggtaaaggaatggaacagatctgattatgaataggatatccatttttcttgtctaggaatttgagtgtttaccttttaattaccaagggttaaatgctcccagctggtagctgcagagccactggtgaattgatagtattttggtgattttctcctcacttgcctcacagtgtaactgtctaaa

SEQ ID NO: 36084 - DNA, 4279 bp, Oryza sativa
aatcatcggatgttgactgtaatgatgatttgtgtgctcttgatgatagagctggggcactacaagtgaaacatatgaacatgagacctattagatctacaaactagtgtaatttttcatcagaaccagccaacgctacttacaaaggtttctttgaaaatcaactttcacaccaggctaaaaaacatcacatatggctgtccaataatatcatctcatcaagtattttaagcatgaatttaaacactatagctgtctaaaactaatgaccttaatggattaattacagaaatatgcattatacgacgataaaatgtatgtgtactcagtctgaagaattatttacctgatcggtaggtatttgaatcttgggacttgggagcacctcataatgtttgaatctgtatttgatttagtcggtaacttttgcacagttccagtatacatgtgattcagttgaaccaagaagccgaaaagaacaacatagcgcttgtaagattgcttctcattctcccacagataaggttcgtacctgtttcaaaataagcaaatgcttcatcatggacaaatatggagcatgggtttttgtctataaagactattgatcatgcattcagctattgaattatgtggtgatatgtataacaaagtaaaacagaggatagtgcttacgtagcccagtctatcggatccaatctctgtgagaacttattgatcagcttgtttataggctctatggtagctgaatctgcctgcaattgtgactgttttctcctgaaggaagtcttagcaatggcgcttggcgaagagtcatgtgttctctgtgtttcagtagttttggtggaagaacttttgcctcctgacagaacatcgccaatgaagcgcaaatcgagcagtatttgcagaacccccttttctgaaaccagagatttaccagactcgattgataccaaaaagctttcatagatatcaataacctgcacgaatttaagtagctgttaggttcagtgattatattggcttttaaatcatacactgaacattttctcctaatcttcatcaatgcaggtagacaaaacagataattgttaataaagcaacacatacaacagctagttcctcggaggttctcaaaattgaaatattgatgacagttggaagggcgaggcattcaggttaataaggtccatgacattatattattagggcacggtattaatttttgtaggcgtgtgcaggtaaactgaagactatagtgcccagcttaatcaatgcttgattataagaaaaacaacaaaagctgaaaagcttgattaacttataactctataattactatcaatcatagtagtaatgaattgtagaacagtcattacattttgccaatagcaactattgcacatataacataaacaaatggttccctcgtagtatctattgttgatcatcattacggtatggtcaaatttatacaaaggcaaaaacacatgaaagtgaactatagctagttgtgtttcatgcagatagcatgataaaacattctttggttcttccattctttgctagaagttccaggccaatgttttagcctataacatgcaccacaattacttctcgtcaccccctcaaagaagaaaaggttgtcatgaaagaacattaccttctgtaacaagtcccatgcaaagttttgcaatatagatttgtccaggatgtgccctccaattttatgaatctccaaacatgcttgataaagaaaggatataatgtacagtgaaggcattgatggaagtgctatttgcatctccaaggggccctcagtggattcctcttgtttgatgactgtgacttcccatccctgacaaggcacatatatcatgtctatgacaatcagcatgccatgtttattttggcattaaaatagcatgataggactagaaatcaacgttgaaacacatagtcagaatttaatatttgaatatagacaaaaatcgaagcacaaaaactagaatcaaaacttggggttagctgcttggtcaaccctagaaaaggtgagccagtaagtatagctctatcgaatatcctataatagataacttcaaaattggcattccaataggcaaaaacaaactctacaggcccacgattttattcaacaagttctttgtaaatcataagggcacttaataaaagagaaatgtcttctagctgctcagtcatgtccaacatgatccaaaattattacagatttcatcattatgttactaatattgctgtatatagcagatgtctttgttacctagcaaacaaaagcatccccgattgatagtatgaataacatggacagaatcagaaacagcagtaagaaatatacttagaatgccttttacccgtaaaggggttggaaagataacaattggaaagataagagggacatggagcgtacccgtaaaggggttgataaggacaatgaatcatctttgttgaggtcatatgagagaagctgtgataattcagtggacaaccatgctatccacaatccatgggctgcaatgcagagtgcctgtaaggtcttgtttagttcatcaagtctgggattggagctatcatcagcaccaaatagggaagcagcagcagcaatagtttgtcttctggggttgtcagaaaattgccttccaggactccttgggcttgactgtgtgtgcctcctgggggtaaaaggcatcgctgtatcaaacgatgctcttgaatgtcttggtgagggcgacgataatctcataaatgctgcaccaccagcctcctttacccactgccttggggatcctaggatcaagggtacatgactcgagtggtatctcaatgcaaacatgaggcggccaatgaagagagatctctccacgataacagatgctgcaagcatattgctctccccttttttggttctcaaggaagcagacaattttccaagctcagcttccaatccattcagtatcccagagatggtcttatagcatttctcttggaggtatggcaccagctccttcaatctgggagcagaattgtgcgagtccacaaaacttaacagatcctcaaggatagtcttgcatttgctgtcaattgcattcctgatgcgactaacttctggcccaaaatatgaggtaaggcagctgtggaaatcattttcatcagcaatcggtttcaaatgtgccaaaattccacctttcttgatcttagactcagagaaccagacaccacctccagttgaaactttccgcaaatacaccatgaaatcaccggcatcctttggatcagcattggcaccaataccatcaattgatttcttaatatttacactatcatccaagctgccgaattccaagtgcacaatgtctttcatccgttgcacaaaggcttcttccatccaatcctcaaaaatgtccttcccttccttcaagatgaggccacggatctgatcccatggtgattcaatctctgatccaaacacactcttcagccattgctccagagtcccttccagtccttccctcccatctaatgcctcccgcacaagtctttgcactgatccaagcccttccccactctcaatggcatcaactagtctttgccctccagcaatcacaccaaaaatctcatcacagcatcccttcagccaatctgtacaagtccttgcaacagcatctggctcaagtagcaccatggtggcctcaagttgatcccagtgttctttccacaaccgtgtctcttccacagggtctggaatgccaccgaacagctgtgaagggggcggcaaatcgagcaccgtcttgaaaaacagtggcaaatcattgagcgcaagcacaaacaactgcccgacatggcccagcgtgacacgcacgatcttggcgacatcgcacagcacggaggagtaggaggtcagatcggaggcaagggtggttagggcttgggagatccaggcgcggcgggaggagaggaagagttggagtgcctgggtcggggtgagcgacggtgcgtcgattgaggcagcggccgcgagcgcgtcggcgtgggcggcgacggagaggcggcggtcggcgaggcgctcgcgagcgcgctgcgcgatctggggccggaacgcctccaccagctgcgcctggtgcgcgagcagcgggaaccgagcggccgccgcggcgtcgcgggagagcacgccgtgcaccacttgcgcccgcacgtaccgccccgcggcctccaggagcaggccctcgtcgagccgcccccagatgtg

SEQ ID NO: 36085 - DNA, 22344 bp, Oryza sativa
cagctcctcggcgtcggccgcgccgccgccggagactgccgcggcaggcatcgccgcctagaccttggagctcgcggcgagatccaggaaggaagcgatcgggattgaggaggaggtagggaggagactgtgtgtactaggagatgcacgttcgtttgagttgggtagaggaggtgactgagagcggtgggtgcaggtggaccgaggggtcgtcagagggtgggcccagtaagtcagagacccgacaaacagtacaccgggttctgggagtgatcttgtgagataattgttgcgagttgtggcccgtgggtttaggttgtatttaggggttgtttggttgatgcgtaagcttatcataactaagcttaggtaagttgtggcatgtggcaaaagtatggccaagaaatagttaatcacaagtgtggcaatgttagctctagttatctgaatatgacatgtgggacctaagggtaggaaagtgtggcatgacacaattgtggcattaaaacaaacacacgcctagaaactgtggcatgactgaagtgtggcatggcaaagtgaagcaatcaaccaaacacccccttaacgttaaaattggaagtttgattgaaattagaacgatgtaacggaaaagttaaaagtttatgtatgtatgaaagtttttatgtgatgaagaagtttgaagtttgaagaaatattttggaactaaacacggcgttagcaaagttgctaaatgtccatattttcttggcttaaattaaacaaatctagaacaagatgtatcacgtcccatattatatttgtttattttttaggatggaggtacatagttagactgttgtgaatgcttgatgcatagtagtccataggtctatttgaaatattcttgtaatgttgatagtttaagtcactttggttgacaacttaagacttaagcaccttcattgttaagtgatacctctgcatgatcattatctacatactcagtggtagaagaagtagtagtacatggtatccatgcaatacttgcattaggcagttgtgcttgacagccttgactcatgcatggggggtgacaaatagacaaagcatgtcctaaccagaaaaaagcctgattcacttctgactaagcccaggtcaaaactcttattgggcccagtctgaggtctaatcaaccaaacgatgccggccttgtcaagtggggataaaatatgaaatggccatgtgtcttatttacttttttttattatcacaggttatttgctttatacttctaataaaaatatgctttattaaaaatattttatatagtgtatttgtttagaccacttattctaatctatttgtgagtttcatttctaaataaaatataaatgtttcgtgttaatgaagtggacaatccatctgaataatctgcgcaaaaaattgtttcaaacatggcccaccaaacaactaaacaagacccgtatatggcaatgttaactaaacaagtccaatagtttgcatggcaatgtttgccgcatagtatgattgcaagtctgtaaccttgcattgaacgaatattactcctggtcagacaaaataaagatcaattgccgttatatcgtctattgtctatacagtagttctttttttttttagaaaagtttatatgctgtgtttgatacaggagttcccaactcctccctttcgttttccgcacgcacgcttttcaaattagtaaacggtgtgttttttttcaaaaatattatatacgaaagttgcttaaaaaaatcatatatatacaattttttttaaaaaagctaatatttaaataattaggcactaatagatcgctccgttttccgtgtgtgtgatgggttcccaacacccaccaccgaacacacccatatagcagttggtatgcataggataggaaatgcttggtaggtcaaatatcattggtcctttaggctgagttctttccttgaggttcctaactcacctcattctttttcacgcatacatatcccaaagcagtatagaatctgtctactcccttcgtctcgaaaaaaacgaatctagtactggatatgacatattctagtacaacgaatctggacagaggtatgtctagattcattgtattaggatatgtcacatccagtattaggttggtttttcatggacaaagggagtacatgatttttaattaaataagacaatagtacgatgaatcatgaaatcaagcaaatcaaatcatagtataataaaatgctaaaaagggaatgtctgagcttgtaaaatagagataaacaagtgactatggggtaggcatgaaaacggatcggaaacggacggaaactagctttatcatattcgttttcatattttttttcggaatcagaatcggaatcgaaaactcggatacggaaatgaaatcgaatattatcgaatatagatacggagcgaatatgagacggaacgaatacggtaacgaatatttaccggtatataaaaaacccctcaaattgagtttcttgatcaaggaagagatatctcttattattttagttcaacatctccaacatttatatcgtcaattttgtagacggtctcacacccgtatgtgaaaatcgattttcatggctattcctctaagagatccatatgcaaatatgattatcattttctattccccaagaccttttactagatatataacttatttaccctttataaattggagatgttatttattttacttcacatcttcgaaacttgtaatatttgttttatactttaaatgctttcaaatacaaatgttataaactacaaagtagtagatcccgttgagctctataactttgatatggaacacatctccatcagatgtcgtttgaattgtagatctgagattttgtaaaaattaatatggtatattataatgaatatttagacccttaaatgacctcaaataataaaatagtcaataagaaagttgtagatctcatcgagctctacaatgttgatataaagtttgtcttcatctgatttcgtatgaaaaagttatttatatatatatatatacacttattttttctaaaatttgctcaatgtgtgcggatatccgaaaaaaaatacggatagtttccgaccgttttccgattccgacggatagtacccttaccgtattcgttttcgtttccgagaaaaaaaatccgaattcgtttccgaatccgagaatttccggatagttccgaccgaaactgtccgaatccgaaaaaaggtccgggcggacggaaactatccgaaccagtttcaaccctactatggggtgcttagatccagggtataaagttttggcatgtcacattagatatacggatacacatttgaagtatcaaacgttgtctaataacaaaacaaattatagaatccgcatgtaaactatgagacgaatttattaagcctaattaatccgtcattagcgaatgtttgctgtagcaccatatttgtcaaatcatggagcaattaagcttagaagatttgtctcgcaaattagtcgtaatatgtgcaattagttattttttagcctatatttaatacttcatgcaggtgttcaaacgttccatatgacagggtgaaaaaatttggggtgggatttaaaccagtgttgtggaagacggtatacggatatcggacggagagggtaccgccaaacgattaatcggaatttggcggaaatataacgttttgaaaatatatgtacatagttgataatagttttccctttttgataaacaaatgcatataactaaatatattccttctatatatccttaaatagaataaccatgtatgacatttaaataagttcataatggatagctgttactgtatatctcaattctcacgtagtaatgggttttgttcataatgcttgaaatgataatcaagagaatgttacatagcatagatgaccgtaatcaaggtcccaaataacatatgtatcggttacctcgaagagcttcatcaaatacaaactccaataacgtgattatcatcaaaatcaaggaacccatgttcaaactttagaggaagtcagttccttgtcattttacatcttgttgccttgtgaaaatttcggaagagcttgtagtcagtagtagtaaagggcacagctaacaaccatcatcacgccgacgattatacggttgattagacggagatggacgatttaatcggtaatgatcggatttatgcgttcgttaccgactaattatgaccgcatcgacgtgatgtgacggtctgatctccgtattcgtattatcggacgtattaacggccattaacaccgttttccacaacactgatttaaacaaggcctatgggggtgtttagatcccatcctaaaattttacacctcatcacattgaacgtttgaacacctgtatgaagtattaaatataggataaaaaataactaattgcacggtttgtgactaatttgcgagacaaattttttaagcctaattgtttcatgatttgacaatgtggtgctacaataaacatttgctaatgacggattaattaggcttaataaattcgtcttctggtttactgatggattatgtaattagtttttttattagactacgtttaatatttcaaatgtgtgtccatatatctgatgtgacacggcaaaaaattttaccctagatctaaacacaccctatcttaacttttctgcgggaattgacaactagtactagtaaaacccatatttcccctttcagatcaaatacaagcagcctcaacactttgaccactcaacagctctactagctgagatataggcacacaagttcaatcataaataaagtacgtatgtccgcatgttgcaagctacaccctccagataattgttttacacaatggccgtgtttagttagggtgtgtttggtttgggaccaagtgggatgggctagacccatcccagttttttgggatgggatggttccaattgtgtgtttggtttgtggtatgggatggttatagttttttgtttggtagaagggattgaggtgggatgggatggacaatttttcacggacgttagggccgtctgctcccagcggctagcttccaggctgctggtgagattggggacgaaggagctcgtcggcgcaagttgaggagctcgttggcgcgagcggaggagaggcggaggcgggtcgcggacgagcggcgacggtcgcgaaggtggcggcgggcgtggacgagcggcggcggtcgcggagacgaggcgaacgcggacgagcggcggcggttggttgcggaggcggaggtcggacacggacgaggcggcgaggcgaggcgtgggcgagcggaggccggtctcggaggcgaggcgaggcgcggacgagcggcggccggtcccggaggcgaggcgaggtgcaaaggagcggcggcggccggtcgcggaggcggaggtcggacacgaacgaggcggcggcggtcgcggatgagcggcggcagtcgcgcggaggaggacggagcggcgctgggggagggagcaggcggatgagggacgagcggccgtggcggcgccgcggcagagccgagcgggaggctgcgggagttgacgccgttctgtccgtcgaagtgggatggattggtccggccgatttcggcggaccatctcgtcacggatctaagaggaatattcctctccagggaccatcccatcccactcacctctcaacaaaacacctctaaaagtgggttcatcccatcccatcccatccttgcaaccaaacacttacttacttttaaactttcaaaaattccgtcacatcaaatatttggacacatgcacagagcattaaatgtggacgaaaaaaaaaacaattgcacagtttacatgtaaattgcgagacgaatcttttgagcctaattatgccatgatttgacaatgtggtgctacagtaaacatttgctaatgacggattaattagacttaatagattcgtctcgcattttataggcggatgattatgtaatttgttttattattagactacgtttaatatttcaaatgtgtgtccgtataaaaaaaattgggcgtgaaactaaacacggccaattttcataaatcaacaagctcaagttgcatcatctgacacgcttctttgtcctggccaatttaagagctaatttccagttcattaagtgcttcgcctgtgactgcaccaaagaaaatcaacaagaaacagcaataattgcatttttcaatcaacaagaacaagtcatgattgtcagtaactagcacaaagaaagacaggcgtttaaagcaagaaacaattactagtatccaggttgctttcgtcgaatatattattattgaagttaaaatccagacggactttttctatcataaacgcaaaaccccaatatcatgtaccataaaatgccgcttatggcaagaacacgctgaacacaatttcttggctgcgtatcttctgccactaaaatgttgagccaagcttgcaattcactcaatcaacgagcatttgttttgaaagtactgttcactaccaacttgacagaattccaccacaataaaagaaaactaagctgtggaattatctaatagtaccataatagttttgctgtcattttaaaggatgggttgcgcacaaacacagattcagctcaacacaattcacaaacttatttctattgaattgccatgatttgtttaattaactgatatataactttgacaacaatgtacaaaacaactgatatcaatagtcttccatgcatcacactgtcatcaaggcgacaaggcatgcctcctgaatttagctctagaccctaccgaaacaagaaaggtacaaaaacaataattccctagatcttaaaaatggcaagcattgcattcatacatatggtcacatgtaaaaacacaaggtgatgaattgccagtgtagagaagttacctgtaatattcctcagatacctgcaaatctcactggtgcataaggtgaccatgcaaacggagttctgcggctggacatcaagcttggttaatccttgcagcgtcctcttcctcacatcaatagcaaacaccaaatgcaacttgtccatgggactgggactggttctagaaagcaagaaaacaacatcatcatccatgcttatggtggggtttaccattggaagttccttgaacatttccacgatctcgctgaagctcaagttagaacgacatgggttgctggcacccaaggtgatgtctttaacaccaacctcacagtcacggtgccagtgctcgcacgaagaaccaatcaccggcattggcatgctccatgttgtggccttccagtcgtcacggattacctgggatttccttgtgttattgagcacgcaatccacataagaaacaggagtgctggtggtattcatcggctcttttggtgaccacatttccatctcaatatacttgatagagtctctgtttcggctgatggtcacatcccggaaatagctggggtcatattgtatcaggaagagatccctgttgctcctcgctgggcacggcagagggatgtcccggagcgcagggaactcatcgagcacgtcgcagaggaagatgccacgccagaggtccacccaggcgacggtgccaccctcgccgccgaccgtgatggtcttccctgtctcgtggtacagcctgtcgacagaggcaggtatagggataaacttgtctctgatgaactcggtcaccgataaccgcttggaggtccaacctttggaactggaggtggatctgtagaggtggaggtagaaatcccagctaacgggcgcaccgcctttgtacaccggggggccaagacccagggcggcgactgcataccaggcgccgtcttggcggctgaggagggcagtcatagagtcgtggaggtacacggggtgcgggttcgggagcagatctagccgatgggcgcgcggcctgtagacaaagtagtccaaacctcgtgcgttggcgatgctgtcggggttgacggggacgcagaggaggacgagatcggcgtcggaggcgatgatcttaggcaccacgcggcggaagtcgaggccggggcagtggacgcagaagcgggagagaagcggcgggcgggcggggtggaaggtcgcctggatgcgcaagccggtgctcgtggtgcccacgccggtgctggcgttgggcaggtcagcgatgaggcaccacctgtcgaggaggaccatgccccctgatgagccgtcttcatggccgtcggactctggaaggggaggagccgtggtcctgtagggaacagtcggggcagccatgtccatggacaagcgaaggataacagatccaatcgcagggaggaaccgaatgtgggacggggtttttgacttaaaaaaaactaattttataactcatctgaaaaccacgagacgaatttattaaacctaatttattcatcattaacacttataggtttctataatatttagctattcatcattaacactaattctgatttctatgcaaactatgcaattagtttttttatctatatttaatgctccatgcatatgtccaaagatttgatgtgaccttttaggaaaaaattagcaactaaacaaggacataggagaactaaattattgtgcaacccctcctctaccaagttagtctaagagagattgcataattctaccagaattggagacacaaagatgtagaggtaagactcttcttatttattcattaacttgtgcaatacaatagcacctcctcccctcaatatataggcatagccatgagtgcttttcatatttagtgacggacctaattagtgggtaaccgggctggaccttcatgggccggtggtttccttaaacaaatcaatcagatccaatttaacttttggggacaagagtctagggttcacgaaggacatttttctccacgtcactcgtgtgcggttaccatcaacagcacgtacaacaaagacgctactacatgtggtctcgagtcttcacatgggctaaaaccacaacattgttatagctcacacaataggaataagtttactttgagtgcctaactagtagccgaatcttattcatctcgtttaaccacgatataagatatgttgactttccaactattaaaacatgtacaatttttctcccggtggttctgaacgtggcgactacgtggaggtgtttgacatgatcttcatcctacgtgatacttatgagcgcagtttgagatctaatcaaccaagcgatgccggccttgtcaagtgggaataaattatgaaatggccatgtgtcttatttactttttttattaccatggattatttgctttatacttctaaaaatatgttttattaaaaatattttatcttgtttagaccacttattctaaaccatttgtgagtttcatttctaaataaaatataaatttatcatgttaatgaagtggacaatccatctcaataatctgcgcaaaaaaaatgtttcaaacatggcctaccaaacaactaaacaagacccgtatatggcaatgttaactaaacaagtccaatagtttgcatggcaatgtttgccgcatagtatgattgcaagtctgtaaccttccagtgattgaatattactcccggtcagagaaaataaagatcaattgccgttatatcgtctattttctatacaagggttctttttttttttgagaaaagtttatatagtagttggtatgcataggatagaaaatgcttggtaggtcaagttcattggtcctataggctgagttctttgcttgaggttcccaacccacctcattttttttcatacgtatgcatcccacactactaaatgatactttttttaaaaaaaaaatcctacaagaaagttgttttaaaaaaatatatattaatattttttaaaaatagataatatttaattaatcatacgctaatgagtcgttccgttcttgcgtgcgcgagagattagttcctaacttcaacatcaggtatgcctataaaacaaaaggctacgatagttttataatgttcgggggtggaaacaaatttaatatgatcttttgccatgccattgttttttttaccatttgttataattaccggaaacaagctaataagtcaaaagcaacttccattaaaaatgattaattttaaatttataggaaatcaaggttattagaggaaaaaaattaaacccccacatgagcaccgaatttacaccgtgtcccctcaccctattattcatcaatagcactatacaacccgtccacgtgatttttaattaaataagacaatagtacggtgaatcatgaaatcaagcaaattaaatcattgtataataaaatgctaaaaagagaatgtctgagctcgtaaaatagagataaacaagtggctatcttaacttttctacgggaattgacaactgctagtaaaacccatatttccccctttcagatcaaatacaagcagcctcaaccaccctcggctcacctttctggattaagaaacatatgccttatttagttcccataaactttttgtaaaaacatcacatcgaatatttaacacatatataaagcattaaatataaataaaaagaaaaattaattgctcaatttgtatgtaaatcacgagacgaatcttttgagtctaattagtccaggattagccataattgctacaataacccgtatgtgctaatgatggtttaattaggctcgaaagattcatcctgcgtttccagacgaattatgaaattagttttttcattcgtatctgaaacccctaccaacatccggtcaaacgtatgatgtgacatttaaaaatttttatttcatccactaaacagtcccatagccgtcttgacatcccattggttaactcggacacgcaaagccaacttcgaactcttcaactaaaacgtgcgtcgcatcccccggccccacacgtcagccaccccaaacagcccatcgccacgccaccgaaccccaccccaccccacccgccgcgccacgccatctctctctctccccccttcccagaaccaaccaaccacgcgcgcacgccccgcgtctcgtcgcgtcggctcggactcgaaccgaaccgacgcggcgagacccaacccgacccaacccaaaccccccgaataaaagatccctcgccccgcggcctcccgtccctcgtctcgcctccccacacgcgagcccaacacgcaaacggagctgcctcctccacacccccttatcctctcctccgggcgagcaatcctcgacgaacgatggcgtcgctcaccaccaccaccgccgccgcgtcctccccggccgcgctgccggcggcctcgaccaccgccccggcgtcgtccgtgtcgccggccgccgcggccgccaagcggcctcacctcgccggggacgacgcgccgtggcgggccgcggcgaccggcgccgcggggatccgccccgtcccgcgcatccaccacgcccccgtcctccgcgtcgcgcaggacgattattccgcctacgccctcgccgtcatgaaggtgcgttcccttttctcggttcggtttggttggtgggggaagggggtaattctaattctgggcttgctctgcagcatccggatccgataggggaggggttggccatggaggctatggtggaggcggccgggccggagtgcatcgtgcccgggcagcaggcgccgctgcggctgctgggcctcaaggtacgaaccgatctctcgatcgcagtgtatttttgcaatccaatcgttacgcacatgtgatcgatatagcccttagttaaattgaacgttattagatgttacttgtgaggggatgtatgcctgattttgggttaatcatgtatcttggttggatagttttgttatggttggtaattcggtgcttggtgcctgaggctcgctcaattatgctttatggttggtaattcggtgcgcggtgcctgtgattggtttgagcttttcttgatcattaaatattcattgggctatgcttgttaattgccaggtttagtgggttggttttgtcaatttcgtagtcatacaaattacagaaaacaaaattttatccatgggattagggatagtcgattaaacagttacgcaattgcgcagcaatgatttgtattatatttttcgtgttgtccaatagtgtttcagctttatcttttgtcaaaaaataggaaatacaagggatactaggttaaggttgagcctttgaggctactctgatgctgtggtactattcatttcgtgctctcgtggtattcattatgaaagtttgccattgctaggcataatatagctcaaaactttttcctttgtttaagtagaatatcatgaattgcttaaaagcttgagaataaattatgtaccttgcacattatggtgtttgagtacttcaataaatcatgtcttttcaatctctgtatttacttgcagtaattgatttctgtgcatgtatgcgttgcggtctttgcatgctcactatttggacacagcaccactagattgaattactacaatagtaaatgatatcacaaattgtcaactgaagtgaatgaaaaccccagccaattaacatggctagtatgaaatattgtgaactgtgaaacacccaaatttttcagtcttaaatttatcctttttgtcatttctatgtaggtttggccccttgatatagagatgaagttcctggagccatttggacgggaactacattccatgaaaaaggtaatgcaagcttgaggctttccatctgttgttctgttgcagctgcacgattggtttgaagtataaagtacttgaaaccaactcaagccttgtgtgctagtaatacttaatcagtctttagccatccttaagacctgtttggaaattacaatgtcccggagaaagataggcgttgtgtttgctatcctatccgtaggacttcctgtagacactcttaaagtcatccaagcctgttgccttttttcactttcaacattagtgctgctgggtaacatgcacttgcttccaatgacctgtatattgtgaccagaagagtccacccatgtatgccctgggattcctaacatttcaatggcaggttgaaggcaatagacccaaataaagtcatgatagaacgttcttcatgctttctagtgatcatggttaataacaccacatatatgttcacttctttctttctttctttctttcagtagtggtctgttgtcatttcctacaaactaaatggtggtctcctgaaccataattgccagagcagatacataacatttttgtacaactatctgctagtcgaaatgcaaatgtaaaatatggttttgtctcctaagatctgtttaggactacattggcattagtttataattaccttctactgctccattagaatgataacttatcacgcctagtttgtttagaacagacatgatttttatggtgtagttactatatcgtacattccttgtgcagttcatggacaagtcatgcagcgttatggactcatctatgtcaaataagtaggcgcatggctgattagttccctccattactagccaatgctgtatccacggctcttgctgaagttacaggaccagaaaggtacaaaacttgaagagcccatggagagaaaccacattcttgcttatcttgagtcgcatcacttgatggaacaagatatagcgccgagaacacagtaacgattagctagtactactatgtatggatccagggctgcctccaccgagttagtctacgtgttatgcgtttattgtattcatgtaacggttgtgacttgagaatataatgctgagttgcaaggaaaacgaagaaaaaaaatcatacaaaataccattctttttgtttctgtattgggttattctcggctgcaggccacatgcgaatatctgatggtgaattctcatcaaaatttcttgtgcgcgccccaggccctcatttatactactatttgttaacccgtaaagtactgtatttgtataacctgtgtttcggggtactcacgtatggtgaagcgtgctgttcattgcctggtccggattggcgattactgttgtcaccgtgaggattctattgatagagcgcgctcctccgattggagctctatcatccgtatgcgagatttcggatcgcgacatctgcaagatgccaagccgccaagcgtggattctcgattgcttaacgaaacagtggagtctccatcaaggactcatgggcacgccgcacgcctggtcgcccacaccacacaacggtgtcaatgagagaggctcctctcttcctggagcgcacggcaaaaccgctcgcccgtcccggtgcctgaagccgccaccacgcgcgacgagacacttcacgcacggcgattcggccttgcattgcaacacggagagggcgtgtgtacaggagggagggaggagggcttcagtcagtagtccccgctcgtccaaactcaagcaagagcaagagcagtgagctagctcgggcgcgcgcatgcatgtcattcgcatagcgtggtaatggccggcgtgccactggccactattgcagtcctggacgatttgtctatgcggatatatggtccatcccttgcaagaaacggtggcttctgcgcacgccggcgtcaatgcggcatggtcccatactccacaggaccatagccgcaatggccacaaggccgcaatcttgcgtcctcgtcgtggatggaagcgctcgaaacgtccgagtctgttttactgttctaccccgtatgggggggggggggggggtctgccgcatatgcatgtggcggctctagccacttgcagagttgcagcgcaggaaggggcagggcagtcagtgggtggggccaccgatggagcgtggaaactgcgtgcgcgtcgtagcgtaagctactcctacccaagcagagcaccccggctgaatcgcatattcgaatcagctcgtgggagggattcggatcaggtgcagtaacagtagtgactgtaactttggtaatacccaatcatccagccatccagcacacaagggatggcccagatttaactgtgtcatgcatcattttagctatttgaataagcatagaacagcttcagttcagattttgcctgaaatttctctccttttgatctgaattttcttgaacgttaagaaaacccaaatattgttaaagaaaactagacacatacttcatttcattatattgaacttcataatatcttgcacgcataattgacaaaatgagctagagtttaagcccttgtttagttcccaaaatattttttccaaaaacatcacatcgaatctttgtaaacatgtatggagcattaaatatagataaataaaaaaactaattgcacaatttgcatagaaaatgtgagacgaatcttttgagcctaattagtactccctccggtttcattttaatgacacggtatacaaaatatatctttgaccttatttttctattataacatataaaataaataaatgcatatttacttttattatagtgctttgaaagacaaatatatatatacgttgtcctttaaactaaatatttttaaaattattgatggtcaaagttataaaagtttggcctcggccttatctaaaacgtaaaataatatggaaccggatggagtacatgatagctataaagtgctacagtaacccatatgtgctaatcacggattaattaggcttaataaatccgtctcgcggtttccaggtgagttataaaattagttttttcattcgtgtccgaaaactccttccgacatctggtcaaacgtccgatatgacacccaaaaattttcttttcgcgaactaaacacaccctaactattttcgctgaaattgggtatcatgcatccactggcacaaaagctttcaaaatcaactagctatgctactgctagattaaccccgttacaaaagctttcatgatacaaaagtagatcatcatctgcttccaaaatcagcacgatgccttctaagttctattgacctcttcaaatgaacttttaagataagatgatatcttcaacattaatagaaccctagggaaaaaagataatatccaaattaatttcatgtgatgtgcagcagtaggaggtaaagtatgcttcccatggtagaattggcgccaattcttacctccctctcagatttttccctccaaaacacatctgctggaatcagagagtaggtgaaaagctgggggaaattaagcaacgaatctagaccatcccttatgtactcgatggttggatgatggatactgttaaagttgcagtcactactgatttgaatcctcgtgagagatgatgtgattacattacagacgcaaaatccagatttcttaatcgcgaatcatcaaaccgaaaccaactccaaaactctaatttcggccaaagagattccgcagaacagttcgagttgaccaatattatatagtttatttccccccttttttgttattactattccaactcgattatccaaacaaagtccatgttggatggatccagatcgccacaacactcccttgtcagttgtctgatcgactgatcgtctcatccctccctaacccgtctacttggccgataacccgtctcaccgccaaatcgccaatctcccacctcgtcacgcatgcgtgttcaaacgtgaactaatcaactctccgcgactccgcctccggccgtcccgtccccgtctccgggattttaatttcttggcacctcgcctcagcatattccatgtcccctctccatccgccccacgcgcccactttgaccgacccatcgatcgatcacgatatttagtagtagtagtagtattacaaatccagcaagcgatcccaatatcccattcccaaaaccccaatccatcctcggagcacgccaccttcacgaggaagagagaatcgaggaagcagagcgctcggaccagaggaggaggaggaggtgccagccatggtggaccggatcggcgccgcgtggtggtgcgcgtgcgccgtggggatgctggtggtgggggcgtgcctcgccggggagaccagcgagtaccggcgccagctcggctccgccgtcgacatgccgctcgacgccgacgtcttccgcgccccgcccggccgcaatgcgccccagcaggtaacccgctgcactctgcactgcatgttcttttctgcatcgcggaaggaaggcatcgatactcgatagactcctccgagggtatcgggtttcgaagccctcgatttgttttcagcatctgtgcagcttcggaggaatcaaatgttcctcttgttccttttgtgatcgatgcttgagatagtagcgtcctgcatctgttcgtgattcgtcactcgtgagccgcacttcgattactgtagattgtataatatactagtactagtactacggagtattttgctgttcgttttgtactcgcgctggtcctgctgagtgctgagtggtggtcatccatttgcatatgcttgtctcatggtgtctccatgctgatgaaacaagcaaggaattttcggtttcgatggtcccgaagttgactgcttgtctctcttcagaaattgtctcctctttaatcacactgtttgtgtttaattcgatcgtttcaatcggataaactgttgtgtttctggttggtagacctgaatttagcgtggcataaatgtttctagctacttgtgttacagggtttctgtcattagtctatcgatgagcatttggcttattcagagtcgtcacctggggtgctttttgcacttagcttaatcccagtccacaaacttggtgtgttcatgaattaaaatactgcttccgtaccaccgcttgctctgcttcactcatttctaaagttaacaccaacttttagggaagtgttccaacttctatcatacactatctgcttgaccatttactagtactaattggttgcagggcccttttacgaacccttttgttgtcttttggaactttcttattcttagggcacccgcaatggttatctataggctctctacaagagatccatgtcagcatatttttctacttggaagaattaaatgtagagagagagcaaagctatctactaacctgaagatagtctatagagaaaaacgaggcaatggattagagagctatagatacccatgtagacataccattaaagtggtttactattaatctagtctattgctgagatgtacatgttttatagatagcaccttactttaccattgcgggtgctcttatagagtcttactcccttgaattaagtattaggatgccttttactgagattgatgtccattcctttttcaatatgccgttagcataaaaaattatatgcaagatgtgctggggtatggtcattggtgtattctccactctgatgcttattgatattgttctctgaaaggttcatatcacacaaggaaatcatgatggcactgccatgataatctcatgggtgacaacaattgagccaggctcaagcactgtgctctatgggacttcggaggataatcttaatttctctgcagatggaaaacacactcagtatacgttctacaactacacctcaggatacattcatcactgtacaataaaaaagttggaggtattagttctttgcaaaagtcgtctttagtgtttggactgtaaattaaagattgactattggctttgttgcagtttgacacaaaatactactatgctgttgggattggacaaaccgtgaggaagttttggttcagaacccctccaaaaagtggcccagatgttccatatacatttggtctcataggtagtattcaatattcctaaattcatttttgctatgtcaggatacacattcaccaaatctataaacgatctatatcactgaaaacaacatctgtattcaggtgatcttggtcagagctacgactcgaatattacgctggcccattatgagtccaattcaaaggcgcaagcagtacttttcgttggggatctgtgttatgcagataactacccataccatgacaatgtgaggtgggatacatgggcaagatttgtagagaggaatgttgcctaccagccttggatctggacagctggaaatcatgagatagattttgccccagaacttgtaagtgtagtactccatttaactttatttgtgtaatgatcttcagtggatgcatatacagttcagtactagataatcagtggagcttatgttataagcatttacattctgttgaacatttgcagggtgaaacgaagccattcaagccatacagctataggtaccccacaccttataaggcttccggtagcacggcacctttctggtattctgtcaaaagagcatctgcttatattattgtcttggcatcatattcatcatatggtatgtaatatgatctagttgcgttttcttttgcatctgtattcaaagtacttagtaacaagcttcacaagtaaaattaaacacccacatgagcaacattgtgaataagtagtcagtcttacatgctttgggcaaacagaaacacacactgtacataacaatgaacttattaacttatactccatttgttgattgctaatagatggaataagataatttatcagttcttctgtttctttcccaggaaagtatactcctcagtacaagtggcttgaagctgagtttcccaaggttaacaggagtgaaacgccatggttgatagtgctattgcatgctccgtggtacaacagctataactatcactacatggaaggtgaaagcatgagagttatgtatgagccgtggttcgtcaagtacaaagttgacctcgtgtttgcaggacatgttcatgcctatgaacggacagtaagcacttacagttttttttcccctgaaaaatagttaaaactttgcatggggaatcaaatggaaatttcttgcaacttcattaggaactttagcacgcacttctttgtcgtctttatatttattagtatatacttgcatctagtaaaattaagttcaacgtgcttgtcgttttctttaaacaaaggagtgcttggttttactacttttttttaaactggtacggagcatgtatagctttactactgatactctgcttagagtagtactagtaccttaatcttgagctgctgacatagacttattttctctgattgcagcacaggatatcaaatgtcgcgtacaacattgtgaatggccagtgcactccagtccatgatcagtctgctccagtctacataaccatcggagatggaggaaaccaggaaggactggccaccaagtaagaatccttttttcgcttccaccaaccgttttcagttcctgaacgctgacaagatatcatgtgcaattgctgggaaaaaaaaacaaatataatgcagcatgacggcgccgcagcctggctactcggccttcagggagtcgagcttcgggcacgccatcctggacatcaagaacaggacgcacgcgtactacacgtggcaccgcaaccaggacggcaacgctgtggcggctgactccatgtggttcaccaacagatactggcagccgacggatgaatctttggacgactcccagtgatctgagtcgttcgtacatggtttactcacacctgctcctcctccctagtttgtgttgtggttcttctacgtgaataagcactggctcgatttgaacacacaggacggactcacggacgcctccggttcaggcgtcgtgatctaggtggttctttctccgctccagctccctcgtggccgtgtgctgcttgtgtatagaagaagcgcagctcacgtgcagcgagaggaaaagaaagctgagaaattgcgagttgatacttgataggcttgtgtacgttcgtactcgtctagatgttgaataaacacattggtttcgtggcgttgcgacttgcatttgacaatccgagtgggagtaacatgggcttctggcaagctgtggcttgtgccaaatcctaggaatccgttattatcagtcttttcgaatacttcaaatgtcgacaacaaactgataataacatcaattcagacttatcagtaaatcccctgaataatactactctaaatatgactgtatctagttctaaatcccctaaattgtaaatataacgatgcaaacattcagtagtaggtggcgtctatcccagccctatctagattggtttttttttttaaggacggagggagtacggagaagcactgggtcgacagcagctcactaatgttgagagattaaatacaccttaataagattagtaagcaaaggctctggtaactgccgtttgggccagagattagatagcctcaagttaagcaacgcagcagtccacagcaccaaaatgaacatttgtacatacatataaattgtcaagacaagcacaagtcgtcagattcccttgccaagacataaacatagcaattcaaaatggcagaaccaagcatatgacttcttgtacaggttaagtagcaaattttcaacgaaacagaactaagccctaacacatgtacttgaacttctgtccattgtagtatccgtatttgtggcgagtccgggtttcattacggggcagatcgtccggatgacaccaaaatggcttgggcacgggccagctgttataaaaaaaatgtatagggtacaataatgctatcaacaaacaaatcaacaaccaaatgcaaaacattgtaatttaactgcgatatgaggtgcaccagaatacctatttggccgaacactacgatctccagtcatagtccaatcaagcacaccagatgaagtgtcaccattgccaactttattgatagtcctgccaagcacaccaatggatagttttaacacatttgtgcttcggactgaagtaccgaaccagattcatcaagacgagcgcacaaacacatgcacatacgaacacaaattctaggagtacctttcttcatcaaaacgtgacagaacgtggaggataacggtgcatgataggaatggggttcctactatgtcatcaaagaagttgataccaacatatctcccatcaaaatcaataagaggccctccaatcccagcctaaccaggttacatggacaagttaatcatagtaccaacaaatgagactacatgcaactatttacttccaccatgtaaaagtaggcaacaaaaagtctcctcccataccttggtgattttaaaattgg

SEQ ID NO: 36086 - DNA, 20066 bp, Oryza sativa
agcactaaaactaggatagtgcaactgcaagacactatagcatatagtatgtattgtgaatatcaaatgagagctaaatttgcacttgtgaggataaaataaaaaatgatgatgaattgcatacaagagaaatatttgggggtggctttgtgctcaccttctagaagggacttaggcatctcaattgagagtcttcctccaaccctgcgaaagagcatcaacatgagtacttctccaaaggaaaaaatggatcaaaaccagtgcatcaatatgcaacatctgcatttacacaaaatgtaggaataaatatgacctgagtacaatggatatgattattttaataaaacaaaagataattgaaaggatgtttatacagaacctcagtgccacgaaacaacacaatcttttttaatgtgcacgtctatctattaacttattaaaggaatagaaaacgaaggctccacgttcgctctaatagcctagaaattctcatattaatcggagaaaaagaaaaaaacggagtccacaaaggaatacaatttaaaatagctgaaattcggaattaaaaataacgaatataggaagagaagactagagtccatcctggtatacaatttagaactaattgaatttcggaattaaaaataagaaaattaaaagcagagattctgtccatatagaaatatttataattaaaatttgaaattagaaaataaggaatattgaaagaaaagtgtagaatccatatagatatacaatttagaaacaataaaaattcaaaatttttaaaaataaggaatattacaagaatagtctagagtccacatagtaatttagaactaattgaaattcagaataaaaataataaattaaaagttgagtttagagtccatatagaaattcaatttataaataattaaaatccaaaattttaaaaaaagaaatattggaagaatattatagagtccatatgggaatacaatttagaaataactaaaattcggattaaaaaaaaggaatattgaaagacgagtttagattccatgtagacatataataataaatatcagaaattcggaatttaaaaataaaaaatattgaaagaagggtttaaagtatatataggtgtaagatttataaataatgaaaaatttagaattaaaaaaaataaaagaatattgaaagaagagtcatgatcatataaaaatacaaaataactaaagtttagaattaaacaaataattaataactattgcgtatatagaatacaatatgaatattacacattggttagtttggtcaagttagtacacaatttaaaataaaattatattataattttaatatattttaataatgaaatgtaaaatatatatgctattatgtgagaaaaaaatataaggatgctagccgcgcaatctgcgcgcgccatcatgctagttctaatatgaacaaaatgccttttaattagaaaaatatattgccttcaacaattgattcaagaaatataagaatgaattcatagtcacaattgcaaatctagtttgctatagagaaaccgtgaaacatgctaataggacaactagtgtaaccctaatatcttggtagaggtagcaaagaatcaagttgttattattcaatacctacatgccttataagtggttgaaaagttcaaaatagattttttttttcggaaaatgtataaagcatacctgattgccttcaattttgttgccaatgcaaaaaatttcctccttcggtaggatgtccgaaaatactccaaccgttcaataattatactgatcggcaggaaaagggatcttcccacaagaaataaaaggttcatgccaataaggttcccatcagaatcaaacagtgccccaccttcccaaccctagcatgtaaacaaaatggcaggcaacaagggttacataggaactaatcaacaaaatagagttatacagaacacgggttgcatacaaatgatgcctacaagtgcatttagtaatagagatagatcgaagaacttctgtttaaagtatacctcagagattttacatgtggacaacataaactcttcagcatcttcagatccatttgaatcgctaattagcatcccatctgtggtgattaatttgccagagatatcacgtcctacagctactaccttactcccggacagatatttcatcacgtgattgggaagcacctcgtgaacattaaggaaggtcatgactttgacaaaagcaatttcgtgatctaaatcatattcatccaaacaccctacgacaaaattgccttcacagcgcacttcgatctataattatactgcgatgttatcgaatgatcgcaattatatcttatgtaaacagcaaaaaatagtaaaggatggttagcaacaccacctttaagttatcacggtcttttgttttatcattgaaagctttaaccaaacttgctgaagtcaaaaaccttgtgaagttacgcttgtgttctatagttatgcctgagcatgcaaacaacacagagtgtcctacacaagaagagtaacttagatcatttatacctagcaacgttaataaatatatatttggcaaaccaagaagagtataacaacgtaatcaccatcagataaagcaagtgatacgacattactaaaattggatgggacctcttcaatgagttcacctaattaaacaaacatagcacaactgagtactcaaatagagctacaagaaacatgaacacacacgcgtgtgcgcgcacacacacagagagagcaaaccagatatctcctctccattgcaagatcttttactcgtacttgggcttatggtgatatcatcaagaccccttttcaatgtcagcatctttccaacactgacacagaaacaataaaaaaaatgccaaatgtgggtcaataaccagtaaaaaccgttgtaaaaccatcacagtttcatagccctatatgtgcctttaagcagttgcggaggacgaaaaaaaaaaagtgtgcctcatgaaacattatctccatgcaaagagttagcatcaattacacaatcacaaatttgtacatttttaaatttgcaatgctctggaattctaaaccatcgaacaaatatatcacctcttcgtgatgccaagaccttcctctgcctctctctttctaaccattttcttgttttgttgccttgctccttagctccttggcttccccttctgcctaggcctgcggcgcagactgccggcctcccgcgccgtcgagccgtcgagccgtccgtcgccgctcgccagccgccacgagatgacagagttggaagaggctagggaatttttatctagggttcagtgaagaagcccaatgggccttttacgaagtgtcggggggatcatcagaagatgggccttttatgaagacgtcaggagactcaggacgagaaccggacacaagtcgtcacggggaaaagaaaaagggaaaaaaaagagaaagaaacggtgacttttgccaactaattctcccgtacgcccgagatccgaagcggctcgcgcggccgccacatcttccgatcctctcgccggcgggcgcgcgcgcgcggcggcggcggggcaaaaatggaggcaacggccggcggctccaccgcctccgcggcggcgtgcccgcccgccccatcccggccgacggacccggacttcctcagctgcgtgctccagcccccgacaccctcctcctcctcctcccgccccgacgacgactacgccgccctccgccgcctcctcctccgccgcaagcccccctcggcgctccaacaccgtatggtacgcccttcctctcgttcttctcagatccctcattggcgcgcgtagtgttttttttttggccatggggaatgaatgaattgggttggattgggtgggtgggtggtgatgcaggagtggcggtgcaacgggaagggctacgtcgcctaccgcaacttcctcctccgccgcatcgacggtggcgccgcctccagctgcgccagcacgtccagcaacaggtgcgtcttgattttgtttcgttttttttttcttccgcacctcgtcgccctgcccttacctaacgaaacgagaacaaaaaaaatgtagccaggctcgctacctttgtgtgtctctgagcttttcttatgctcatccactagttttctcttaagattaatcatttgaatatgtagtatgattttggaggtgaattctaacactgtggatattgcaatttaccagtggaaggtgggctccttctcctgcctatgctgcattctccgaggcggatagctggagttctagcaaggttggtatcttttattgtttgctgcattagccacattgtaaattatcgttgatacaccattacatttgtgcggatacctttgtggagtgatcacaacttgttgtgaattgtcatgtacttgtttgctgcaggacttgagaaggaacagcggaccattgctccgcaatcttagtatcagctcaaagcagagtgatcctgagcgtcatgtcagatttgccgagcctgcatactcatttgttggaatgcattgcatctttgacgactgcaaagcatcaggtttgttgccttatagtcatggtgcacaatttcaaaatttcatctctgacggtaataaattattgttgttttagtgatctggataatatattaacgaaagtttgattttactcccggcagttacaatattgaaatttggtcgtgcaagttcagatctacttacatatggtgcttctgatggcagtttaacagtctgccaggtttctgacccaccaactgttcttcaaaaattaatagggcattctaaagatattacaggttagagtacaatcattacttgtttatatggttttatttatgtacctacgtggctcaggaaaagtgcttagcttctagtacaagggtgttactagggatgatcaaattgcatatgaagctaagtgcaaaaatcagcattgcaatgtaccctcaatgttactgggatcttattcgatgcttatcttaataatatagaatgatagttcagttaattgtgacttcccaatattttaaatgcctatcatgctgtttgtaacatcaatagtatctcctagtgctgagcatttacaattgctgcacatgtagtttttgtttgttatagccacaaaaaagttgcatgaataatttatggatttggatggatgctaattaaaacagaataattgagttgtacttatctattatttcaatgtttagtatttagtgagcttcgaattctaactgcattacagattttgatttttcatctaataaccagtacatagcttcgtgctccatggataaaactatgagagtatgggagatctcaaaaggcacttgtatcagggttgtatatggggtttcttcccagctatgtatctgctttcatcctgtaagtcccgcctttgcagaatgcatacttatcccattcgcttgttggcaccaatcttatttgcacttcgcattcataaaaattatttgtgtagtaaccaggatggatggtctactttatcatatgtttactgggttttctttcttctttttttttttgcaggtgaataataatttactgttagttggcaatgcaaacagggaaatcaatgtacgattcctgaccttttgctcccagcaattcatatactccaatattttgcctgctgattaatctgcgccttcccttgaatgttctgttttgtgatagtaatggaaaaatgaatgtgttattcttattctggttatttattcactaaagatgattttcttctgattaaattagaaaatatatcacctaatgactaccatttcccctttacattcttttgcttgtaccttttaatgtcgatggttgtgatccatatctctatctattataggccattaattttagcactgggagaatagtcagcaagcttacctttgatgatgcggttacagctttggatgttgatcacactggacaacttatttttgctggggacgctcaggtatccattgatttggtttgtttttactgctaaaatgaatatacgatgttcataattttcaattggtaattgaaatgtgtagggttgcatatatactgttagtgtgaattcacacacgggttcattatctagaactcataagaacaagagcaataaaagcaaatctcctgttacaaccatccaataccgcaccttctctctggtggcacgttgcccagtcctcctttcttgtgttcaaaatggaaacttgtttttcttcaggtgcgtgatcattactgtatgttatgctgttaactctacttttttgtaactatttgtgttgttggtcatttcagcattgcaacagattccaagggatacttgaccctaatatgctccctaaaattggcgtcaccggtgcagagcatccgtgcttctttctgtccactcctttccctcgaaaaaggagaattcattggtgagtaaaaataaaacctttttttttccttttcagttgttgcttgttggttacctcaatcttaaagctgttgataatccaaactctcatttctgatactgttcatgtcagccagcactcaattgctactgcaaattttgtgtattgcctgccctcacatgttgtgttagcattatcctttgtaaacttgtcttttagttcaatgaagtagcaagccgacaatgacacttgacacaagttatcattacaaattttgttaattaattattttacaattttaattgaacttagtgagacaatgtatgatgactggctttggcaaataggtggaccattttgtaccctatgttctgttctttgtaatgcatagctgggtttttgtttaaatctgattcctttttcctcctgaatgtaaagtcacgggcagtgaggatgcaaatgtttacttctacgatttgacacggccaaagaactcgtgtgtaaataaacttcaggtatgttcagtgcttcttctatttttggaatcttaaactttggttccatggcaaaggtaccgatgaaactattttcattcgtgaagggacatggttctccagtaattggagtggcctggagtcatggggaaaatttgcttgcctcatctgattcagatggtacagttattgtatggaagcgggcataaactaattagagcggattccacaaaacgaaagttgcttgtataatgaaggcatttttggcgcatgttgtacctcccatcatatattgtttgtaagacacagaagatgaatcagccttcaattgtatttctacaaaagtatagttctccatagagtgtacagcggttcttcaggtacatcttacatatatttttgttcaatactaaaggggtaggaggtacagtataattctctttttgtaaactaaatttcatgagtttaaatggagtagttgcaccctgggtcagattctgtaaggtgaagaaggtttgtgtttgttataatccttcgttttttccgtctacgaatgagccattactgacttttgtattagacttcctgtcttgagaattggcgttttaccggttgaccgaagatctgccaaagaactttttctgcctttctcagctgtatgtgttttacagcggcaatgcgggaaaccatgtattgcaaacctaaaaaccactgtagtataaaaagaatgagcgtctgagatttatcgacactgtaagtaaaattcggggatgacatggacaaatctcatatgtttacttttcgttcctacagtaatttctaagtgtttacattacatacgtggtttgcgccatatattttccccagcaatgcaatggaacacatagctctatctagttcccgaggtgacaatatggcatatattcagctagctgagcatagcattgcaaatcacaaagaagcacacaaccggctagaatagtgtcactgaaagcactagaaacatggtactactaagttgctaacatcaggcaaccattctacccccccagacagacattatttctaccactccaagcaccatgactccatcaagctgctatagcgatggttactgcaaattgaacgtgaatgacaggattattcctagtgctactccgaaggcgagggctaacagcttgcaagtcccatcacaggtgtctgacgtccgaggcgctggcgaagaagtcatgtcgaaacgcaggacgcagtcgtcgctcaccacgacgccgacgccctctccctgctcctcccgacgtgcctcccggaagcatctcggtatctctcgcgccgcgccctccaggcactgcacgcagtccgccggcgcgacgcccgcggcgcactgcgccaccacgcgcccggccagccccgtcctcgtcgtggctgctccgacgtcgatcgccagcatccgcgccgccacgccgttgctcatgtcgaggaacgtcgcgtacaggttgtcgctgaacggcaggacgtctccggtgacgacccaccggtggaactcgccccccgctgggctgggcgacatcgtcgtgttggtgtcggcggcgtaggcggcgaggtagctgcggtagcacccgtcgagccaggcgccggcgcgggcgccgcagcccgcgacgacgtccgcgacggcggcggcgaggctctcgcggtacagcgccggcgtagagtcgccgaggcagacgctgagagcgagcgcgcggtcgccgccgccggcctgcgtggaggcgaacctcgtcgcggcggcctgggcggggaggtcgtcggtgggcagcgcgaggaggttcgcgcggaacgccgtgccgttgctgctgttggacgtcggcgccggcgaacagtcgatctgtgggaagtacctggctccggtggccgtcgacgtcacgcagacgagaaggaggcaagaaagcttggtgagcgccatgagcgatggattgcacgacaccaaggtcgccaggccggatacgaactgcatgccgtagctcgaagctacaccgctctttatgaaggcgatcgagtgagctcaatgccaccacactgtgcagctattaggcctttcacagcgctccaccctggaccggtgctatggggcgacacattggatttttgctgccgtggcgctcgaacccgcgtctcaagttggaacctcatctccatgttgagcgacgcaggacttcgtcaaaacgatgccgcgagcagaggagaagactggaggcgcgcgcgctgtgagcgttgtggcttcgcccacgcgtgccctcgtggcgaaatccaagggcgaaatccccgatacgccctccaaatccactcccaccacagcaaaatccagggcggcctcgccatctcgtcggacggcgccgcagttgccaccggggtgtccgacgagcagggaggcgcctagcacacttccagctgcatcaacccaaatcaaaatcaaaaccaaatcagaacaatgaaacaaatcaaagaacacaaatcgagggcaaggaaacaaaaatcaaacataaatcaacaaatctgaacacaccaccaacacacataccacgtcaccggcgagctcccaagaaacaaaaatggcggcggcggcgagatagatggacatacgtgtcgccggaggcagaagcgatcgaagcaagggagtgggggagggagaggggaggggcgggggacagatccaccgccgccgctgtcgccacgacgacctccatggcaactacggcctcctgcgccgcaaaggtgtagaagccatccgctcctgccgccggccgcccgttagcgccgtattgtccactcccgccgctcccaccgtcggcggcgcgccgtccactacagccgcccccacagctcctgagtccgagcgggaggaggagcgagcggcgtaggcagcgcgggcggagcgggcggcgcggtcgatggcgaggcgaggcgcacggcggcggtgtccccggcgtccgccgcgagggaggagagggaggagaaggcgaggcgaaggaggagacgtgctgagggggactcagcttgggtgacattgtaaaggcaagtcacagcgtgacattgggaagatctggaccatccgaaacaaatccaacggacatggcgcttggacccgcctgcaggtcgaaatttcgctgcccatccagcccctatccagcgcgggagacggcgcccgcccccgatccttcccgcgcgctcgcatcgtcgtttcgcctcgcccgcccgcgtccggccatcgctgtgagcacgaatcaactgggaggctcgccgccgtcgtgcctgcgcaggcctccgtgctcgccgcgagtgcggactgaaccgggccagccgccgcgcgaggccaactccctgccctgccgcgacctgtggaggccgccgaggcactgccctgccgagcgcgtggaggcggacggccgctgggcctgacggcgcggtggtgtagacggccggccgcccagcctgagcccggcgcgtggaggaggggacatcctggaggaggctgcgctgctaccagtcattggctgctgtcttgctaatcctacagatgacaacttctattgttacttgccaagtttttgccggctaattctaacatttgcatcagtcaggctctggaatggcacagctatcataaatgtgaaattcttttgtatggaggtgatcaatgctgaaactctgaactattcaggatttttaggtcctcaactgagaagagcagaggatagcacacaggacaacacagtaacttgaaaaaggagaaaaaaaaacccaatcaacacacattcacgcgctgagctgggcgcaccactgcaccagggcttgtctcaggtacttcatgaagccattaggctcgtctcctccacgcgccgagctgggcccaccagcgcgacgtctggaccggcagctggccgcgggccgcctccacgctcctccggccgtggcggcacggcagggcctggccccggcctagcgcggagatcgcctagtcccctccccactcacggtgagcccggcggtctggcgcctttccagtcacggcggcgacgagcctcccagctggctcccggcgacggccggacgcgggtgaggcgagcgtcgggcgcctcgcgcggtggtcaccccgtcccctccccactcgcggcgagcccggcgctccagtaacggcggcggcgcgtgctcccagttggctcgtggcggcggccgaacgagcgcactgctccacgcgttcaatggatggattggggctgggggagccgtctcccgtcgggatggatggattggggaataatttcgacctgcaggcgggcccaagcgccatctccgttggatttattttggatggtccagatcttcccaatgtcacgctgtgacttgccttcgcaatgtcacccaagctgagtcctgctaagggtgaggggtaggtgaggaaaataaatttggggtcgcgtcctgtgtcctcctgtagggtatcgcttcgtttccttcacggcttcacctctctctctctatccaattaagccacacatatatgggtgctttcactgtggggtgagtgtctttgagttgtgactttggactagggatatgggccccatagcttgcactgctattgcccttagctatagccgctgcctctctgcgcggttggaccagggttcataatttcagctcgaaatttcggttctatcagaccacgatacaataatatttcggctgaattttttttcatttttttcataaatttggtaatattttgttcaaatttaaccaaattttattcaaaaattcatatgatttcggatcaaaatttcagaattttgaaaatttcggtatttcgaccaccaccaagtcaaaacactaaaccgaaaaattaaaccctcggctggacacgcacgcgccacaactcgaaatggcacgggaggttagcacgcgtcattgcagtagctgcaagtaagcactgtgaatggccaacgggtaattgcggcgaaaagctccgccgaattcgctaatcaagagggcgtcactccgaacttactcagccgaaagttgtttccctagctagttcacccgttgctcgaattggctggacttctctccctttactcgcttattaagcgctatgctcttctattttcgtgagcttacggtcttaagcgttgtcattcctggcaggtctgttcggcacgaaactccggtgcaattaagtcctatggcggcaactaaatcctagccaatggcggcaaacttcaacggtgctagattggtgggaggctaccgcaaacatgcaagagacacctaagaagatactccgcactttgatgttgttggtcgcctgggagatatggaacaaaaggaatcgcagaaccttccaacagaaggagctttcagctacctctcttttagccaagatcaaggaagaggtcaaaacttgggccttagcaggagcgagaagtcttaatagctggctttcttttagttaactcggaccaaaggtcctaactcctttcctttttttctttcgctttgtaaaattctccttctctattcaataaaattggcgctcgtcgattcgttcaaaaagaaaagtcctatggactatggtgtgtgctaccagtttaacaatttctcatgggtcaatgagttggggttgttgaaacttggccggcgcaaaacacgttgcaagattgttgtcatggggagtaagatggactaacgtgtaagcatgtttgctgtcagtaatatacattttttttcctttttgttctacctcttgctatgtgcataaactccttttattaatataacgccaagcaggccattccaaaaaccttttcccatgggtcattaactactgcaccttcccgtaccaagcattgctagcaattaatagcttgcaacgccatgtctagggatgaaacgattggaaaacaacatgcatcagccgtttaagtaatcatatatttctcggaaacgaaccgataacgatgaggctgaaaacaaaatgatatcaaaaatactgaaaacgtgactacatgaacaaaaccatgtcaatatcgatcggaaaccagtaatgaatatcgaaaacattaaactcgatgtttaacttaacatgactatataatattgtctctcctctagccttgtactcaaattagaaatttgataaatatttatgggtctcaaaactacgggtcacgggtcacatagatacatggacgataaatattgagatatttaaaaatacggtgattaccgtattataaatgtagcatttttcatgagactttggtaaattaaagaaacggttggtagaacaataaaatcgtttttttatttttaccatttctatttttagttattgttttcactcctgtgatggcaaaggcaaactggtcaccattgcttcctacgcatccgagttagccgcaggctatttcataacgtatagttgtgaattgtgagattttcttttagtttcacagtgtatggtggcgcaccggcagtccggcacatcccggccttgccccgataccacgactggccctcaaaagccttatcttttcacttatgcttatacttatcagctaaaacttaaattttctatcttagatttaaatttaattttgaggggtttttttatcgaaatttatttttcagtctttgcttttagatcggtaaaaacatgtatataaaagttttattcacaattttttttttttgcaaatatgcccgcgtcgcggtcacggtcgcgtagtcgcgcgcgcgcggcgaacgcgtgtgcgtcgtgcggggtgattctgttcaccgccccatgggccgcacaaaggggtccaatctttcaccctgcagaatgggttggcggtggacgctcgtaacactagcggctagctgggcaaagcattttgcaaacaaaacaccacattataagctactgttatcctaacacataatccctagtactacatatgaccatttatgtctactactcgatcgaccaccatgactccatgaaagcttatctacaggtggttatattactgcaaattgtcttcactcgattcgaacatgacgactactactactacatgattattgctagcgctgctgctccaacggcgagggcaaacggacggagagctcctccaccaaggcttgccgccggagaggccaggtgcatggtgaacttggagcacgcagtcgtagctcagcgcgacagcgacgctctctcccagcccccatgcgttccagcagcatctcggcatcgctcgcgccgagtcctgcaggcactgcacgcagtccgccggcgcgcggcccgccgcgcactgcgccagcacgctccccgccagccccgtgttggcgccgtcgtcgaactcctgcgtcgccgccagcatcgtccgccccgaccccgaccggttcgcggcggcggcggcgagcgccgacacggcgccgttggccaggtcgaggaacgtcgggtccaggttgtcgctgaacggcaggatgtcgccgtcgaagaaccaccggtggaacgcgctctcgcggggcgaggtcgcgtcggtgtcggcgtaggcgaggtagcacccgctgagccacgcgccggcgcggcgggtgtccgcgccgcagccttcggcgacgtcgatgacggcggcagcgaggcagtcgcggcactgcgacggcgtggagtcgccgaggcaggagccgcgagcgaacgcgcggtcgtcgtcgtcgccgccaggcgcccgtccgccggcgccggcctgcatggaggcgaaacccgtcggcgcggcctggtcggggaggctggcgagcagcgtgaggaggttggcgcggaacgcggtgccgttgctgccagtggacgtcgccatcggtgccggggagcagtcgatctgagggaagtagccggtcgtgtagagctgagtaccgcgggctacaatggcgctcgcgccgccgacgacgacgaggaggagctgggcgacgaggaggagggaggaaagctttctgagcgccatgagcgatggatggcacgacaccaaaaggtgtgttctatggcaatgggcggatcgaaggagtcaaggaggcgggagcagactacggctgtatttagttcagcccaaagtttaaaatttggttaaaattagagatgatgtgactttaaagttgtctgtgtatgaaaggtttgatgtgatagaaagttgaaagtttggaaaaaaaactttggaactaaggctgtgtttagattcaaactttcaactttttccatcacatcaacatatcatacacataacttttcaatcacatcatactaacttcaacccaaactttcaacttttgaaggaactaaacacacagcctaaacacagcctaccagtgtgagcagtggtcgacagagccgttgcgctactacccgaaatggcacctgagggatgggggtagcacgcgccattgcaccagctgcaagcgagcacagcgtgcgaatggcaaccggcaattgccgcgaaaggctcacgccgattcgagaatcaggagggggcgcgttacgttctactgatccctagctcgctgcagacgacgacgcggccggtcaccacccgttgctcgaattggccctctctccccttactcgcttgtattttggtgagcttatgtttatgctaggtatagcagagaggtgccattcctggttgatctgatccgctcggcacgaaacttcgacgcaagtccatcctctggtggcttagcagagttaccatttcttcatgggccattattggcgcttttcccgttccgagtattgctagcaatagcttgcgttgcacatgtcagtggcaaaaggaaaacttgcctgttgagaggcaatatcgctgaagccacgcctctcgatcgaatcgaaaccatccaaagaacaaggcgattagagattcaaattttaaatagaaattcaaaatttgaaaatccgtttttttcttcaaaattttatactcaaatttgcaaaacccaaatcacaataagaaactttaagcgctctgcattgaaagcttaaaaaaactattcccaaatttaaaacatttaactcaaattttgaaattttcaactaaaaattaaaaaacatctacccggatctgaaaaactttcaaattctgaaatgcccaactaaaaatttaacttttattgaaaaaacaaaaaactctacccaagatttaaaacttccagcacaaattttataactttcaaccctatcatttaggtatttcattatacgcgttggcataaactgaaagaaaagactgttgttaggcttgtattgtgtcgtctagttgcaactctcatgtgtacaagaagggcgaagacgacttctattgctagcccaacggtgccaactagctgctccgcatcagggtttacaaaaccaatgaattcgattggattttgctaaaaaccaacgtttctacgtgactcggcaatagttctcctctaaatcgatgggtttcttccaaattcaaatttggattaaaaaaagtgaaaatatttagaaaaaatactataaatagtatggtataggtagaacctattggcatataattttttttagaaaaatgctgaattccaaatatgtcatccttgttaaaaaaatgttaaaaaaaactaaggaggtgttctgtgctgaactctaaagttgtactaatgggctttaatttagatggtgggcattctatttgggcaacggttggtgaaggatgtcaagatgcatattgaattgtgcgtgaaatgtcatatgtgttctaaattattgccttctatgaatttgtatagcatattgtgtgtatgccaatgtgaagttatcaaatttataggaaatggaccaaaatttttagaaaatttccccatttttttagccttttttttcagtattttctacatttttaggaaaccggcttgcgcggctgcacacgttgcaccactgctcgaaatggcaccggaaggggaaggtgttatcccaagttcgccatgcaaagacgacgaagctgccaccgcccctttctcgaactggccttctctcttcactcgcctgagctgagatgctcgaattggcattctctccaaacaacataggccggtccaccccaaacaacaaaattcatttcggaccttactattcatcacctgtaagttcaagtgtcttaatttagttttggtgattaatgacaaatctaataatatgagactaacgtttttatgagcttctctttaactagtctcgtttagatatgaaaataaaaatgatgagaggtatgtattaaacttcacatattctaacttggtctctcttgtggatccaaaatatagtgtgagctccgtcattaatcttgattgattatgtgcatatgtattcctttatatccatatgtatgcacatcttgagggggagcttattatatattttgtttattataagatctctaccttgatttgaaatcatctttcatcccatctctctatattgtttatatcgggttattatctatcaccaaaaagagaaaagattgaaagatcttggattaaacaatttgtgtaattgttgctttgatgatagatgataaaccgatgtttatgggattaacctctctttttcataagttgttaactaggttatttcccgatgatgagatgtggtagatatgcattctttagtgatggaccttaatcatgataaggatgaaatgcatggagataaaacgatatgtaccacttcttatctcctactttttgataggttcatatatatgatttccatgttattgttatataagtgtgagactaatgtttactcgagtcgtatcttatttagtctcatttacattaagaacatggagatcatgaatgtatatgttttatgttggtctacatctttactacatatgccttctctatgtgtataggataaacccccattggtcattctctaattatgcatacacttgcatctcttgtatatttatttgtatgcatatatttagggggggcaaatcctatacatttattgtgcatgttctagatccatgttattcacctattatttatatcggatctttgcacttaaggttgcatacgagtatatgacacttgtgatgttaatgaatactcaagaaacatatccatatctttcatatgcaaccggttggtcatcaagtgaaggatgacaaccgatttgttgagactaatgttctcctttgagatgtgaaaaggaataggtcccactatgatgaggctgatggatgacaccatgggttaatggtcaccaagccaaggacatcgccatgttggtaagaatgaaatcaagcttgtaatgagaagaaagtcttgacaaatgatggtaaataccttggtataaacatggttgaatcaaatggtcacaagtgttgatctcgactcaagcttgaccccaagatggattttgcaaggcaaaggtataatgtagctaagaatgttttcttagccttttcccggtcttgatgtttggtgtagaccggatttgctagataggcgccgtactatcaagaggggtctatgaagcgagcttgtggatgatcttgtgccttattagttcatatgcatgtaggtgtatttggtgggcttgtctagccaagtgtggtgagttttctcaagtcctaaacaaagagatatgtgggcaaatcctataggtttgggtagcctcatgtggttatgtccggtggagtatcctttggagtgtgagccctttctccctgagaaaatttgtgtttcttggatggattgttcatgggttggatagccctttgaataagctttccataaagtccaagaacgccaaattccgagacccgagtcaagagatatcgtcgttttactaacggtcggttgagctgaaaagtgaattgcggtatgaccgtgggccttaggccggtctgaccggccccacaggtctggtttttggtggcgatacagagccgccagagccgcaaccagtcagaccgagccgacggcggtctgaccgagccgtggacggtctgaccggccactacactgtggtcagaccgaccaggttgagtaggctcaatgattgccctgtaacggctagttttctagccgttacaaagtagtccggtctgaccagcctcacaacagcggtctgaccgacagagcacagagttggggatttcggttccaacggctagttttggtggttgggggtatatatatacccactccccagcagcaagggtaaagttttggcactccattgcattatcttgaacccttgcaagagctctcacacccttgtgcacttagtttttctagtgaggtgttagagagtgagttaagccaatccaagtgcattgcttcattgttatagctagtgtggcacttgatcatcctcggcaagcatcctagacttgttactcttggaggttgccgcctcctagacggcttgtgtaggtgttgcccggtgacctctccgaggagattgtggaggaggcccggcgccgtttgtgagttgtttggagttcaccaccttcggagtgaaggaagaactaccccgagtgatcgaggcttgggtagtcctctccgtgggccagctcccgccttgcccaccccttgacaaaggaggcgtgcggtggcttcgtggttgagcggtggagttgggctcgcctcaacagggattaggaaaccggcgagtttccgaacctcagtgaaaaattccttgtctattgtctcatttatttgttgcatttacatttgtgctatttacattcatagagacatatttgagcctatatcacctaggtttacaaaacttaacttagttgcttagttaaccttgcaccttaccttgcctagcaacttaggttagttttgtttaagtgccattaagttttaaaaccgcctattcaccccccctctagtcggcctccttgatcctacataacccctatgtacgagcaacactaacgcgtactatgattctaaggtcctgtttgatacagctccaacttctaaatttagctccaagagttgagtctggagtggagttg

SEQ ID NO: 36087 - DNA, 10922 bp, Oryza sativa
  unsure (1)..(10922): unsure at all n locations
acgtggagtggttgtgtcgtccagcatcagcgccgcgcggccgacgcgtcgggccggagcccggttaaatttcttctgcacgcagctgagcatctcggcacgaggctactccctgcccagcgacgccgcgtcgccgacgtaccgcctccgctataccgatccggcacctcatttgtcacatacccgtgccttcaggcacgggaggggagaaagggtgtgcatatagatggccatatggcccacccggcacggcccggcccaggcccggcctaggcacggcccgaggcgatcgggccggcacggcacgcctggcacttcgtgccatgccgtgcctgcccacgggctgaacctcaggcccaggcacggcccgacagcagtcgtgccgggtcgtgtcggcccgacggcacgctgagcccaccgtgcccgggccagcccaggcacgccaaacactaactgccacttgttcacttcagttttgcacatacatatcgaaaatgccatgtccatcacaaaaatcagcacaaaaccatccaattcacaagttaacagatcacaatatcacaagtctcagattacaatatcacaattcacaagttatatagtatgtgcagtatgacaattcaattcactaactcaacttctaagtctcacagttcacaactcaagtcacaaatccacaatcacaaaacactttcaaatactaagtctaacagttcacaaatcacagttcaaactcaagtgatcagtcacaaacactttcaaaaataatagtagctgtgtagtgcaatggttgcctcattaaaaacctttctaggtaaaaactcacacctcgtgagaaaaccctagaaaggaaaaagagtgcatcccacagctttcatctaattatcacattaaagtccaagtccagtacaatcatccagttccagtggcactgccactggttacatcatcaagacataaattctcaaacgattttataagctctacattctcagcagtgtgctgcaacttcttgtctgcctgcacccagtccttgatcaatgccaaagcttgcaccatgttaggacctagacgtcgtcgtcgctcctcgatgatcctgccagttaagctaaaagcagactccgacgatatagtagaaacaggaacagtcaagacatctctagctaatatggacagaacaggatatgtgtgtttgtgctcatgccaccagtttaggatattgaagtcatcgtcgaattggttgacagtgtcactatcaagataggcagacaactcagaggcattcaagttagcattagaagaaacagcctgaatcaaagcagtagcagaagttctcctggaaaatggaccagcaccaagtccagaacctggactggcactagcaccaagtccagcaccaagtccagaacctggactggcaccagcaccatgtccaagtgcatcactggcaccaaaaatctttccccaggctatctttttcttaccagcagtacaacctggggttattctttgcaatctcacagcaccaaacttactttcatactaagagaaaatgtcagacaatgcagccctaacctcagttaaataagtagagtaatcagaggtcaaaatttgtgacataatttgtagaacattgctaaaacctctgatcttagccctaggatccaagataaaagcaaatgaatacagaaatggaatctcagaccagtatgccaagaacttacttttcatgggaacaacaacatttctaaagttattatcattctcataagtgttaagatgtccagcaatctcaagaatgtgatgcataattaatggagatgttggataataaacaccagacaaaataacagttgaatcataaaattgttcaaggaataaaagcacagtttcaacaattgtccagtgcaaatcagtaagcaatagtctaccattttccctaggataatgagtttcaataaacaatgaaaaaagctccttatgtgggaagagatgcttgagcattagataaagtgcattccatttaacatccatgttcaaaccaaacttaaaatgttggacacccttaaccaatacaccggttttggtataaagcaatgcgctgattagatgcattcacaaatgagatggctgttctaaaatcttgaagcatgggtttgaaaacttctagaccagccttaacaatcaagttgattatatgacatgcacagcgctgatgcaaatataaatcaccaacatatgcagacaacttaggttttagaaaatccattgccttagtattagaagaggcattgtctagagtaatagaaaaaaccttatcagtcaaaccatattcttcaacaacagaaagcacacgttcagtaatattctcagcagtgtgcttcacatcaatcagcaccaaacccaaaatccttttctctaattgccaatcagaattaacaaaatgagcaacaacacttaaataatcctccttagcattaccagaccatatatcagatgtcaaagcaacagagttaacagacttgaacctctcaataagcatagcacgactcttgtcaaagtacttaaaaacatctctactaatagtttgcctagagacagcttggaatctagggttatgaacattctgaatgtactcctcaaaagtaggagattgaccaaaattcagtggtagatcctctacagcaatcaatttaaccaactcagttctagcataatcaggatcatattcccatggacgaacagtaccatcagcattgagcttaagcatagactgtgacaaattactagcagttctaggtttgcatgacttgagatgcctaagcaaatgaccagtgccaccagatgaatgagcagacaaagttttttttgcagtgattgcatttagcagaaatgcgaaccttcgcgccattgcgtgattcaaagtgttcttcgaagtcatcccataccttggatgatcttggccgcttgttggtagcactggagtcggtgccggacaacgcgcctgagccaccatcaccgtcaccgccaccggtaccgtccacgtccggctccgtctccggctgcgacccatcgaagtgaggaggtgacgaagtgattccgaacacctgcacatgttcctcctccaagtcatcttcgtcatcaccccgcatccccatcaacctcaactcgtggttgcaagaggatggatcgtccatcgtcggcactccggttcctcaacggcggctaccgctcagcgacctgcaagacacacagaatgagagaagagagcagttagggaccggagagaagtagaaaaccaagagaggagagaagagcagagataggtgtgtacggtgtacctgcgcatccggagcaccggagttgccgttgatgatagagatcgacggatctacgagaagaagatagcagagactgggtttggggagtgatgtgacaaagagctcacggagaaacggtgagcgggcgatagtggcaaaaaaaatgaaaaagaaagaggaaatcgagagcacggccaacgatccaaagactggagaggcggagatgagacaaggtcacggatccggcgaggcagcgaccctcggtggtagatccggcaaggcgttcatcagagacggcgacggagagggatggagagatggaggcgtggtcgcgtggaggtggaggcgtggatcgacggagcggaagcggaggcggagcggtcaaggcggaggcggaggcggaggcgtgcgtggatcggcggaggcggctagggttagggttagggttgtgagggaggcggactggcggaggcgagaggacgcggtggcctttatatatgaggcgtgggcacgcggcggcggctcccgatgggcctcgtcgggccgtgcctaccgttatacaggcctgggccgtgtcggcccatcgtgccgtgccggcccatcgtgccgtgccggcccagcgtgctgctgcgggagcctaggcatggcccggctgtcgggccaggccggcacgggcacgaacactgacgggccgggccgtgcttgggccgggcagtcgggctgcgggccatatggccatctataggtgtgcagtttgtaacagcgtgtagtgaggcgtgtttcatctacagggtactagtatctactggtgctgcttgatttttgtcaggcgtgtgcttacgtagctcagcaattttggaccgtgatgggggttggcggcatcggtcttcgcatgagcacaatgaccccgaaggcccgaagcagaacatgtccgacttggtggacacatgcccgcacctactgcacgaacaacagcggatccagaaaaaaatagcagtatgatctgagcaaactatataaagttatagtccaccaacccatctacgtatggtaaaaaaatttagtggggtcttcgtggaggttctcatagtcttcacacctgtagtgaggctcgagacaccactgcccccatgctggatccgcccctgtgcacgaatcacaccatgaaaattacttagagcggatacaataaactgattcagcatgcatgctccaaaatacgacatatcatcttattcttatatggatgggaaaaaattgagaagggagagaaaagtgggcgactaatctggcgccggtgctagcacggcctcacacgctcatgcagccgtgaagacgattaagagcaagtttaatagtaggctgtaaaccgactataaatttatatggaagaaagataatttaaaaaataaagagggttgactcttatacaagagctagccattcacatacttcaagataaatacattaaatgcaaaggtgagagatagagagaggaggagaaaaatagagataaccttatggctgatctactatatatgttaacctaatataagctataagctcatacttggctctattattaaacttgctctaacagcatttacaatgctccacgctatacagtggccaacaattttcttttttaattatttttacatatattaacactaaacatatccaacgtgtctcgagctctcaagctactactgtactcttggacttcgatggggagagccatggctgcggtggagctcggggcttgtcacaaagacaatggtagagttgaaggtcggtggagaatctagtacatggaggttaggtggggtgcctacctcgtgaatgtgggggtggataattaagctcatgagacgacaacgaacaatgaatgagctcggggatataaagctcgatgtaggagatgcttgagcttgcgagctcacctctgcgagcttgtggaggaggaggtgatggagttcgaggatgtagagagttcatatggagcttaacgatagaagctcaacaagaagacatagtggatctggagcttatctgcaatgataagacaatgattagaaccatgaaactcgacgaaggagcttaacacgttattagaactcaatctcacctatgcggagtctatgaagcatgaggcactggagtttaaagaactgcccttaccgtcggctgatatagtcaataagtaagttagctggtaaatggggagtatataagatagtcctgatttgtcggcttgtcattttcttaaaaaactttgctagactgtaagattagtttcacgtaagtggaaatcattccgatttagatgaagggatataaattaaaagtttttgggttggatagtcttctataaagtaaaaaaaggtggagtatgttttaaacaaataaaattcatgagattattaaatggacttatttctttggtcgtagtattattttctgttggcccgtcttaagttgttagaaagagagaataggatagtggcaagaggtgtgtggtttttttttcttaaactccaaatctcttttttttttcaagtcgtcgaaagaaaagtcgttaataacctgaagagactctcccaagacagaaggagagaaaaataatgcactcgtgtaacttaaatagtgtagtttagcaaattcgttaaaatccccttttgggaatcttcggcctccccagcggcaggcaggcagcgcggcggcacggcagcctctctcccctcctcctcctgctgcccgcgtcccccctttacctcgcatccgccgcggatctccgcctctcccgccatgatggacctggatccccgcctctacgagaacgtcgtaagctctcattctacctacgcaccctgcgcccttcctccccacctcatctttgattacctctcgcaactcgattgctttaagtattccttgttggttagtaggtaggttttctaggaacccatctctgctgttgctggaggaggggggcaaagtaggtgctttagcgaatcttgtttgcttcgagcgctgccattatgtgcccctgcttgatcttttctccgtctgggtgcgaattcggctttcttgtgtaggttggatccgtttagtggggaggatgcgatggttagtttggttgtttgggggtgctcatgctagggcttttggtgaagaaagatcgggaatttgttgataaggtgcttgcagtgcaaaaaaatcggtacttccacgatgaggtaggttgaagtggtcaaatcaggaactttcttcattatgtgtggcttctagtgcagaaaaagataggattttactgaaatcgggcggaattaattggcatgagcgctggaatccagcagaatgaattggcattctactggttatgacttaggcggcatgccatgccatgccagcaaccacagcttaacgtatcattctcttcggcaatactccagggggaaatccttgttgaacaggttgtgctgagtgtaaagtttgaaccaacagtgcacatgtttctctgtcatgtatttgttgaataagaccttgggatactggagcattttagacagtagtgcccatttggtaaaatctaggtaaaaggggtatgcctgatatttttccacaaattgatgtgacaccaaagctagcgaaaacgtggtgttgaagtcttttctgttgttgccctaaaatcagatgctggtctgtgctatctgctcatagatacttctgcatttatcatcgctcgattagcatcaaatcattattgacaatgctagttgcatgaatatgccatatttttttgtttgcatagatcataaatgtagctgtgttcattaagcaagtatataataatatcactgctgatattttccataaacagaacctacttataactgtcatttgtcgaggcttgaaagttttcttgttctaaatttcggctaacactggatgtctatgtttaccttcgtatttattgaaggtatatactgctattgacactaaattttcattttttccagtccgtgagtgataacgatgtccgcaacatagtgttgtcttatcttatgcacaactgttttaaggagactgctgagacattcttatccagcactggtttggaactgcctgttgattacactgtagatgtagataagcgtaaaggtatttattcacatatcaacactgaatcttgtatctttctttggatgttcaacacttgtaaaattgctgcataagcactttatattgttatgttagttcatttgtatctttttatgaatgctcatgtttttgtttgtctacacaatccttagcagcttccctttcaagtttcatgctaataaaagatgtgctctcagctcacttgttttagggacaaaaaggctgtgctaacgacaccgttcattagctgaaataatctttgtaaaatcaacccatcaatggaattgcagcataatttagctagtgggacatggagtcatttcagttcagtatagatgcagtttttgtttacttgtttgttgtcaatcattactgaacttgttggatgtgatctctgttgcacataattgcaaatgcaagttttattgaacacttactacataagttacacatgttatgaagtaatagaattgtgtatagctatattattctttagtaccttttccgtacaaagtgtaagataggtttttttctaatagcatgccattaatatagggtttatttcatggtatgactctttactgtgctgttacctctatactcctcatacaaggatacctaactttcttgtgcaacatggatttaggattaaatatagcccttagaaataataaattaataattatggggtttctggaaatttccgatgctctgttatcttggatggaatttgtaacttcatttgaaatagttggtggttaaagcagataatatggattgtatctaatctatcatgaacatgtacactgtgccagtattaaaaaatgcatctgcattccatttgtctagtcgcatgcacttgcatctaacgcttttgttttggtttctttcagcgatttttagttttgtgttggaaggcaatgccctgaaggctatagacctgacagaagagttggcacctaacttgctagagaatgatatggatttgcattttgatcttttaagtcttcacttcattgagttagttcgttctagaaaatggtaagtagctttatttttggaaaaaaaataactgtgccatgtattttggattaatctggatgttttgactgacagcacagaagctcttgagtttggtcagaaaaagttgacgccatttgggaaagtgcccaagtacgttgagaaactagaggtaacttttcctaaacctacatatgcttatattagacagttttcaggtcatgcaaattctgtcttcttgtcaggccatcaatttagagaactggcaatgatgttaaagaacttcactaccatttgttacccatacaaaagaggcaaaacaaaaatattggtcttgaaaaaactttcagtatggtgaatctagtttatcactatgcatgagatatagatttctattcaagtacttagctacttgcaaaacagtattggtacctggcacaccttcatttgccctatgttgccgccttgtagatctgatttgtcatcaaagttatgtcagcctgttttctgggctatcatgtattttgttatctttattaaatacatcagatttaaatggcagcgcggtttttgtattgcatttgtttagtaattgctggtgctatactgtcctatccaagtaccgatgctaggtagtccatcattatcaacgccggccattgggtattatatttattaaatgcaaaatatggtgaaaacgtttgaagtagaggtgccgcttaacaaaataaatatggaacatatggtgacatactttttgtgtattgaacttatgattggctgctttgtaatgctatgcttggaatactatgaaaagttaacttttgttttatatgtataggactttatggccctcctagcttatgaagagcctgagaagtcacctatgtttcatctactaagcccagagtacaggcagaatgttgcagatagcttgaatcgggctgttcttggtatgttctaagatattgttcttggtatgttctaagatactatttgctgtggtctcatccgctgatgacacgattgtgatctttgtctcatgatcaatgacagcacatgctaatcgaccagcatattcatcattggagagagtgatacagcaagcaactgtggttagacaatacctacagcaggaagttggcaaggtaacatctctatctttttcttcatctcacgatcaatcatgattctgtacggctgcatcgtatcttgttgaacatctttttttttgttcttatctatcttaattattgctatttcttttattggggtgcatgtttttccataatcataagttactacagtccacttaaacttctatttaactattggtgtgctttaacatcatgatgcatacatgacatttcaactcttggagcaggattcttacccgccattttctttgaaggcctttctgaacaagtaaggtgcaaccaatcaatcgttagaaagatcacctccagggctccagtcctatggccaccagagttcccttcagaatgtgtaaaacagttgcgtgaaagcaagcgacgggatgctcatgcacatattattcagagaaccgccttctggattaaacgatatcatcagtggtgtaccaacaatatcatctgcatcgaaagaggaatgttgtataactgttgtttcctcatttacagttccccatttcccctttacccgttgacgccatcgaaagttgtacatatcagaaccttgagctattctgtatgttcgtgcagagatatcgtcagtttgaaccaatctgcagtgcacttattactatgcctgatgcttggtctctacaaactattggtgtgttttatggcgtccatttcaccatatcgactgttccattcaaccaaagataaaaggaaagcagagcaagtgacaagaccatgggaggagaattctcaaaaatttcttagaatgtgcacttgatgctatgcctgatgcctgatgctggtttctacaaaatattgatgtttttcatgccgtccatttcacgacatcaactgatcgattcaacccaaaagatgaaggaaagcagacaagaaagtgacaatacaatgggaagagaattctcgaaatcctcatataatcagaaaaggaaaacacgggtgccaactttagttttccatcgtgaacgccgggaatcacgaaagatgagagcgagcggagggcaacaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36088 - DNA, 1438 bp, Oryza sativa
acattggcatatctacaacaaaattatttgaatatcaattgtattcttcatagtcaagattcctaactggaatttcgtacttactttggatccaagcagtatttggtttctttgtgcgaatcatcaagatcaattgacttcttgtttgagttaggtctatcaaaaccctcattcttaacatccccatagtaacccctatccttccgttttgaagaaggcactattgttggatcatggcatgcattagattcaccaccagcagcagcaacctctcgtctggtgttatgcaggtcaatcagaatcttgcccaacaaacggcgtgcaatctgaagaaaaggacatgagaaacatcataagttgcttgtgactaaaaaacaaaacagtgccaaataaaagggctagcctctaggagaaaattgggtactacatattttctgcaacaaattcctttagcatccttcatttctagaaacaaaatctcatttatgttagtttttcggataaacactacataatgaaaacaatgaatatacaggacgcaactcataacagtttcttttccagttttcaaatatatttacacaccagtacctttgaaccaattttgagtttctgcttcgcatttattccatactcatttggaattacaccatcagctagtgactgaatgaaaaagaaacattataaatagttagatagcaggcagaaaatggatagaaaaagagcattagaatgaccaatcataaaattcagaattcaacataagcacgccactcttactagtaacgtactccctccatcccataatataagggattttatccctctcactagacccacaatataagagattttgctatactacttgtcacatccatcatctctaattcaaatttctacctattttagcctccaactacccactcaccacaaccaaaatcacatttaataggggtattgtagtcttttcttttcatccttaacctttcccaaaagggaataatcccttatattatgggatggagggagtaataggtagtatagcagtacatgtttctaatagtgcatagcatattgagttctctcagtgttaatttagtaacagtaaagcaataatcattcaccactctactagttgtattcataatgtaaaacagggatcaaaggatttcatttaggacctgagtgctatgaaatgatgtcttcatgtgcaaatatttcacaaatacacaggagcagctgtatatccgtggttctacacacatttaagtgcaagggcacattttaagagtgcgatacatatttaatttacctgagaaactctgaagagatcactcaaaccattaagtttgagatgtgagttatgaaagaggtcatacctgtcaagtatactgttagaaatagatgaagtgaaaaaatatgctggaacaaagaaatg

SEQ ID NO: 36089 - DNA, 1143 bp, Oryza sativa
tatatactgttgagtactactaccttcttcaagagaagttatttcttctagtttaaaggaggttaatttgcatcccatgataactagcaagaaataacacatctttaaagaatctattacagaacaagcaactcagtcaaaacatgaaaaaaggatatctcaaatgtacgaagcatcattttttattataccgatattaatacctcatatactttgctgcgatcatggaggaggtattggggatccaactcattgaccaaaaatggcctgcataaagatatttacataatgttattgcatcaagttgatgaacttatataggtatctagctaataataaacatgtgaatttcttaggcccataatcaacactgcctgtgtatttcccaagaaaaataatatacacattaataatatgttcaaattgcagctgaccagtgttaaaaaaagctagctcaaatgataacctatacttatgatttctaaagttctcttcattttcttcagctacagaaaaaaggcataggcaaactcatatatacatacatgaatgaaacagtgatatcaataagagcttaggtgatgctattatgaatagagttgctttagatacattaattagccatgggcacattcagtagcaactatatcaaagtaactttaaaagtggtgcaaatgttgaagccaaaaagggcaactatacagaaacaacacatgggtcatcaatgtccacaattttattgttgataattatcttagtccagctgctagtagtactagaaatgttctatatgtcagggaagcctgttgtgaaactaaagatacttgcagatccagcacaaagatgtgctctgaaaatttcatgtgtcaggaaaagcatttaacctgcgtaaagcagcatatttctctgccttttctagtggatacccagccgagtaaaaggcaatcagacagtcacatagaggccagctgtcaacaaaaaaacagaacaaagatgatttcatagtaaacacaatatatgaagaaaaataaatcactgaattaacctcattatactccatccaatcacgaaaacatatgtgcagataattagatgttttggacatgtttcaagtcaaactttaaaaagttgaacatcaatgta

SEQ ID NO: 36090 - DNA, 5991 bp, Oryza sativa
  unsure (1)..(5991): unsure at all n locations
cgggcacacggcaagttttggtttacttgcaagcacgaccacacattcgaggtttctgacaatacatgatgagtctagtagcaacacaagcacaatttaggacaatttagggtgtgtttagttggggaaaaggaaatttttaagtgtcacattgaatatttgaccggatgtcggaaggggttttcggacacgaataaaaaaactaatttcagaactcgcctggaaaccgcgagacgaatcttttgagactaattaagccgtcattagcacatgtgggttactgtagcacttatagctaatcacggactaattaggcttaaaagattcgtctcgcgatttcccccataactgcgtaattagttttttatctatatttaatgctttatgtatgtgtccaaagattcgatgtgatgtttttgagaaaaaattttggggaactaaacgggccccaaaggactacgttttttggctgtcaaagtttcttagagcatcgatagtactgcaacttggcgaatgcttttggattaggtgttttttctttttttttgtcatatggaagaaaataaatagaaaaacaaaatcgatactgcttttgagcaacgcatggtatgaactcatgtttgctttagttgtagtcaatccacaacggaatgtctagagtgatttcataattaattaaaatatgtcggtccagttttttttaatgtgcttataagatatagagatataatgtacgtgaatatgcatgtgtatattagccgtagtacgtttagaaaataaaatacaactacatgtgcatgggaatgggtgcacctagtatttcattagtttgttcggtttcattttctcagtcagatactcccaacactttgtaaggtagcaattggttcctcctatgtttttttttcttcttatgaccagttgtgatagtcaaagttttaaaactttaattgaatgtcaaagttttaaaactttaattgaattttatctacttcctccatcctagaatttaaatattttttaagtagacacggatattaagaaactaagtagagatgattaaaagaggattgtgattggtaaacagaaagtaggtgaagaaattactttattttggacaagttactatgctacaaatagatatattttgggacagagatagtagatattaaatatgtatgacttacggtgtacttatatgtcactatatttgcatattttcttttcaattacaatagtaataaaaaatacttcatacttcgtcacactggagtgtggtgaaggcgcccatggattacgtcgctcaggaaggaaatttaagattgaatggtctttcgaaagatgcatactgtatctcattttatatatatagtcttataaaatattattgctactttaaaaagaaaggctagatttatttaggagactgaccaagaaatgtataggcaaatttttatatgagcaagcaaatgtttcttgcaagacccagcaaaatgttccatcagcttatggaggcacttgacgttagtcagccatgtcatgcaaaaaggaaaaagaaaaaaaaatcttctaggcatccactcatgctggccttcttctacagtgggccttgacaaataaacacatgtatttttatcacaaattttgataatttgaccttttccgaaaattaattttacaaataaactgcggccaaaacttatttcagaaatgactcttttgttcagcgcaaatcgtatggcgctaaacttagacacctcagcgtcatgtcagctggcgctgaatgtcgtgccaccgcggatgagaggctgagtcggcgtgccaacatgcattcaacaccgtgctatttgatactgaggtgtctaaattcagcgccatacgatttggcgctgaacaaaaggatcattttttaaataagttttggccgcggttcatttgtaaaattagttttcgaaaagggtcaaattgtccaaatttgtgtacttttataattgatgttctctaaccacaggcacttaatcgcaaaatagaaaataatagaagtaggtgacaaaatgttgtactacctccgtttcaggttacaagattttctagcattacccatatttatatagatgttaatgaatctagacatacatgtgtatttaaattcattaacatatatatatatatatatatgaatatgagcaatggtagaaagttttataatatgaaacggaggaaatacattttacagaaccagatcttggacgaattcctgtcagtgacgcgcgcgcgcgcgagatcacatcccacaaaaggtgaggtacacctatcagatgtcctttgggtctgaaagtgctaatcagaaatgtttagggaatcaatcaccaaattttcagctgtcaaatatttgccccaaaaatcagtattacatctccaaatcctccctttcagatgattcagaaataaaaaaaaaaccaaaaatggaagacccaagcaggaatattttgaagaacattcagtcataccatggaatatccaggcaaatgctcccatcagaagagcaccctgagattaggcgaaattgacccgtgatctaatccaattggtgttcccgtcggcgtcgacgtcgagatcgtagcacgtagcaggaacatccaactggaatatcccaaaaaatgattttggaggctcatgcgagattatctgaccaaatctttgtgctacgcgccacataatccaagaattatgggaacctttgcttccacgttcaaactccagaaatgattgttttcggctatggacaaatacaattacgtctgatcctttatatatatatatatatatatatatatatatatatatatatatatatatatatatatatatatatataaggcaaggatagaatttttgtatttaacacaactgatagaatatttgattgtgtaagttttgatcgaactggagcactgaagaccatttgatttactggagagtcatctactgcgtgtaactagccgacacttattatagtagtgtctgctttgtgtgtctctactctctagagtctgctttcaaaaggtcagcagtttgatctttaggaagacagcatctgagaatattgttctttgaagaaccagatgcgtcactacagtattatatatattcaatccagaatatggttctacgctacgacgaatagcctccgatggtatattggtatggcatactgattactgaatttattttaaattcatctataatggagaggtcgaatgtggagtccaaataaggtaaatatagcccgggattggtaaagttatcacaaaagaaattgaccaaatcatgttgcacacttaatttttactccaatgacaacacaaaaatggatctgatgttttgcttctgtactagccataaaggggaatccagcatgatactaactaatcagactctaagccagaattcaccgcaatggtaaatccactcccacaatagacgttaactgaagcagaagaacatggcctcttatcacctatattaactctctgtggagtcacttgatcacaagtatctcccaaaccaagctgtccatgctctccccaaccccaggtgaagactgttcctttatctgacaaaaagatgcaagagcaattagtttgtaccacccagggattatgtgctcattttcagcctttgagtaacttacctgttaccgaagcagaatgttcagtgccagcagctatgtgcaccacctgttctccatcaacacagggaaccttcaccagtgttgatgatgaggatgattctgcaaatcacaaagacaaattttatatggtgatagggaaaaaaaatgcagcatgcagatcaaatggcaaagaaaagaatgccaacctcttattgaagaaaaaaattgttcgacgtccgatttaccctatgctatgagtttatttcaactaatcttgtatgaactaagcagattgttattacaaaagaaattaacagaaagcacaacggttgggcaataattactaggctaacacatagaatgagtattcatctatatgtaaagatattttccagtccagctactggttcctaataaaaacttaatacaactacgtgacataatataaccaaaattgaaaaggggctaccatcatgactatggcttgttgtggcgggatttagtctctgcactggctctgcacttggcaacacatggggatcaagcttacgatgacggtaagcgccaattgtgtacaattcacctgctgtaactgcggaatgcttactcatttgacagcagttccagaaaacatatttcaattgaaaaggaacaacgcaccacataccagataaaactaatgcatgatgccatcctaatgccacttgagaaatacccaaagaaggaaagactggccgaggttgatcatcatcatgttcaccaattaatgctcttccccagatgtacaactgaccagattctgttccatgcaatgaaagtacaatcatgtccaagtaccaaagagaagaagagtgtttgcacaacaaatttacaaggcttaccatccaatgcagcactgtgatctccattggcatatatattccctatcttacagtctggaaaaccatcaattattcttggaacatcatagaacttttggttcctagtgcatctaccaatttgtccccgtcttgttgagccaaatccatagacagaattatctgcaagaacaaggactagcagtgtcatccgtttgtaacatatataacaattagtttgtcaatacatcaagtagaagaggtgtccatataattctcaggacgtccaataggaaagatatatgactgatgagctaaaacctgcaacatctcatgcatattcatcattagaacacaatgatggtgcagcatccctctgaaaagaatgctaaaggatggctcaaaggtacaccttcatagattccacatcatcagagaaagcagtggccttaaaattctcagatgactgataggaaatattatatggttgtggattgatgaccctcccacgtctcccgaatcactagtgcagaagggatggttctgcatccacatgaatgctttgtatgccatattgccatagttggaaaaaaatcaaagaatgctcactcagcccttcttcaaggaatcaacaaccctaagttgccggtatgtttggcttcaaagaagtgtataactgtgtataggtcatcttgttcttgattttcgctttcaataaaaattatcagtatggtcttgccctgctatagcgatgcctatcctcaattgaaaagaaaaaatattgattaattgtttctttcaaaggctgtttaactttagaaaatgcattacggaatatgattgggtcatttaaaagttgggtattgcccagacaatggaagatttctgagcaagtggtttcagaagaggtaacagagtaaatctgggtaggttcatgtactatgcaatttcttaaaaattaagctaacatcgcaacacatgatgttgcatacctttcaaaaggacaagagaatgacgcatcccaagtgcaagcctcacaacatgctttgtggtaaagtatgccacttcaaaaggtaagtttcttgggtggttatcaccagcaccgagctgtccaaatgaaccatctccacacatgaaaagctgtccagaatctgaaaataagaactagaaacatcacagctaagctcatcagtaatggttttatttttgaaacaaaataaacacctgaaatgcacagactatatgtgatatagagtataaagtagattttttgaacataaagcataaaggatcaaaagaaagtacaaggaaataaggtggtttcagaattggacacctgtagcaaatccagaatggttccatccagcagacacacaggttatcatgtagttctcaaagaactttannnnnnnnnnnnnnnnnnnnnnnnnnnnnnnnnnnnnnnnnnnnnnnnnnnnnnnn

SEQ ID NO: 36091 - DNA, 723 bp, Oryza sativa
ctatgtatttggcaaaatatcatgagtcaattgatatttgggcctgaccttgctgtgatatggatctaatttcaatagaatgcatgagtgctttggaaacatatgttgactgtcgaagcatcaacaagccgaagccttggcagtctaaataatgtcaaacactaaacattgcttatcttgctcctaaaatacataaatgagatattcttcatggcatggtatgaaacaaatttacatattagtactgatgggtaagaaacttaaaattgttcattcattcttattattggtttagtagtagacaatttattttagctaaagtatgcattttgttcccctgtggtctgtgccttgtactttcatttattgtggaaaacctatccttaataactgccaattgttctgcaataagttctacatttttttatatgcaaatcatgaatcagtcttatcaatgcatccatgcatattccaatttgtgcggtactgcaaatttaatttgtcagattgtctattttaaacattaactttgccgcattgtaaagaagtgttagaacaaatctttgctgctgctgactaattctgttgtacataggagatgaccataacataatgatatattatcctagctccgctggtggaggaatgaaaaaactgttccgcaaggtgggcacttgttaccttcaattcacacacatttcttggtagaaaaattgtaattag

SEQ ID NO: 36092 - DNA, 580 bp, Oryza sativa
gctttgcactgattttgatagttgagggacccgttgtatttgattttctggttgaaggatgaaaattggattcgttgacaagttaaagggacctcaagtgaacttattccttctcgctcttcaaggactcggagccgcggggttggtccattcgcagagctcagcggtggaattagctcgaagctcgatcatggccgccgccgccgggcttgccgcgccgcctcctacctcccggatttcctccttccccagggctttctccaccggtatggcatccgccccctctcccgtctcgccattttatcccttcctgtatctcgtgtagttgccgagttgggtagttgtggtatggcctatggggaattggggatcaaaggttctgcgcgttggaacggggtgactcggctgtttctgctctaagtatcgggtttcggaaggaagcatgctgtcaaatctgaatttctgtgatgagtttgctgcattgcttgtgtgcgcgtcaagatttgtgcagttcgtttggaggagacttttgtgtgcaaatcagaacaaaaagtaaagctattatttggaggattctggt

SEQ ID NO: 36093 - DNA, 2222 bp, Oryza sativa
gttagatttgttagtccgtgtactaggcgagaaaaatctttcgtttttcgtgcaaatgtttttgggactgttatcagaaaataataaaagaataaagaaaaatgatacgtttatcggaaaaaaaaaagacaaacggacaaggatacgttaatcgaatgaaaataagaaaaaagaaagacggacaataattgtttttgcaaacataagatagcaataagaaacatgcacatgcatgggcatcatagcgtaggtaacgaactacagttcttgatccgatgaaaataagaaggaaaataaacaaacggacaaggattgtttttggactcggtattactgcatatccttgactgctggatcgacaggaaacggccaagaccaagctgggagatcagcatgcgagcaaagctgcaggctcgacgtggcttccgggcttgcctatctcggcaaggtcttcttctcggggcctccggcttggacgaggaatatttgccgtttgcggccagccggcgaaagcgaactgagattaatggctggcgagtagtgactggcgtcatgtttcttgacgagctctggtcaccgtgagcttttgacatcattaatgctatgaagattttgctatgtactccttctgtctcacataggctgtgtttagtttctgaaattagggagaagtttggagaaaattggtagtttggaaaaaaaaattagaacgtttatatgtgtaggaaagttttagatgtgatgtgatgtgatgtgatggaaagttaggagttgggggaagtttggtgtgaactaaatagggcataaactcaatgtagtattggatttgatgtcttctagtacaacaaatctggacagtagaaaacgttctatctaatactaggttgagttttttttgaaacagagggagtagatgtgatggataattggagaaaatattctctcaacataagctggtaatatattgatgtacctaaaagtttaggttaacgactacaaattacaggtgggtttatttctgaatttctttcagtttacttgtgctaattactaactgcttatacatacattcctcgcaaaagatactcaatctataacttgtttttctttttttttttcagaggtagttacttggcttggttgcatcgtgccaacggtaagagtaactgagtacgctccccacgcccaatgcacctatactgcctccgttaaaagaaaaaatccaatacgagatgttatgtttaaattcatagtatcaacacatttcgcgctagttttttttttccctgacagagaaagatacccttgtacacgccctaataagccagcgtaatgggttaggagacatcatggcatcatgcatttgtacactactttctgttatttgtaatgtttattccgaattttttttctattttacttgtacactactttctgttatttacgaagagaccacagctgtataaaacggcttgactacactccaagaccatactaatcagccctcacatggacagtaccgtttcatttttttttctttgacccgattgcattagattaacaaacaagcacggagctataagctactaaaacacaatgcaaaattgcaaatatcacagcgcactaacgataaatcattcaaatggtggaaaaaatcaaacaaaatggttagattaatatagggctgcatgtgaatgccacaagaccagttttaccaaaccattgtaggctttataaactgtagttttctacattaccttggctatgagttgtctgttactagcaaatcaagagtacgctggggatgtatcccccacccgtctttttatttcattaaaaactcatcgggtatgtgttatggcagatgccacgaatgtaaaacattttcattgtctaaacaaagaagattccatgaaaccatgcaaacatgaaatacagaatgacccacatcagagcttacaaacgttggcatgggcagttcaaccacattaggttcaatatcaatggcctcgcaaaggccaacttttggattgacaggaaacggtatagtaactgaaacccattagtctcatactctcatgtcataaatccttttccactacagcagaaatgcaactaccatgagagaatcctaatcctattcataaattcagaatagacgacaacctggctaaaagtaaaattctgaatcaggtggtaagcttcttgacaattcacaggga

SEQ ID NO: 36094 - DNA, 726 bp, Oryza sativa
actcattctggtcaatcttttccccccttcagtaaagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgtcaagctggtatcagagccatctcgactgtaggataagccaagtggataaaacctaaggacatattttataaataaaactatttgcgaaagttcctcttttttctccttcccctaatgctatttgcaaagggtttacccttttcttccttcttcaaatttcaactagtactagatggtcagctttgcgaagaagaagatgtcgtcagttgtttgccgaagctccggaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcagtggggtgtgatgtaaccatgctaggttgtttgcttaatcaactt

SEQ ID NO: 36095 - DNA, 242 bp, Oryza sativa
cccccttaattcccccttgaatggcgcccccaatcgccgggaacggacgcgccaagtccggccgccttcctttgccgccggccgccattcccgtcgccgttccgccctctcccgtgcccggctccctcccccatcctataaaatgcaacccccgcactcgttctatcgctttagccccctcccgcggtctcccgtggtctctagccacctccccaccgtcgccctctctctcccacgttgcc

SEQ ID NO: 36096 - DNA, 1255 bp, Oryza sativa
ccaacccagtcatggtgaggaaggccaacggaaaatggagaatgtgtgtcgatttcacagacctcaacaaggcgtgccccaaggatcactttcctctccctcgaattgatcagttggtggattcaacagccggctgcgagctattaagcttcttgacgcttactctggctaccaccaaatcagcatggcaaaagaggacgaggagaagacagcgttcatcacgccgttcggggtattttgctacgttaagatgcctttcggactaataaccgccgggaacactttccagcgcacggtccagggcgcacttagcaaccagcttggcaacaatgtcgaggcttacgttgacgacatcgttgtcaagaccaagacaagtgactcattgattgacgacctgcgggaaacgttcgacaacctccgacgatatcgcctcatgctcaattcagagaagtgcacattcggagtaccgtcgggcaagctactcggattccttgtttctggtagaggaatagaggcaaatcccgagaagatcaaagcaatcgagaacatgaagtcgcccacaagactcaaggaggtacaaaagctaaccggatacatggcagcattaagcagattcgtcactaggatgggagaacgaggacagcctttcttcgctttgttgaagaaacaagacaaatttgtatggacacgggaagccgaagaggcatttattgcactcaagcgctacctatcaaacccacctgtactcgttgctccccaacctaatgaagaattattcctttatattgccgctacgccatattccgttagcactgtcattgtagtcgagagagagaaagtacatcgaccagtttattacgtcagcgaagctctccatgatgcaaagacaagatacccacagattcaaaaactgctctacgcagtcatcatgacatcaaggaagctacgccactactttcaagcccacagagtcacagttgtctcctccttcccctcagcgaagttgtgagaaacaaagacgttgtcggccgcatcgcgaaatgggtagtcgagctaagccaatttgatatccactttgtgtcgcgaacagccatcaaatctcaggtactcgccgacttcgtggccgattggaccatgccagataacaagtcagacaaccaaggcgacaatgagacatggacaatagcgtttgatggcgcactcaacagccaaggagcaggggcaggatttatcttgacatctccctccggagatc

SEQ ID NO: 36097 - DNA, 3072 bp, Oryza sativa
cgccgccggtcggacattagtcggcaaggcctttcgacaagggtttttctggccaaccgcccttaaagatgcatgcgacatggtccagcgatgtgaagcctgtcaattccacagcaagcacacaaagctacctgcacaagcgctccagacaatccctctgacttggccgttctcgtgctgggggctagatatacttgggccattcccacgaggacagggcggctatagattcctatttgtggcgatcgacaaattcaccaaatggatcgaagcactacccactggggaaatcaaggccgacaacgccattaagttcatcagagggatatactgcagatacggactaccgcaccacatcataaccgacaacggctctcaattcatcagcgccgacttccaggattactgcatcggtttgggagtcaaaatatgttttgcctcggtctctcaccctcaaagcaatggacaagtcgaaagggtaaacggcatagtactacaagggataaaaacccgcgtctacgacagactcatgtcacatgacaaaaaatgggttgaagaactcccatcagtactattggccgtacgcaccacaccgacaacatccaacaaggaaacacccttcttcctcgtgtacgggtctgaagccatgctctctggcgagttacgacatcaaagtacacgagtacagaagcattccgacgaggaacagcgagacattgatgtaaaccttctcgaggagcatcgtgagcgagttgctgttcgagcagctagctatcaacaagccctccgctgttatcacgagaagcgtatccgagcacgcatactttcgatcggcgactatgtcctctgacgagttcaaacccaagcagggcaaaacaaactctcaccaaaatgggaaggaccctacacgatcacacaagtcttgcggccaggcgcattcaaaatcgcagacggcgacggtcgcgaattagcaaattcgtggaacattgaccaactacgtaaattctatgtatgagtcaataacaccgtacctgtaagcacccttacagtatcaataaagcctatttctaggtttcataccacgaccaaagtgttttcactcgacgatcccttactctgataacacctaacgttgaaacatatccttatgaccctttacgccgtctcgacaaggcctccgaggaacctaagggatcttcggctggggatgcccagaaccgataaggccttgtcagatccttcagagacgaaagaccatgtaagatctggtcgtgtaagagttctcgccgtgcgtattaaccaagccgtgtaatcggaaaccgagctttccaacttcacggctgggggctaggatcagagcttattcaacctaggcagatcaagtgtccaagagccttatcatccaagaaaatttctccgacgacaaggctgggggctagggagagtgtacgactcaaacagccgaggtcgttaactaagaacacactctaacacataacatccagagtaagatgcatttgtttaaggaatatttctttattcacataataattcttacttgttttttacatagatctcccactacattacactttttcctaagacatctatagcaggccacgagtattaccaagagggccaatgccagtccatagactggaataccttctcggctaacggcgtcatcgacctcgcaaggtggtctatctccgccggagtcctccgagaacgagcaaacccttcatggaggaattcgagatccaggcgcgggcggtgatctcgcaggcaagctagcacatgtcctccggcatatcgactcgctcgacgacactcttgtttcaaggcctcatcgatacgcctgccgatgccatcgagttgggcacaggccccgttgagccacgagatgtacccggtcgccgattcctcaggagtgttgcggactactcgaagctccccgcatacccgggccattgaggtacagcaactctttaaatatgacgcaaaccacacctcgcgtcctcggagcgtttccatggcttgctctttcttcacggctagcatggttctcgagagttccgccacttcaaattttgtcttctaatattggatacgacgatcttgggttgcaagggcatcctcgagatctgctaaacataacgaccactaagacaacctggaaaccactaacccaacacgggttaaaaaggctactcacttgaggtggttgtccccatctcgacctccacatcaagagtttggtcctcgacgtcatgtgagacgcgtggttcaaactcaggaaccggaattatcgctagtgactcgggctacccgcgctggtgaacatcctcgtcaccagcatctctacaatcgacaagaaaaacttccgaaatcaacactgaacaaggatggtaatcatacgcccgaaagcaaccagagttcaagatttgcaaattataaaaaatacaagaagtcctactcttcaaaaagggggaggacagactcccccaggtcactgacttcttccatcacctccttacgcgtgtcgcttgccgccccctgatccaagatatcacgcagatcgagttcagggcgcgacaaccttacacacgcgaggatgtgacacgccccggtgtagataccgttggacgtctcctccgcgatcctggccgaatgcttggaggggatttcccctatcaccgtcgccagctccgcaagagaagaagtcaacaagaactcgtcggggttcaccgggatcgtggacttgacgccgcactcctcggcgagctggtgaaggccggtgtaggtgacccgcagcgaaccacggatctcagagagattgtctccaagttccgacatgcggtcctcgagccctttgcgttggcgctcgttcccggccaccagctccctcatcttcgtgaggtcctcacaggcctcagccagttcccgcaccaaccgctcggcacgcgcgtttgccaccgccgtctccaccctcgcctctgagatctcgcggccggtgccgcgagcaccagcttcgagaaggcgccccatttcgacttggagctcttcctaggt

SEQ ID NO: 36098 - DNA, 490 bp, Oryza sativa
tgtccatcttttgagttttgatgttgatgaacattttattacttcctaactcagttgcacagtccagcctagccaatcttctgcctggcccatctgcaggcttgtcaatgaagtatatagctgctgagacacgacaccaactcctttgttgccagcatattcgaccctgcaacgaaaaatccattgcatagtatgatggaacttggaagaacaaactttctctgacttcggaaattttaccaagacaagtccatcttagtaggagatccaacaaaaaaggttagccacgacttactagccactagtgaataatatacacctttcaattgtttttatatggctttagtggttcctttattcaagcaacatggggtgaagaattggctaggtttcggcccattaggtagttcatatggcttaattggtgatttatttgaggaacaatacataatacgggtgtaaggaaaggaaacaatttaaattttgactt

SEQ ID NO: 36099 - DNA, 619 bp, Oryza sativa
caaaattatgtgaaacttacatataagttacactgtaattacatgtaagttacagtgtaattacatataagttacagtgtaattacactacgattgtactataattacatctgtcaaatttttggagaaaaacttgtcaacaaatgtataggtagtcccacggttttgtaagttgagggatgtcacatatttggttttgtggttgggggacgattttgtatctcgatgacaagttgagggaccttcggtgtactttttccaatatctcttcaagctgtcagaggcaaactggtaaccaacccagtttagcccaattcaacatgggcctaaactacagcccactaacaaaagcccattaagagaaagcccattattttctctttctctctccaaggtggcggcggggttggtccactcgaagagctcggcggtggaacagctcgctcgatcatggccgccgccgccgccgcctcaagggcgctctgggcttgccgcaccgcctcctaccttcggatctcctccttccccagggctttctccaccggtatggcatctgccccctctcctgctttccattttgtcctccctcctgcttagtattttgcctgtattatatggg

SEQ ID NO: 36100 - DNA, 884 bp, Oryza sativa
acaaaccccaacttctgccgataatatgatatactaaaatcatattttttttaaatcacgtagattctatcacgaaattctgtaggtactacgccatccaaaccggagtaaaagttccttggctaccaatttcaagcgtgtagcaccattacgcatagtatcctgttgttcctgtgaaagcatcatacaccaagagtggagctaattggaacacatgaatataacctgcatgatgttaggcatttttttatggttaaaaaccatatcattacggcaacgccaaattgaccaacatagagcactagctccaaataaaatcatttttttgtgtgtctaggcactccccttagccagttaccaaaaatatcttttgcattgtggggagggggaatattgaaggcaaagaagacacatcgccaagcaaaacgtgcaacatgacagtcaaagaaaagatgttggatggtctcttgtgtattacaaaaacaacattgcttgtttcccctccattttctctttatgaggttatcttttgttaagattactttttttgtgaagcaaccacataaatactttgatttttagtagtacctttacctcccataagatcctcttgtggattcttacattggaattgatgatcgcattatacatggatttgaccgaaaaatggccatttttatgtagcgaccaaataaagcaatcattttcatttgacagggttatgttagctagtcgagaaatcaaatcattccactcaaactaaactttggtcctacaattgatcgttggaataaaacattcaacggtgttgtgctcataacctctgccaaagtagaattgtctctttcgaaccacattgtacagagaaggatattgatatttga

SEQ ID NO: 36101 - DNA, 1315 bp, Oryza sativa
tttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgtcagccgccttcccctcctctcctcctgggccggccacccggcccaaccctagccgcgcccccgcccgtgcagcgcgcgtgcgcgcgctgacgccgccgcctgaccggtgggtcccacgcgccaggccgggcgtcgtccccttcctcccgcccggccgtcctctctccctctcccgtgaaccctagctcgcttcctcctctaaatccgctcgattcaagcatgggattcccaaattgattagggggaattaatcccctttccctcctctctctttcccccttaattcccccttgaatggcgcccccaatcgccgggaacggacgcgccaagtccggccgccttcctttgccgccggccgccattcccgtcgtcgttccgtgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggagatgcacaattaatgcaagggagtacaaggggataataacatagaggttaagttttgcagtaaacggcatttaaaagtcacttagttgcccaaagctattttgtaaagacgatcctagagctatacaatattattaatcaaggccgtgaaccctcacgaacctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacgtcttcctcacgtgttgccacgtgccacataccaccacggtatacggacggaaga

SEQ ID NO: 36102 - DNA, 15114 bp, Oryza sativa
gagggctctttttagaccaaggagaatttaacaaaaattctccgggccatatttgaatttttcttgtacgtattttagtgtttgccaatttcttttcgaattttaattaattctattattcctgttagaagatgatttttatttcgggatgaatttatcaggacgtgacattccgccctctcccgtgcccggctccctcccccatcctataaaatgcaacccccgcactccgttctatcgctttagccccctcccgcggtctcccgtggtctctagccacctccccaccgtcgccctctctctcccacgttgccggccgcctccagccgcctgtgccgcctcgaccgtgcgccggccggccgcgccgtcgcctcctccagcgtcgccgccacctcctccacgccggcctgccctccgtttcgcgaggtgacccccggagctgcgtttccgccgtcgcccatccatttcctccgcgccggccgcctccagtcgcctccatctccctgcctgcacgccggtcgacgtcgccaccacctccctcggctccacgacgccgctctcatccccggcatcacctcctcctcgcccgaacatcgccggaacaccgtcgcccgcgccggcctcaccttcctcctcgtcgacatctcctccggctgcccctttcgccatgcccgtgcatcagccgacgctgccgtcccctccctcggcatggtgacgtagccctccacctcgtccactcctcggtttcgccggaacgccatcgccgcgagcccctccatccgcctcgccggagttgttcggccgcccgtccctccacgccgtgcaccggtcggccacacccccatcatcttcggcatcgcagctgcgacgtcgtcctcggcctcgcctcccctccgaccgaacaccgccggtgcccgtcgtcgccttcaccgttccctctcgcccggctcgtcgtcttgcggcgccgcctccgtcatcgtcatcgctgcggcgtgttccacgccgtcctcgcctccatgcagccgttgccggctgccctcgtcgtctcctcgccggctgccctcgtcgccttctcgccggccccggtcgtcgtcgtcctcgtcctctcgtcgttcccggtcgtcgtggcgtttgtccctccgtcaagccgttctcgttcgtcgtcctcgcttcgtcaagatcgctgcagccccgtcctcgtgttcgtcctcggctccgcgtcgtcaagcctcgtgccggccgcgtctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggtttcctcctctcgcttccccgccctcgtcctttcggtgtcgccccgtacccgttgtgcggtcgtcgaccccggtacccgtgtaccggtgtcggtagtcgttcacgcgtgcgggtggtgaccgtgtagtgtccgcgttagtgtgcccgctcggtagccgcgtggtttccacgtgtgcaacccgggtggtgtctagtggagtccgtttatcggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacatgttttataattgcaaagcttaattataataattcgcaaatctccatataacagcattaaacttcggatgatcatatcttggtcatacgaactctgaatcgacccgttcaagtctcctaatgtttgttataacctaaagaaccctgtgctttctttttatgtgttgttattgcttctttataggcttttagctttgcttgtgtgcttcgcgtagcttctgtcgttccggaggttcccgaagcgtggttcgtggtcgtcgccgaaggttcggaaggccgttatctctgagcaaggcaagtcacatcatccttgaacatattgaatcccagtttgtaaaattatgttgatttaaattattgcattatcgctttatttaaattcccgcgttatcactgttttatttagccatgcctattcacctttgttatgacattattattgctattgttattattaccttgttcaccctagaataaacaaaaccccaactagtgggtactctattcctggttccactagtatgaatttaggtagatgcttcgctgattaataggacaacattaggtggtttttataactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactactgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtctttcgcctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatatggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatagctttgggcaactaagtgacttataaatgctgcttttctgcaaaacttaacccctatattattactccttgtacccccttgcattaaccatgcatctgccggtgtgacttgctgagtactgtggttgtactcattcttgctcaatctttccccccttcagtaagagaagctttggagaagatgtcttaggcggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccagtcgcgacagtgtccccgacaacaaagatctaaaggatgcaattctgaaagaagctcatgatactttatactccattcaccctggtagtaccaagatgtaccaggatctcaaggaaaggttttggagggcaagtatgaagcgtgaaatcgcagaatacgtagcagtatgtgatgtttgtcagagagtcaaggcagaacatcagaaacccgccggtttgttgcaacctttgaagattcctgaatggaaatgggaagaaataggtatggattttatcactggtttacccagaacgtcatcaggccatgactctatttgggtgatagtcgacagacttaccaaagtggctcatttcattccggtaaagacaacctattctggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacgggcaaaccgaaagggtgaatcaaattttggaagacatgttgagagcttgtgctctagatttcggtggaagttgggataagaatctaccctatgcagaattttcgtacaacaacagttatcaagctagtctacagatggctccttacgaagcattgtatggtcggaagtgccgcactccgcttttgtgggatcaaacgggagaacgtcaggttttcgggacggatatcctaagggaagcagaagaaaaggtaaagatcattcaagaaagattgcgagtggctcaatctcgttataagagttatgccgacaatcgccgcagagatttgagttttgaagaaggagattatgtgtatcttcgtgtcacgcctcttcgaggagttcatcgttttcagaccaaaggaaaattggcaccgcgttttgtgggaccttataagattgtcagcagaagaggagaggttgcttatcagttggagttacctcaatccttggcaggagtccataatgtgttccatgtgtcgcaattgaaaaagtgtttaagggtacctaccgaagaagctaatattgaccagatagaagtccaagaggatttgacttatggtgagaaaccaatccgtatactggaaacaaatgagagaagaaccaggaatcgagttatccgtttctgcaaagttcaatggagtaatcactcggaagaagaatcaacgtgggaacgagaagatgaattaaagtcagctcatccgcttctgttcgccagttcttccgaatctcgaggacgagattctgtttaaggggggtaggtttgtcacaccctgaaaattcaaaatatataaattgttgtttaaatggaatttctagaatttattttaaaagtcttgaaaagaaaatctaattctaattaataaattccaatataaaattgggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagccggcccagtccgcagccgcccgcgcgcgcgcgcgccctcgcagccgctgacaggtgggtcccacctgtcaggcccgtcgtcttcctcgggccgaaaccctagcgcgccgccgccgagccgccgccgctgtttccttccaaatccggccgcctctttccttctccggccgaatcaatagaggggaaatgatctccgggatctcctctaccttttctcctttggaatcttcggctaaatcgctttggaaagcgttggaatcgagttcgattcggatcggttttccctctttccaagccgcgagtttccttcgccgttgccgtcgccgtgggccttcgccgtcgcctccgagcccctttaaaaggatccccatgcccttctctttccgccgccaccctcgccttcgcctctcgtcgtcggaagagctctagcgccgtgtgccctagcttcgccgtcgccgccgccgcttcagccgtgctccgccgtcgctccagctgtcgccgccgctcgggaagaccgtcgtcgtgctcgccaagtcgccgccgtcctcgtccgccccttcgcagccgtcggaacccgccggagcatcgtcgccgtcgtcaacccgaaggtagccgccgcttccttctcgtcgccgtcgccgtccgttccttttccgccgccgttttggtcaccggtgtgttcgccgcgttgtcctctacgtgctggtgccctccgttggtgccgtggtgccgccgttcgccggcgagtgtccgccgcccgagccgtcttcttcgccgagtcgccgccgtcgtcggtgacgtcatcgctgacgtcatcgggatcctatcccgtgagccggtcgtagaccgatcgatcttggccgtccgatttggatcggatcaatctcggccgtccgttcgtgtgaaccgccgcccgtgcgccggtccacccaaaccctagttgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccatgcccgcggttatgggcgggtctaacaatgtctttcgtgattagtctcacacctctcatcatagtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgtttaattattacttaactgttttgttaaattctcaaatgtttactaaatgctgcttttgcaaatgaaaccctattatgccatcctttgttatcctgtgcacttgcatatttgctgcgtggcttgctgagtatgtcatatactcaccttgcaatcattcatcataggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaatgttgctgttggagctgactagctgatgagacacatgctagcaacatgtccaatttttccacaacgggtgcatgcctttgatccgaagaagacacatcggaaactcttagtccaaacaaatgtctctttggttgatcacttgattttcttcgccatcaatcgctaggttatttgattcataatagattatgagcttacggaaatgagaccctaggtctccttaatcatcaaccaaatgtacccatcacacaacacttgcaatcttaatatggaccctacataaacttgccaatctcattcattatctcatgtttctctgttattacatgattgacggggaacagctataaaacaaaagtacttgaacaccgatacaagagtattatggttgcttctgactagcactaggcttaacaggtactgcatttgctccactgactacttggtgattggcatggttgcttcctgtaaattggcgaaaatgtggaggccgattttgccttggttggggacagtttttggagtaatgcccttcttcactgcagttgtaacaaacaataactttcttacactcgggttcttcatcttgtacttgatttctcagctgctgtattggaacttccaaaggtacaacgcagatactgacctctgtcttgtcagctggtggctggggctgaaattgagcattgacaccttgtggtagtgcactcattggagttggagctgttgcaacgcgggctataggactgcttcgggatgcatggatgacaattcgttgaggagcaagcttctgattgcggggggttgcgtggactgacgtgctggcagctacgtttctcggttttgggcacttgtcggcgaaatgacccattccttgacatttgaagcaacagatatcttcccggactcggcattttcttttctcattttgattcctctgtcctggcactggagttaggctgaaactgtaatcttggcgaggatttgtgcttccttgatgcttctctccgttggaactggcgggttggttggccatcttcttcgtcagcagaaaactgaattgacaatcttttggtacgtgatcagttccttcacaaaagaaacaagtgatcctgctcgttggacacctgtcgggtggatggtcttcctcaccatgaacgcatgcagaggcacacgagctggcaacatgaccgatttctccacaacgagagcatgccttaagttctattttattctggttaaaaccttggggagacttctcatcttcatcatctgaggagacttgatctgaatcttcactaccagacactctacctccattagctaaaagatgctctgtcaactgttgtgcacctcggaaggaacttcttctctgacattttgtcattcctggtggaggccattctgtgctggtaatgatcatcttacggacttcatcttcggttcgcattggtgcttttcttttctgctgaggacagttccttgcatagtgcccttgctcatcacacataaaacagatgatacttgcttcttttgagtcaacatgtggcatggcatgaggggccttctgggatgttggcggtgcgctgacttgtggtgtgagtgcttggactgcctccaactgcacttgaggttgtatttgactcaagttcagaattggcgtctggtgctgctgtagtatctctataagcaatcggttctggttaatcaggtgttggactagtgtcacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttctgcgacgggttctccgagatcttcactcctgcttcacatctggcttcactgcttccttcgcttcgctaacgaatccaacagccttctgcagcttcggcagacaactgacgatgtcttcttctttgccgacctgaccatctagtactagttgaaatccgaagaatgaagaagggaataaaccttttccaaatagcattgggggaaggaggaaaaaggaactttcgcaaatagtttcatttataaaatatgtccttaggttttatccacttggcttaacctacagtcgagatggctctgataccagcttgtcgcgaccgagaaaattgccttttcccgaacgctagtgcattaatccccgtcccaggaaaagccggggtgcaccaaacaaacatgatacaaaaggcacatctttattatatcgataatatttacattattacaaaggcgcttcaggcctgacaatcaaaaataaacagcagcggactagcgggcctacagctccatctccacaggcgctcaactggggtataagccaggactccacctaagacatcttctccaaagcttctcttactgaagggggaaaagattgagcaagaatgagtacaaccacagtactcagcaagccacaccggcagatgcatgattaatgcaaggggggtacaaggggataataataggggttaggttttgcagtaaacagcatttaaaagtcacttagttgcccaaagctattttataaagacgatcttagagctacacaatattattaatcaaggccgtggacccacacgaacctgccttaacccaaggcctacgatgattcggaccgaactggcaacccgacctgggtcccagctcgtcccaagccaacccaggccaacctttccacattttagttgttaagcaaattttaagaattaaaccactaacttgggtacattgctaggcttgcccatatccgagggctcggctattcgaatagatttactctgatcagaggtgtacatctttacccacaagacacatctttactccgcattccatggccttggaacccgtcgtaaacatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagcctgagcaccgagttaagccttacccattagacatgtggttagtacggtagtgctttgcaacagaggcccgagcttaatccttatagtggccggggtgctacttcccacaactggcatgcacccaaaccccaccgaaaacaggttttaggggttttgaaagaggaagagaggtgtatatccaattccaccataatccaacaattccatagtgtccaaatgatatgagaattcccaaagtctaaagttataaaaccacctaatgttgcctaattaatcagcgaagcatctacctaaatttatactagtggaaccacgaatagagtacccactagttggggttttgtttattctagggtgaacaaggtaataataacaatggcaataataatgtcttaacaaaggtaaataagcatggcttaataaaacagtgataacgcgggaatttaaataaagcaataatgcaataatttaaatcaaaataatttgataaactgggattcaatatgttcaaggatgatgtgacttgccttgcttgctttcccaaacgtcggcttctacttccacgaagagcgaatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattccgagttcaaatggccaagatatggccatttgaaatttatatgctctttaaatggatatttgcgaatttcttcatttaaattttaattaaaaatcgggtttattgcgtcagccgagagagagggcgcgcggaccgggtccacgggagtggggcccacgcgtcagcccctcggtccacggtggaccgggtgcacgcggctgacgccgaccggcgccgtgggtcccacgcgtcagccgcacccgcgggcgcgggcggctgacggccgggcccacctggcagccgcggggcgcgcccgaaggcggcctcgccggcacggccgacggaaggcggcgcacccgcgccccgatggtcgccgccggcgaccaacggcgcggcggagcggcacccgagagagaggagggaagggggaagcgaacggagcggtccacggctcaccccgggacgacgagggcggcggaaacgacaaccggagcggaggaaggcggcggcgcggttcggatcgacgaggacggcggcgctccgacggtcggcgggcgaaacgaaggggtggacgaggttggcgaggacgcggcgaagccgaaggaggtgacgccgagtcgggaggaagtccggagcgacaacggcgatgaaccggagctcggcggcgacggcggagagagaggaagacggtgcgggcacgattccgacggggagagtgagcggcgagtggcggaaacggaggagagaggcacggggaacaattatatagcgccgggagggggagaaagcggccggaggggaaggaaaccggcgcggaggatccggccgccattgatggcgccggcgaggtttgcggaagcgattccaaacggatccgagggagagagagagggaaaagcgggggaaaacggagagggaatcgcggggagtgatttccccctctttatggcgcgcggggatggcgggatgcggcggattcggcggcggcggcggcgctagggcacgggcgggcggcgggagcggcgggaggtaggggatgacgggtgggccccacccgtcagcgagggtggcgggcgggcccgcccgtcagcggcgcgcgcgcggggaggaggccgaatgggccgcgggggagaggagagagagggagagagatgggccgagccggcccaagagggggggaaagaactttttagagcttttctttttataaaaccattttaactttgtttatgtcttaataattattatttgtgctctgaaaattccactaaaatttatttacgcattttaggcttttaggaaatatacaaaaatcctccaagccttatttgacttttaactttgcatattttaattgttggaggcttgcacccagattttaattattctatgcataatttaaaggatatattttagggtcgttttgggacgcgacaataaagggcagatttaacgtgtcaatcaagcatatagaataaaagtagttaaattagataagatcaactgaaactccgatactaccctaatcggcaaccagaaagcaggctagagattgcaatttgaagcacgacttaatagatcaaactcaactgatgcagcattaagtatgaaaagaagaacaatatctagaaaatcaagccgctggaagtttcatagagtggtagatatatcacataatctaagttaacgtcattatctaacctaatcggctgccttccattagcagatgttagccgattataggttagataaagatattatcgaagactatgtgagatatatgataactcgacgaattatatagacaagattagagtgtcataaagatggaagcactaatcctgagaacataagtcgtcatgacaagttttacctcttgttgaagatcgaaaccgatgcagctcaacccgagagcacgaactcgtcgaaataaaagtaaagcaaaagggtggcgatgcgccgagattgtattggatgtgttttcttgtttttacatagggctcgggtctatttatacccgaggattacaagatacgtccataacggacacgactattatctctaacaaactctaagataccataagtctttacggcagacttttgcccaaacatatctctaaggaaattacatagaatatcctaattaatagatacaatcgccttcccaggactctatccaagcatggcaatcaccttgaagcagatcaacttgaacccaatgactttcaccgggtcatattatcggaatcggctgtatcggctagccccgtccaattcggactctgccgatcctgaccttagccgatttagactgcagccgatttttactctatctccgcaaagatcttcatcttggatttcacttcgatctgatcttcatctccgatgccaatagtgatagaatttaccaaatttggtcgttaacaagttaccaaaatttgtcagcaaactaaatgtaaccacttttttgacaactttaccaaaatttggtaagattgaaaatggcatcaaagtgaacaggcccccaataaaaaaaccaacctagctcttacataagtattgtcattcattatactccctccatctacttttgatagtcatatttcatcttatcacacagaccaagggtaagtaactctacttatcattcatttaaacatgctactagtcattcctcgtaaacaaacaattcattaatatttacatttctcgatgcccatgtagccaatgttgtgtggaagaatgaagagtcatgcattaaatccgagaaagtcattaagatggttgttgaattgaaatattactatcaaaaataaatttttcagatttgaaaatatgactatcaaaaatagatgtagagagtcctatataatattataattattttttatggaacggaaagagtaaatgacgtaagaagatataatgtaatacagtttttgtgtcactgcatcacgactcaagccgcattcgagataagagcatatgaaaacgaagtacatgcgcttaaaacgattatttattag

SEQ ID NO: 36103 - DNA, 19966 bp, Oryza sativa
ggggagaggagagagagggagggagagttgggccgagccggcccaagaagggaaggggggaaaaaggactttttagggctttttctttttataaaaccattttaactttgtttatttcttaataattattatttgtgctctgaaaattccactaaaatttgagggctccttttagaccaaggagaatttaccaaaaattctccgggccacattcgactttttcttgtacgtattttagtgtttgccaatttcttttcgaattttaattaattctattattccttttggaaaatgatttttatttcgggatgaatttatcaggacgtgacagcagttatgtatggtggatgcatggccccggacatattatgaagttccaatcatcgattacagggaaacaaacatgcgtttagaggtagaagagaaggccgattgcatatactgatagagctatgtaattgatcagtcatccattaatcgtaacctgtgtaaatgacaataaattggtaattgattagtagttaacgccatatgtaactgtgcaagaaagcatggttaaaattagaatatatcttgctttccccagaaaaatatatatcttgcattcgcacaaatgggtttacaagaatgactaaaagtcaaattttagacatcaaccattagaggcaagaagaaaatagatttggtttagtggatgaagcctacgtaagtggcagtgatatagtggatgaaaacatatatagcgatgtgatcaagcaacaagtggaaatgagaattagtgaattggggcttgtgtccagtggccagttcgtgtccggctaaaaattaattagggcgtagcagcaaacaaccaggaaggagttagaggctgttacgactgaaacaattactaaattaccattgtagtgcttttttatctctaagttgccctttagcaaatcaagggccgatgatgctgagtactccctccgtcccacaatataagggattttgaatttttcttgcaacgtttgaccactcgtcttattcattttttttttgcaaatataaaaaacaaaaagttatgtttaaaatactgtgagataataaagtaagtcacaaataaaataaataataatttcaaaaaattttgaataagacgagttgtcaaacgttacaagcaaaaactcaaaatcccttatattatgagacggatggagtagtttgagaggtgccttgcattgggtacctcccaagaaccttaaaagctctgctttatctttggtgaagatgacggaagggtgcatatatgcgcagtcctgtatatatacttgaaacatggacaagaaagggattttcaggctattcaggtggctgaagaattgtactatcagttaattggacttgttaattagttgaagtacatcatgaagctgccagcacccaggaggcccaggagggtaaaaggtgccatgagaattatatacgaccaagactgactaacgaatatattgtatacatgataggtttacctgaaagctgggaaaagaactcatgtgtgatcgatgcttgtttatgatggaacaaagggaatttaatctgtacatttccttcctttttttttaatagtggaaattccggccttggcttgaacagacgaaggtacagctaatgttatcttatacctacttaaaaaatcggcaactttctaatcggcaccgatgcattttcgtccgttgtcttgcgcctttgcagctcatgcccgcttcgtccatttgctcacgtcgtccacccgtgttcaaataaaattaaacaaagacaggctgagcggataccaagttcaacacaaaaggtagtcggatacggatttgatttggactcaaaaagtgataaaatcaaccccataaatacaacaaggattgcacgggatatcaattgctacaataagaaatcaagcaagacacatagcaattagtgagatctgacataatttcatgaaggtggctttgacttgcagtgtcgagctccgagcggcagtgcacggctttggtgagggacggaagctcgatggcatctccccaccgatgagacaggttcatgaggaaccagaggaggcctggtgaggaagtggagtgtaacgccccgatattcgttagctataaacacaagacaacttacaccagggtgttatgcattacctgtgagatagtaccagtcccaggatacactagctagtacacacagaataaatgttgaatcacagtaaactgttttattatatcactaggtagtagtccttacaaacgttgccatcatggacaggcccatagataagcaacacaacattacagaaaaccataaaagcgacggcatataagcgaacagcgcggagacactaagcgactaagcaactaagcactaggcaaagcacctagaaaactaacttattccacaggcgagactttgggctaggcacgaaacatctagaagtcttcatactcggcttgctcctagagacactcctcagcggtcgagtcgacatcttcatcctcgtactctatagattaatgtaagggtaagggtgagtacttaacgtactcagcgagctaggggaaagaatgacatgttcggtttaaacaaggagactagggttttatttgcggaagcggcctttttggcaaagtgatttatttcacaaaactcctagtgagtcaaaatgttagttgtcgggaggaggctcacgcctcgacccattccacaagttgctttgcaacaacttgtcacaagattaactaacaataattaatttgcttcctctgttattttctgttcactttcacaacaacatagttcacccagctatctcagcacatcaacaccttctcgcccctaacgacatctcggtgttagacgacaccccgggtcacacagatccattcctaactacaaaggttagccgtctgccacataggcggactctggaaatgttttccttcccaataaccactattccttaatcatttgtcaaatgaatctacactatgagaaacaccttacactcgcccttgaccgtgggcacggctgttcgaacagttcattaatctctgcagaggttgtacgatttacccacacggcacgaaactgacactgtttactcgtcggtaacagaagttcgtgataaggcttttccaaagctaacccatgaaaatagcatgccacctagttgggctaagtctcttagccgagtatcaggcaaggtcagccttcatccactcaggaaatatcgaggatgtctcctactaatatcgcgtgccacaatagaggcaataaaaacacccaaaagggctataaagatccaaacttcgtctcctcaccctcggcatcccacaaccattggcacaccgcactcctatgtgataacaatttacttagccagaggcatcccatcaacacccgtgtggtcgcgctgtaatgtgtttggatggattttccaaaggaaacggtccttaacgataatacgtggccaaaccacaaaggcatgactttgcatcatcactatttacacagcacattttatttcacagcacctcggtacaacatactgaattttttagcatgtaattggaataacctagtttcctacacggtaaatcaacgttagcatggctaagcaaactacctcggtagtcgcataacgataccggcgcaaatatttgtggagctatcaaaggtaaagaaacaacaacatatgtaaactaactgcaactaatatgtcagtccgtcggttgtataaacaatccgaggcctaaacatgtttatcgtgtatactaagcaatgcacttatcaaacaaacatatcttgcaaatataggggcaatgtgatcaaagaggcttgccttgcacagggctggggtcttctccctcaaaagcggcctccaaagcttcctcgtactcaggctctaaacgtgaaaaacaaaactaattaacaaaaggcaataaaacaagctcaaatcagagaaacaatgatgccactgtgtagatctcaattttagaaaaatataggaacttgaaggggtcaaacggagttacggttgaatttctatgaattttcaaagattaaaaggattttttggaatatttggaaatctatttattaacggaaagggaatattccgctaatgcggacagcaagaggggcccacctgtcagtgactgaaagagagaaggaggcacggggcccggctatcagcggtggggttttcttcttcctcctctcgctcggttcagctctggggcggaggcgtgacgtggcagcgaggctcggctcggcgaccggcggtcggggaggcggcagcgaactccggtggagctatgccagcgacggcggcgctgggaggcgaggtgcggcggcttgagcagcggcacagacaaatcaggagagaagagagaggagagatgggaatggcgtggtgagcatgggggctcgggcccttttataggcggcgtggcatggcgggacgtggcggtgagctggcgtctaggcgcgggagaactgtgggtagctggctagccactacagcgggaatccgggaggggatggcgacgcgacagcgtggcgtcacgcaccggtggcgatgcgacggcgaaaacgacggtgacatgacacgaggtgacgcgcggagagagggaatggcgacgggacaacgatgacgcgcagtcgacggcagctacagccaagagttgggacggtagagctcagaacgaggcgacgggagcgacgtcacgcggtggtggcgacacgacgcaagagagagggagagacgcggtcttggcagcttcccggagtggatgggcaacaagacgacgagacgatggcaaggggacgcgcatccgcgagaactcgggatgggacaatgacggaacaacagatgacgcaaagcgacgcggcgccgtgtctcccggcaggaattcggagcgagggagcgggattcacagctgctcaggaaacttctcatcaatcgagctagcagaagtggatggttcagtgagtggctcgatcgttagaggttcctctatcttggacacggatgcctccggctggggttcattggattgcgtcatgaaggaagtattttctagaatgcgatccaaaattgtccttccttctgacggtgttttgtgcatgaccgatcctccagcggttatgtccagatagaatgcagactccttatccaaacccgtatggaaatgttgaagaagcacatactcgggtaaggacagggttggtccggattgcactaaattagtaaatctggaccatgctgcaccaattgatccgttcttgatctgtttaaaactgagaatttctactcgaagggcagtaatacgagtaactggaaagaaggcaagacagaatctgtctcgcaacttttcctagctaccgtttacacatccaacggtagaggtgtaccatttctttgctctctcttgaagagagaacatgaacaatttccaccgcacagtttcttgtctcatgccacgcatcttaaggcacgagcagacttgttcaaagtctcgcagatgatggtagggattttctagatcaaagccagaaaaaagatttttccctaaccatactaattagttcgggacgaatttcatagccagttgtataaatgggctccgatgaagaaggtggctcatagaattcgccccgaggagcagacagctaaaaaagaggttgctccatggtcgagaagagtttgacaggaatacttctctaggatagcaggggtaaaggtataataaaaaacttaaaaatgatacgaggatgaactaggttcggaaatgatcagcaaccgttccccggtgacggcgccagaaatgcttgttggtagttcttacgatcacagataaaatccgcaagcgcacggatataccgatgcagtactttccctatggagtattccaagggtattgaatccaagggaacgtgtgtgatcagatcttccttcagttcatccaaggacaccaagcagatgataggctaggatagagaggatttagtagtgagaaacatctagggaaagcttaattttaatcgtaacgcaatacttcaggcactggaaacccgttgttcccagatatcgctctactacgtacccggatagggaggacttaagtgatctcgagggctgtcaccacctctacacccacctcaaacgtactgtgggatacgcagtaattactggataacaactacctaaacaccacgtctaagcaattaatatctactttagtttttataactcactaaagcaatcactatattttagttggttatagtgaacaataatcctgtatgctatttaggaactaaccaagagataattctcatgagataaatctaaattactcaagaagaatattatattgaactcagagtaataaacagaataaaagaaataggagaagattaccgacaactccggaattcttccgacttcttctattctactctcttcctattctagtacacaatatagtacaatagagcctcttataattcagctcaagcttggaagtgtgtgtgagagtgaatgaagtgaggtctatttataggacaggtatgacggttataggaaggggaattatccgaagtgccccctaaccgccatcaggaatgcatctggagcgtccatgccaaaacctgggatcaacggtgatcaccagggttcggccgaacctgggctgggcccccctagcctggcctttggcctggctcctctcctggtcctcatctatccattcttcagagttttgggttgatttactgatgttttgatgaagttccctcctggcctggcctttggcctggctcctctcctagtcctcctctatccattcttcggagttttgggttgatttactaatgttttgatgaagttcacaacccctccttgtatggatacgtaattctcctcactttagtccagatttcctcccaacatcaggttttatcatctgcatacaaatatacaccaacactgtggaatatatgctctattatctgaactttatgtagatgttggcggtatagaattgacatttaacagccgccaacagtgatgctacagaaaacatgtgctctcatttatggattaattaggcttaaaaaaatgtcacgcgaattagctctcatttatataactagttttgtaagtagtctatgtttagtccttcaaattaatgtccaaacatcatatatgatagagactaaagtttagtccctggctccctgcatccaaacaccacctaagctcaaagcctggtttggttccccaaacttttttcccaaaaacatcacatcgaatctttggacacatgcatggagcattaaatatagattaaaaaactaaatgcacatttaggggggaaatcacgagacgaaccttttgagcctattagtccataattagccataaatactaaagtaacccatatgtgctaatgacgaattaattaggctcaaaagattcgtctcgtagttttcaggcgagttatgaaattagtttcttcattcgtatccgaaaacccttccgacatccggtcaaacatccgatgtgatacccaaaaattttcttttcgtgaactaaacaggtcctaaggggatcgatcttatccaaacccgttgactggttgacgttaccactactggggaagggctctttattcccggtttacaaccccttttagtcctgggttgcaaatcaggacgaccaatccgggactaaagatataaacgggagtaaaaatgaatctttagtcaccgttggtaacaccaaccgggaataaagttcccagcgccattttagtctggttggttaggcgcttttttttcctttatttttttgcttcttgcatttattgtcaccttcaaatccacacaaatcatccccaaatcatgcacaacaaatcatccacaattctcagcccatccacaaaatcatccacaatccacaagtcattcacaaaatcatccaccaaatcatccccaaatctaaaataatttacaacaaaatttacaaatcattccaaaaataaaagaaaatcacaaaacaagccgccgttggccacccagccgtgtgccgcctcccggcctccgccgcccggccgccgctgctcagccgctatcgcccggccgccttcgcctggctgcctccgccagggagaggagagggggaggagaggggaagggggacgaaggggagaaaaggccgggagagggggaggaggtggaaaaaaggaggggaggaggaggagaagaggatgagagaggggaggaggaggagaggaggaggggataaggacgagcggggagaacaaggcacggcgcgcgggtcgaggcaggattttcatgatttttttatgttaccaaccgggactaaaaaataataggactctgacatgtctttgaaccgggagtaaaaataatacttagtcctgattggtaacaccaaccgggactaaatataaaaaaaaaattattgtgtgttttcaaaccgggactaatgtgatttttaagcgatccagcaaaatcatttctccagtagtgtcccaggtttttaactgggaaaagaaaaatctaatgtttttctacaacatggaagctgaatatatgcgtgtggtgtggaacttggaagggacagacgcggacacacatgaatgcggtggtggagccattgatatcgtgaagcccgaatgagtactaacattttccagtaatattcgactaatttttttagacatgaatggctattaatttacagtgaagacgttagcggaggagcctggacgacgcccgacctgcccggggctagctccgccactgcgtgatgaatgggctacacaatgtgggcctggatgcaggacgctcatgtacatattcgagaggttttctagaaaaggaaaaaggaacggttcggtccggcttgtactgtttgagtttagtcgatggttcaataactaaaacagaacaattaattgataccaggatttcacatattgagaaattgaacgatataactacaaatccgcagaaatgtaatctaggtccaattcaaatgctgatcaaacatctatacgtgtgggcttgtggttatttcttagttagtatcattatttatgaacatggaactcctattcccgtttaagctgctcgcgtagtacaagccctgttaattcatgttattttatgagatcactgaaatttatccgcatccgcatgcatgctgtgaggtcaacgaaatgtaagagctcgcctagaacttgtgacttaattagtaggtcatgtttggcataactccaaatctaatacctatgatagatataaagtttgtatgttaaactatagtggtttaaaatttaaaattttatttaaaatgtgaacaaaatgatttatctaaatgctatcagcgtaaccgtagatccatatccatagatttgtggagctgaaaatactcagctctaaaaaatcttgcatctctggagctatatcaaaaagtgtctagtatcaaaatttcacctcttgaatatggtatctcaatatgctctcctaaattaattattgcttgaataccatagtggccgtcaactccttacgcactcactatttgctcctttggctctctccaccaattgttgaggtgttgttgtctttgtttgcttatccgttagcgcgggtgttttatcttttcctactatatgacttgcgtcttttattttactggcacttaatttgttcgttttgtttatatgtattattcagcttcctgtctataagttggcagggttttacccatcatgactacatacgtaaaattaaagttttttttatccgttgcaaagcacaggtattttgctagttatttggtagcacctaaggctatcaataagactttgaaatatgacaagattataataaacgataacacccactagagtgggacaatctgttcattggctggtcaattccgtgtatcttctgtgatcgaagtagacaatcaagattcttcactccacatgcatgaaagaaaggagtgcagaacttctgcatgtaactgaaaggatcattggtctctctctctctctctctctcttacccctctcatgtttttactcatttgtttttcatttattaatggatcgatttttacatttccttggctggtcaattctgtgtatcttcagtgatccaagtagacgaaataaagattcctcactccgacatgcatgaaagaaaaaggagtgcagaacttctgcatgcaacttctgaaaggatcactgatttttagctccaaacatcacaggattcataagctgaaaagttgcgaaatacacaaggaaattgaaattacactcacagacacatggtacacaacacatgtactctcgtctctgctcctaaatactccatccgtccctaaatatttgacggcatttattttttttaagcatgtttaaccgttcgtcttattcaaaaaattttataaaatatgtaaaattatatatatacataaaagtatatttaactatgaatcaaatgataggaaaagaattaataattacttaaattttttgaataaaatgaacggctaaatatgtttaaaaaagtcaacggcgagacggaggaagtatataggcgacgttgacggactaccgtggcggcgccgacatggagctatcaacgtcgtcggcgtggcagcggtggtgcggcgaggcctgctcgacgatgtgttgtggcacggcgggcagcttgccgccgccggtggcggcggtgtcgtgcacgggcgcgtggatgatgagccaccagatcttgcgcaggagctccgccgcgtacacgacgtagaggaagacgacgacggtgaggacggtgacgtagatggagcagggcgccgcgtgcgtgctgccggcgatgtaggcacccatgaggcacaccatgtcgagcaccgcgatgatctccagcgccaccaccttcgcctccgagtggtagaacgactcgttcatcagcaggatgatgatcaccaccgacgtcacgaacgctgtcgcgttgaagtagaagaacacggtgtaccttatcacatgcacatcaaacattgaaaagaaagattaatggaggggtctcgccgtggtcggaggcaaaaattagttcgtcgttgttacctttgtgggaagttggactggagcaccggcgtgccggcgacgtgactctcaccgtcgttgtgctgccagaagccgccgggagggttgagtccggcatggtaggtgacggaggcggcgagcacggcgagcaccatcagccagccgctcatctccttgagccacttctcccgcttcttcttcgcctcgttcaactgccccagcgccgccgcggccgccgcctcctcctccttcttgtggtggtgcaggtacagcacgcccgtgtacgccggcggcaaagccgctgcgtccccgtcaacgccgggacgggaacgatgggagatatcaggacttgcacggggttccccgtggccggcatcgcctgatcgccggcggcgtcgtcggcactggcgctcggaggttggccattgataaggttaagatccatcagtatctccacggacattgttggtgacgggattcttgctatctttctgcaactcggatgatccgatcgatcgagcacctggttgatttttactgatgctgaagtgtttcaggatttcagctaggagatggatctctgtgtaagtaagtatataagtactccaagctgtccatgcatattgaagctaagcttgccgacgattggcgcacacggtccatgtggcacgtgagtgcgaagcgtagaaccaactgtccaggacaggctgtcactgcaagagagctcggcacatatatatatatatgtttagattcattaacatatatataaatattggcaatgttagaaaatcttacaatataaaactatatgtttagattcattaacatatatataaatattggcaatgttagaaaatcttacaatataaaacggaggaagtagttgttagtactcgtttttttgaaaaccttgttagtactcgttaggctgcattctgtgtaagactcacgacctcgcgtaacgttacatactgtaagagtcacgtcacgttattaagatcattctgttaaaccagcatgaatgaagtatgaaggttacactgatctccatcttaaaatagtaaccaaatgttaaaattagacacacaatctatattatgtttaactgagggaataaacaaaagtaatcagtaaacaccatacatgacaaaaatgagacttggcaccgttcaaatcagatgggcttatcggccgcacataaatctagacgagttattggtgttgtgaaacaaatctctaggagataagtttcttgtgggccaatctaaatcagagtagagataagttctatctcctcctaagactcctagatatacaggggcagggtgtaatatttaaggttggcttgtactccagatgagatctataatgaagagagaactccaccctatatttgtgttcattgtctacttctgcaatgttcttgagggcaaaggaatgggcgcgggtgttcgacatgatatcacgtctctattgttgtaggagggacagggaaaggatccggtgatccgctaataggcgtgttggtttacaacacgttatcagcagctcttcgttcaccggtttgtcgttccaatctattgctattagattgattttttttaacgacagattgatttgctcggttgttcttggcttgcatgtaccggtggatttgctatctaatatagcgcagtgtcgtctgcatctcttcatgcacgacttcacgccggcacgacctagggttggccttgtaacgcgcatgtatggatgcatcttgcgtccttggatgcttgagatcgatcggcaaaaagcatgttgcaagcatgcatgcatcagtatatgcatctaattttcttgttgcttaggccttgtatagtttggttttgcgtgtgggtcctcggactcgtaaataatcatgtaatggtgcttttaaacattctaatgcttttaaagttgatgcaattccaataaaataatttagatacggatttctaggttatgatgcttccataaattgtgttcacatagtgttgaatctccccttggaagcattatgatgggtttattttcctgcatcaatatgtgatggttttctgtgtgacataaatattgggaatacaatgctaaataagaccaagtaaataacagaaaatcacctaatgcatgaaaattctgggaaattgaatatccatggctatggataagaccgctctttactgataaactccttcatacataaatggtgatattaatgtgtctacaagatggagacacgtattcttgttgtacgagatccatgcttttgccgaattcatcacgcatattgtccgtttgcgtcttgggttctctgagaactgcatgaaatgatttggacagatagtgtgggtgatttcacgtaaaggccttcaatgactatagctttgggcattaatgtagatcactctatccctatgatcacactcaagaataggattctgagtcgttgaaatgtgtgaaattagattatgggcttgggattctctgtgcctttcccctagtggcttaacatctcaattagagtacagtcggactacggtcgacattttgctttcccaatggttgagagcacacttttctgatttggagataaatgattatacctcaattttctagcaacttggagttgcgaggttcaataatttgagatatttttcactcggtccggtgaaagatgtaaagtgttttccatgtggtggaatgacattgttcatatggttgcccctattgtgcacatatcttctcaatattattttgaacctgatgtcttgcaaggacaccggaaaattggagccaaatctagcagaataagcccgagggtagatactgtgaatatgcatgattcccacttcactatagcaccaacagctaaacttgggtgttgacccaatctcgatcctcgcgtggatctagcgctaaatggccacctttggttgatgaccaatggttggtagtgtttgtctaataaagttgttttgacaatgggagttgtatggctagtttcgagcatgtcctaggagaacattggtcggctatactgttgtctgttgccaagcagtttatcttttgcttagtttggaactttgcattagatcgatattttctagatagataaagttcttggtctttcctattctattctaaagcttatcttcatgctggaattgacaaaatgctttagtttagaagaacaattagtgtatgatccaaggagttacaactactaacacaattcggtgtaactgtatttcagacaaatgttggctatgcactattgtgttttatcgtgttcttgtagtcggtgactactccctggttgtgttggttgatcagccatcggttgatgaccatgcttgtcgcacgctggcgtttttcacgtgtggacgtgtgcaagccatgcaaagattcgtcgtgttgcataagttgagctcgttgtgccaacgatgattgcatcgacacaccccactatttttgtggatatgtctgaacataatggttttatagtgaatattgttggaggtattgattatctcccgatggctatgtttaggggacataagctaatgtggtttgacaactcgcttatgaatcgtacctaaaacatgctgcttaacatgagtgacccaattctagaatttggtatgagtaattggatcgttcttgcagccttgttggaaagctgccatcacctccgtgttagtgacatgcagaatggtgttgcgacgttccgtgaagcggcgaatgtaattggagaagcgttcgtcgttgccttgaacgatctggtatagatcccactgagtgcccgggtggggaaaggtgccctggaagttgacgatgaactgccccttcagttcgaaccaactgttgatggtgtacctcggtagccccgtcacccatgcctgggcggctgtggtcagcatgactagcaggcagtttgccatgactagttggtcgcccccggcagcttggatggtggtagagtagacggaaagccatgcgctggggtcggtcttgccgtcgtatacttgttgatgcccatgggcttgaagttggccggccatctgactcgacgtaggttgacggtgaaagctggtatgccctcggtgccgtcgtcgcggtgtgggagggggtcgggcaagtggttgcggtagtcatggtatggtcgatggacgacaatgtgttgacgaaaaaaattgaacacaccggcctgggagatctgcttagctcctgtgcaggtccaaagattggtaagatgcgggtgtgccagtcagtttgatcctgcaactgacaagatatgcaaataatagacaaaacagccgatcggctgacaagccgatggagtagttccagccgatagccgataatagccgatgccgataccagccgatagcgatagggttttgagcaatcagctatacgtctaatgtagattctaacactttagtaaataatgatatataggcaatcaactactgataataaaatataacaataatattgtccagtataaaccaatcgtctagcattgatatgatagaataagcactgatctgaaggttaaagcatacatcggctggagatccgatgtcatgaaatccacaaggttagattaaacagtgaaacctttgttgtcatcggctaaatccaacttatatgtatatgcaatccttatgagccgatgcaacgtccagataactcaccggctgaaaccccgatgaaacccttattggcaatcaagaagcaggctagagattatgtttcaaaacccgacttagtagatcaaacttaactgatgcagtactaagtatgaaaagaaacataatatctagacaatcaagccgttgactaagttttcagggtggtagatgtctaagctaatcccgataccggcagaaaccctaaaacgagaagcagccgatagagctaaattgatatgctaatactagattaacagagacatatgataaataggtaggcaaatatatcatccaaaccagagcaatccaaaaggtcgaatgtactgatgcagccttgaacgacgccgatgtaaacgatataattgcctgggccggcgaaacatcggtgcagccccgcgtcaggtgccaagtcccgccggacgataaaataaagtagaaaaggtaaaaggaggcgatgcgccgaattgtattgatcgtgaagataaattacatagacctcgggtgtacatatttatacccataggttgatacaagtccttctcggacaagaaagaaactttcctaaagataaaaggaaactaacaaactattcctaattaatagataaactgacatgccgcatccttcttgaactcggactcttctggataaattccctttagttgatccgactccatcgagaacacggttgctggcgatttgacgactctcatcggctgattccataactctgaaggcgatactgactctaagtcgatgatgactttgggctaaccaaatttcgttgttaacacaatgcagccgtccggctggacgtcggcgtggcagcggccagcgtagatgttgtcctcatgtatccgtagacgttaggcgtcgcggagctggcgacgcttgttcatgacgttgcggaggtcggcgtttagccgacgtcccacctcgatcttgtcgcgcaggtcgctggtgcgcagacttgggtgtgaccttcccgcttgagatgcctcgacacgccttgacccggtattttgtggccgggatggtctcttgccagaggagtcgctggcagtggaggcggtcagtggtacttcggtgtgctggacagcggcggcatccaccatggccttcacctgagcgatggtggtcttgacggccgggtcgcctggaatcggcatgttgtcgaggagggccttggcggctatcatgttgttctgtagcgtggtgaagacatcatgttctcccaacttgacttggaggatggcattttgggcgagacggccgcgctgtcgcagctcgtttagacgccgagtgaggtcctcctgctgctactggatacggcgcttctcctcttcgtactcccttttctcctcgtccgtctcttgaaagacgatgaagacctcgcgggagtgatggcttgaagtccgggtgttgttggagcttcccgagtccgagtcggagagacgtacagactcatcaaggaaaccaacccagcaggatctgagctcccgcggcagtcgaggacggtgacgcggagcggccgtggtgtcccgggcaccgcgggggtttggacgtgatcgggcggctggtgtcgaggttgccgacttgaaatgccttggcagaggaagcaacgaagttgctgataccgagaggtgctggcggtgtagttgtcgatggcgtgagttcccacgaagccagcttgaggacgccggagttggtggcgaagaagtcgagactgccgaaggagagagcttgattcctggagggtagcggtaggctgtaaccggcccgatgacgccgaggctcacctgacagaccttgccgaagctgtcggcgatgaagtcgaatgcgccaaaggagatttgggtggtggcagggaagtggtggtgttggtgatctcaacgccggtggatgccatctccgccttgaaaataatcaagcgccccctacctggcacgccaactatcgatttcttggatcggcaatatattttatggggtgcgctagataagaagagatggtgacacataagtttatcctggtttaggccctcagagtgagataataccctacgtccagtgtgtttaactctgtatccggtggaaaaatgatccgaagacctccctcagactgccaccggcgccttttatactggcttaggcccgccggcgctaatcagggtacagtatccttataatctagatacttgcctactattacatgatacgtggttcattgccatatctgctatagcttaccaactatacaacacctaccatactcggaattgggtcttcggcccacccctgaggacgcgatcttagtcctcaatatggggtacccgggtgccacatacctcacactttttatgttggttttaatagttagagagggagtcattattacgaatcagattcgacccatatctgaggtagctaaatagacttttttttcctaattccacgaaaaacttaaagcccatctgaaatcgttagttttgctcttgctcagttgccagggcccatctgaaaaaattttaaagcccaaataatatggaggcctatttcacctggttttgcctcgttcaacgccactcccctgcaggaccaaaccaccaccgccgccacttgtgccaccatgcatctcgatcgccgcctctgaccaagtcaccctcccacgcccgcgcatctcccgccgtccacgcctccacgacgcccgccatcgacggcatccaccaccgccacgtccgcaaccgcgaaaccgcactcgtacgtccactcctatataatcatccctcctcccccccggccggagagatcacgacatcgacggatcatccaatcatccaatcgctgagctgagccaactgtattagtgttcgtccatctgtgacagttagcaacagaagtagtgttgctgccatggccggagcagcgctgctgttcccggctaccgtcatcgccgccgcctgcgtcgtcctctccggcggggcgtcggcggcgccgccggggcgcgtgttcgtcgtcggcggcgacgggccgaggggttggagccagccgacgggcaccgacgagacgtacaaccactgggcctcccggaaccgcttccacatcggcgatttcctcggtgagatcgatcgatcgatcgccatttccattacatattgcttgctgcattgcattcgtcgtccatggtggtgacatgatcgcggcattgtgtgtgtgtgtgagtgtgcagatttcaagtacgccaagaacgactcggtggtggtggtgtcgcgcgccgactacaagctctgcagcgccgacaagccggtgcagcggttcgacgacggcgccgacgtcaggttccgcctcgacaggaacggcaacttctacttcatcagcggcgcgccgggccactgcaaggccggccagaggatgacggtccgcgtcatggcggaccacgccgccaagggcgccggcggcggcgactccccggccggtgcgccgtcgcccgacggcgacggcgacgacgaggacgacagcggcgggtcgtaccgcacgccggggtacggttactcgtcggggtcgccgccgacgccgccgcacgggaataccagcgccgccgccgtcgtctcgccgtcgcgtggtggtggtggtggcggcggctaccaccgcgtcgccggggttgccgccgccgcgctgctcgtcttggcttgagatgctgccacgtggctacgtctgccgcttaattagctagactcagtgatgtagtttgtcgtgtgcttcttaatttaaacctatcatattagctagactggtgatgtaatttgttggctgttagaaatgttaaacctgctacttagttttcgttaattactggtaccgtacgtggtgcatggacgtctctgagggcctttttttttcttattaacatacataattcggttcttgttaccacgaccttttaactgttaaacaatatgttttatgtaaaaattttgtatataaaaattactttgaaatattaaataatcaaaaaaattaaattttaaataactaaaacttaattaatcatttgctaataaatagggctgca

SEQ ID NO: 36104 - DNA, 1158 bp, Oryza sativa
catatactaatagtataataaacaactattgtataaattagctattaaattggctatagataaattagagccagtagttggctataccattaaccttgctctaagagcacccgcaatagtaaagtaaggtgctatctataaaacatgtacatctcagcaatagactagattaatagtaaaccatctcaatagtatgtctacatgggtatctatagctctctaatacattgcctcgtttttctctatagactatctccaggttagtagatagctttgctctctctcttcatttaatctcttccaagtaggaaaatatgctgacatggatctcttatagagagcctatagataaccattgtgggtgccctaatactacatgcataatactacatgcagtcatgatgacctgtgaggctgtgactgttgggaggagaatgaaaattgatgtcaccggcaatccggcagtcctgcagacgggcagaaaaaatgtgtctgcaatgtgcagactctacttggtgcatactgtatgcagtacgtaaatttcatccaaatgccaaatctgccaccaaacgccttggcctcatatgccattcaacatttcatccagatgtactatacactacggtgccgttcttacaagtttgtataacttgaattccatagtccagactgcaacaatccgaaatccatgaaaagtataataacttaaagggtgaattaacttaaattctaaattagtactacagttcatggaacagatacttcctataacttgggaagttctctgccgaaaatcagttgttctgctcagggtacccttttgactgctccagggaatcagttgtgttccatgtctcttagttgacgtaattttgtacaattgcttccgcacaccagtcgtgcactcgtgcttccaatgttatgcctggcgacaaactgccagtgacacttccacagttcaactgatgctacacgttggagcagatttcttcgtaggtattacctccttcctgaaaatataagggatttttgcattgcgaaatcccttatattttgagatgaaggtagtaacatgcttttcgtcttccacgagtttatatagcctaactgccagagtgtctcacgatataaacgtccttccatttgttgttattggta

SEQ ID NO: 36105 - DNA, 1388 bp, Oryza sativa
caaggtttgttcattacctcgtgaatggcactgcataagaatttcatttcactgcatcatacaatcatagttgaatatatgaaaatggtttttcagtagcacaacattgtaaatgtgaacttgctgccatggcaatgttcttttgaagtagtcattcataaatcatggcttaaattcactgcgtcatatgccaaatatctgcattcagcattcgccttctgtatggccagttgcctggtaaatggattcagcaaacaaacaatatcagagagtacttgcgactacaattctgcagttatcctgtagaactgacaatatgaaaccatatgcagactgttccagcatctgctatccctgatggttggatgggccttgatattggcccagactccatcaagactttcagtgaaactttggatactaccaagactgtcatctggaatgggcctatgggagtgttcgagtttgagaaattcgctgctggcactgatgtgagtactgtttttgaacagatttatcagcacaggtttttgtgtttgaagctaaatgtgttcttaatcaattcaggcaattgccaagaaattggctgatatcaccgccaaaggtgttacaacgatcattggaggtggcgattctgttgctgctgtcgagaaggccgggttggcggacaagatgagccacatttcaacgggaggtggcgcgagcttggaactgttggaaggcaagaccctcccaggagtccttgctcttaatgacgcataacactgggggcaagcatatgacccaatttccctagccttttgcggtggtctggttcggaccttggtgtaagttggtaaaaatgcaaagtcagtcgtctgctacctttgaacttgaaataggcttcgcttcaggtattgctagatgacagtgaataataataagcttttggcgtcctcggcatgagagaaatgcccggctcaaacaaactataatggtgtactatattttgccatattctagttgcagcagtttacactaagctataatatcgctcttgctgttatgaatgagacctgtacatgttgtgtatggagacaaatgccactgtgcatactgttttaagccttctcacgtgaagcttctgggctgccagtttggttttgggcgttggtatgttgctttcagattctatgtatcatccaaagctaactttgtgaatagaacttgatgatgaattcgttgcaattagatgtcatggaacgtgaggatggctagctgtttctcaagaccttttctgccattagttttcttgcagtaggcttttccaatgtgcaagatactggaccgaaacctggcacgatctgtgtcgcggttaatcacaaatagaagaatcttatcatatgttg

SEQ ID NO: 36106 - DNA, 853 bp, Oryza sativa
tagaactgcagaagcaagttcagatgaactaacaatgtccctggagcattgtttttttgtgaaaatgtatatatagcagtgtagtaaatgtgtccgaggaggaaatgggggacaaaattgctcagagttccaactgagaatgtatcaacagttgtgagattagatagcaatatatcgtactgtatcaaatcatcaagtgcacacaaagaagaaaaccatgttcaagagaaaatgagaagtatatggctaatagtttaatcgttacaggaacaaagaacactgacctcctttctccatagtccatagaagttcgggaaaaggttgcatcatatagcttgtcagcttatagtgatgacctgctgagaaatcacagtcaaaaaagaactacagatcaacagctcgatggatcagaaacaaattgcatgacaaaacaagataacatcgatcagcaacctaccttaagacaattacgaacctgtgatcgaagactggagccccgatgagatggttttgctggtagtgagagagtgaagctgcaacatgatctgatcgatgaaattaaagacatggatgccttcaaaccgatcaaatccatacatagctcagaacaacgaatgcagatcgagatcagaactgcagtagcagctcctggctgaattcaatatattcagcagtgcaactcatggaccagatcatgctggcagcttcagcctctcacaccagcaagaactaatatcttctgaccaaagaaaaatgcgtgctcaaacgatacttctggcattgtgtcaatccatccatctatatgtatatcatcagtggcaatttcggtagggcagtgagacaaaatcttgcg

SEQ ID NO: 36107 - DNA, 161 bp, Oryza sativa
cagacatccacgaaggtcacgcgaccgccgacaacccaccgccccagcgctgggtgtagggctttcggtcgttccctacgtgatgtccgatggcctgagagattccgacccggggccattgaaaagtatgatgggagcaccgaccccgaagaattccttca

SEQ ID NO: 36108 - DNA, 1105 bp, Oryza sativa
tgtttaacgcgccgttttgcattttagcaagcatctgagcccagaatctgggattttacgggcgagttaggccgtacaatctaagattgacgtactgttcgcttaatcattttgtaacttgaatccttgatagctcgcctgtttataccatttcgtagttttcaagcaatatgctatgcggctgcgcctcaatcacgattggcgattcgtttgttcactactgctggaaaggagctacaccaacccatcccacgtacgcaatgcaacatggctccttaccagcagctctccacaaatcacaagctcaacaacatgacagtgcgaactttgctaccattcacccatataacaaaacaatgggagacgttaagttcgaatatacacgccgttatagcacacagcagaagtgttcgggagatatgaaattggtaaaatactgcagaacatatatatccgggcgatatgaagttggcaaaatacggcagaacatatatattgatttatgccatcggttataccaagtggaagcataatctggaagtcccacgcccattaaaaatataacccttaaaaataacgactacactaattacctcggtacagcaaatttgatgaaagcatctataattctgtttgagaacagtattccagacatcaccaagtaaatggatgaatatatgctgtagatccaaaaaaattgcagtacaacagtaacgttttcacatatgttgggtctcacaaatatctattatgttggatagggaatgaacaaattcatcaaaacttcaaaaaaattattgatgtcagcgtcactagttaacttgacaaatccagtgcaataaatgaccagaaacaagtatgttcaagagtcaaaacaaaaacatgaacaactcccaaaataaacaaacacaggatgtgacgcatcctagtaatactaatttgaactgacgtcacatcttatactagatttgtttttttgggacagagggagtacattataacaaacaattcagttacaagagaagcaaagtaaggcattacgtcaaaaatatgacaacagataattgccacacgatacatacaaggatttacaggtgcatgaaag

SEQ ID NO: 36109 - DNA, 1881 bp, Oryza sativa
cccacgtgttctatacttctgtgccctaagaggcatcgtactccaccaggcaccagcctccatgacgagcagataaggcaccagccattgcggtgaggaagaaggtgactgcaagccaactagggttctaggatgagcttacccctatcttcttttcctttttctactgtttttttctctaaggccttcttctttcccttacatatatgaaaagtcaaataaaaagacaagacaactgggagaaaacaatactgtgtaaagggacgctacattgattcacaagaaccaatttcatttggaaggaaggaaaacagaaccaacttaaagaaacatagcaagataggacattcccttttctttctctctctctcttttttttttttggggggggggggcagaaagaagtagagaaaggattacagcacttgttcagctgctaaaacacaacctagaggtaaaagaagatagctatgctccgattgcacaaaactttgaagggaccaccaccacagacaatacagctctagagataggccagagatatttctggtaaggacactgaaaaattaaatatggacaaaaaaaagtacattttcagagccatctattagtaacatcatacaagaaactcttacacatattagtagtacgtatgcaagtgggatggatgacccacctactcaatctctgcacatggcctatagctatcgtacggcatctttatgaacaaagccagatattagggtaaagcaactgaatgatcagtgtgtgggttggctgaccaagcccagttacatacttgcatcctaacagaaaccccattaatcttatccaataaattccaaacaaaccggatgatgccgacaatactgagtagcaaataaaaggccaaagggcagatgctaccaattgtacaaatacagcccaatttacttatctaaagtatgtttaatcccacaaggaacaaaacaatgaaacccatatccctcacaaacaacacagtcaacagacaacattgttgataagaaacccaacgaatctaagagaatacaaggaaacccaacctaaaccaaatagaaaacaatccatctctaaaacatccagattggaaaaaagaaaaaaaaagaaatacatcactactgctttactttaagcattttctaatttttatcacctaacctaaacaagcaagccctacaatcaacggcatgaatgggaaacaacaggtccggttagatttcatgggaacatacatttataaggcctttactttaccctaatccctaaaatcagtgcaaggcaacgatatctgatgtaaattaggttccgagatcaacttggtctgggcgtttgtgcaaggggaccatgcaactgacgggagatatcgccgtcatcgccatggatgcgggagccagtggtcgggtcgtgccgtgcaacggacgccccccgttcaccgaacaaacgctaaccctaggtaccccaaccccgtggattacctgctcgaggcgtcgccgcggagggggagacgaacgaaccgcacgacatgacggtaatcgcaggttgtaatcgtcgatgccgccatcggcggcgggtggtgggaagggggacggtcatggcggctcgtggtcgtctagggttttcgatggcgaggcggatctagaagggagggggcgatgccgtcggtgcgagaggaggccggaggggaggaggaagaccaaaccctaggaaggaaatcgccgccgaatccgcctcgccgcgccgcgccggccgccggcgagaaggggggagagagagagaggcggatcgatttggggattttttccgagagggatgattcgggaaaggattaatgggcttcgttgtgggtgggttagccttgta

SEQ ID NO: 36110 - DNA, 713 bp, Oryza sativa
aagctgctgctaaagcagcagcagcaacagctgatactggaggaccgaccatgtaagctttctcattttactatttcataatcccttctgtggcagtggcactgagtattcctctttgtttattttatggaagtttcacaagatcattgcaaaggaaattccttctaatgttgtctatgaggatgagaaagtgctggcatttagagatattaatccacaagcccctgtgcatgttctagtcatcccaaagataagagatgggttgactggactagacaaggtatggaatgttgttcactagtgtttgcgagaggaattctcaatctctaaaactgtgtagcatgcagtatccatgtacttcgttatgtgcttatcttagtacaagccgatgccctttttaactgcctatggaagcaaaattgttggtcatgtactcatgcttctttgagcaagccttccatcagacattatcacctcatgttggaagaacatatttttaggctgaaccaaggcatgtcgaaattctgggctatcttctatacgccgcgaaaatagtggctgagaaggaaggtatagctgaagggtaccgtgtcgtcataaacaatggacctaaaggatgtaagcactcccatgccacatctcttttctacttactggggtttgcacatgttttcccttttcagtatacatgctacacatcatccttcaacgta

SEQ ID NO: 36111 - DNA, 788 bp, Oryza sativa
cctttttttgttactttctagaccttttcagaggataaaaatttgccatcgacaatttcgtgactcaaacattttggttcacaggggacttgtgacctgagcaattttttctgacaagcgacaactgaaactaactaataaattatgctaggttacgaatgtagcgatggaccagatataacacaagtggcccaacctgaccaagccccacaaggatttggcctgctaggtatgctcaaaattatgtcagtcaaggcccaaaaaatatcattaaactgggctagtgaatatgtcaaggcccaaaaaatatcattaaactgggctagtgaatgtgtcaaggcccttgtactcttcagcctagcttaagttatcagcctgtcttcaaggaaaattagtccagctggaggttgcaatgttgggttgggtccctactgagttagggggtagtagggcttgagattagaaacttttatttgattacttccagttagaggattttgctaacaatgccaattttggcattattctcaataaaatttaattcatgttctgttcttatagacttgaattgaattacagctgaagaaaactttgtacaaatctagtgtagacaatccatcgactctcttaacctacaaaatacactagggcagaaatcacctatagggataaatgtgtatcgctagctacaattccttcccattacaatctcatatttactattttctgatttatgtataaactctcaacgaactttgatggaaaaagaagtacatggagattgttat

SEQ ID NO: 36112 - DNA, 823 bp, Oryza sativa
ccaattattgtcacttggtacacaaacagtaggggctcatgccttaaccattctttgttgcgtagggagtacttgtgtagggtaactaatagccaaagcatcacaaatcacaaaccagaacttgacagaaaattggcctttttaaccagcacctgacaaccagccaattttctgttacagcacaaagtacactgttacagcacttgacaaaaaacggtgggcctgatcggaactgctggctgctgcagccgtcacgactgtggccgttttcagctgctgctgtagctgatttttagctctcgcagccgcagcggcggcagcagcaagcgctaccgatctctctcagtgtttgacatttccgacctctttaaaaataaatattttttatacaattttataaagctacttaaaatctgcaaaatttttacaatccaaaagaaccatttttttatgctactgctatttacattgaggtgttgctttgttggcaaatggcaaatcacactgaaactctgaaacccgatcatatataccttgacagcgtgaaatggctcgattaatttctctaggataagaacgaattcgcaaatgctcctcctacggtaaacaagcacatcaccatccagggtgcgcacgtacgcagcacattgcaattaccttttttttttcccttgcttttttgcagctagtgagtggagtagtgaccaacttatccacagcaaaagcaagcaaaccatggacgccctcgtatgcacgtatatccaatttatccagtgctgtgctaataaactgttaatccgtcgcatttacggggctgcaggaa

SEQ ID NO: 36113 - DNA, 531 bp, Oryza sativa
ttatttccggtgctctgaaaattcagtaaaatttgagggctccttttagaccaaggagaatttaacaaaaattctccgggccacatttgaatttttcttgcacgtattttagtgtttgccaatttctttttcgaattttaattaattctattattccttttagcgaatgaattttaattttgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaaacttcttcactctggactgcttggctcgatctcctgttgcagatggaatcttctcttcacctgacttgtccctggttgaacctttagctgactttgactgggttgcggcacttgaagatggggcttcagttccagaactttgcatagttcatatctttggagtcaacctcatacaagttacccacttcatgtcatgc

SEQ ID NO: 36114 - DNA, 2606 bp, Oryza sativa
ccccgccggaatcgagctcgcgctgtcgctctctctctccgcaatcgccgccgagctccggtccgctgccgtcgtcgccccggaccaccttccccctcggcgccgcctccttcggcttcgccgcatcctcgccgacctcgtccacccctccgtttcgctcgccgaccgccggagcaccgccgaccccgtccacccgagccgcgccgccgccttcctccgctccggtcgccgtttccgtcgtcgccgtcgacccggggtgagccgtggaccgccgcttcgtttccccccttccttcccctctctcggccgccgctccgccgtgcctatggccgctgccggcgaccataggggcgcgggcgcgccgcctcccgtcggctgtgccggcgtggccgccttcgggcgcgccccgcggctgccgcgtggggcccggccgtcagccgcccgcgccctcgggcgcggctgacgcgtggggcccacggcgccggccggtgcgagcccgtgtgcgcccggtccaccgtggaccgtggggctgccgcgtgggccccactcccgtggacccggtccgcgcgcccctcccctcggctgacgcaataaatccatttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacatttgggaaagcgagcaaggcaagtcacatcatccttgaacatattgaatcccggtttataaaattattttgatttaaattattgcattatcgctttatttaaattcccgcgctatcactgttttatctagccatgcctatttacctttgttatgaccttattattgttattgttattatttccttgttcaccctagaataaacaaaaccccaactagtggacactctactcatggtatcactagcatgagtttaggtagatggtacgctgtttaattaggtaacattaggtggttttacaactctagactttgggaattttctcatcacctggacactatggaatggtttaaatattgtggaattggattcacaccgcccccctctattcagaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtacgtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaatctattcgaatagccgagccctcggatatgggcaagcctagcaatgtacccaagtcagtgttataattcttaaaatttgctcaacaactaaaatgtggaatggttggcctgggttggcttgggacgagctgggacccaggtcgggttgccagttcggtctgaatcatcgtaggccttgggttaaggcaggttcgtgagggttcatggccttgattaataacagtgtatagctctaggatcgtgtttacaaaatagcttgagcaactaaacgtcttcaaatgctgtttactgcaactctaaccccttatattataattcccttgtactcccttgcatttattctgcatttgtgggtgtgtcttgttgagtacggtggttgtactcagtcttgcttaattttcccaagcccagatgaggagctccttgaagatgaaggcttcggtgtctagctcgtgcctgccgtcaagcgcctgtggtcttcgccctagtcttccgctgtttttcgttgtctttgtgtgctgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaaaacacgaggcctgggagatctgcttaactctagtgcaggtccaaagcttgccttcggatgtatgagcgtgccagttgatttgatcctgtaatcaacaagagatagaacaaagaaaccgcaattaatcctataaatgatagccgatcggctagatgccgatgacatatcatttatttcaagccgatgtcatgcgtacat

SEQ ID NO: 36115 - DNA, 1304 bp, Oryza sativa
agaataatgtgcaacagattagataactgatcagggctaattgtgcttggtggaatattaaccaaagtactccttgattacctaccagagccgcaggtcaggctggtcgccgtcgtgcggctgcggccacagctgcagcaacgtgctcgacgccgccacccccttctcctcctccgggaagaagcaattgaacgcctccgccgccgtcgtcgccgccgccgccggcggcagcatcgtcagcgcctccattgccgacgcctccccggaaccagggctctgccagttctcgctgtgccagttctcactcatctaaagccgaacaaattgagtattataatactcctaaattcaacgtccacatgttaaaaaaagaataaattaaattggaaatagttaacccgcattcacgggtatatttgtcatttttgttgtaatttataaaagttgaatttaaacttgtatgtttatggagtgaaatattttcatattgatctatcttatcagttcttttaaaaaaatttgataactattttatactagttacatgcccgtgctaacgctacggcgaaacaacaaaaagatatacaatatattgtttgggctatcaagtatagattcaagacattaattaagacttacatatgagcgagtttagttaagaagcttattagaagttcctcagttattatatactcgaaagggataaacaagccaaataaactacatccaggacaaggttcaaaatttgcaaaacaagccataaggtcgacccattcagtcgacgatgtattatgtcttcaacgtcttttctccatgtcacagaaaaaccagtaagcaaagaacaaaagtctgattgatatattaagttctaaaccgattccaggacacattcagtcaattcagttcaaatacataatcatgcgtttcaacattaattaaagtatcacattcatatatcagtacatggcttggcaaaccacaaagctgaggctgccttaatctaagctacaacaaaatttcttttttttttgcattttagaataaacagtaaaagagaatggataaatcacatgtcctgaagctgtaaatttctacgaagtcctgagcagctcaattttggagagggtagtagtgttgttccctttatggttcatctgatgcatgaagaaggcaagttcaatttctggttcagtaactcttgttgttcctactgcttccaggaagtcatataaaccagaatcgccaagaattttcttgcttgatgactgtaaagagatgaaagttcaaactggtcattaaaaaaa

SEQ ID NO: 36116 - DNA, 1349 bp, Oryza sativa
atgagtgatagaaatcatggcagcaagtatcattattgtgatcacattctgcatggagaaatgtattttttccaagaatataagcccattcctctgctagtaaagttcccatgtcaacctattttactttaaaaccaaagaaactgtaaataaaaaaacgagatagagatttgcaattcactgggtacaaaagttagatgcacttctttaacattttagcagattgcttccaacatatgacatcaacttcccagtcagttggttattttacaatcttgaaaagcaatatttttctatcagtccaactaatttgagaaaaaaaattctgaatgagatatgtcaagagcagttgtgaggctgaattgttcagggatgtatggaaagcaagcttgtgtttgacgcaacaaatatgtgtatatgtaagattgatggagtatggattctgagcgatagcagtagacaattcaatcaatattttatcacctaaagatcatgcatagtattttgacgaaacaacggcagatgtgcaccttcaagatgaagctttactgacgatccaagtcgttgagggggtctaagatccagaatccataaacactctccagaacacatgcattgcaggtgaggagccggacgggacatttcgccgagcaccccgcgttcattgtactctgaggaaaagcggcaagcgctggatgatgggttttgtttcagaatgcatgatgaatccggatgaacctccacgatgccaagttccggactggtcacctgctgatgaactgcatgatgagttttgttcaactactcacctctcacgggattcacctgctgctcccccaccggcaaggaactccatagctgcagctcacccctgcgatgcagaggggattggtggagacaggcgatgcagaggacggcgcggtggctacctagcgacgggagcacctcgtgcggcggggatcggtggagcagaacggcggcgacgacctggcgacgggaggacctcgtgcagcggggaggcggaggatcgtggagggcgagccggcggcggggatcggtggcagacatgcgatgcagaggacggcgcggcggctgatacggagcggagcactgatggcggaggtgcaggagcggaattccggcggagggcgaaggtgcaggtgtggtgggagagcgatagggagggggggggggcggtgcgggtcgtccgctgattgagggaggtggaggtgggatcgattctgacccgttcggatttaacgcggatgatcccccccgttgaatgatgaatgtaagagtgtaagagtaaaagatgagtaaaacgagttggtgaattatagggctgcagg

SEQ ID NO: 36117 - DNA, 868 bp, Oryza sativa
cacgttgtcggcggcgtaggcagcggatttgagctccacgatgaggctgcgcagggagtcgttgtggggggcgttgcgccgccgcctgcctcgagcatggcacggaccatgtggagctggttcttgccgctgaggaagtcgccgtgcaggcccgagcgagcagcccactgctcgagcttggagccgtagtacttgtcgaagacgacctgcaagaacccaccaacgacgcccgcggcggccgcaacatccatcgctgccgctgcgaatgactgcaaacaaacagcggaggtgacgaggtcgataggtagcaaattttgcagagttcttccagcttgctagttcagtttgcggtggttagctttaggtgaggtagtgtgtttgttacattttgtagttttattagtccgatttactccctccgttccaaaatataacaaattttatctcttagaatttattctaaaatataacttctctaccaatattttcttctaactaattacaaccctccgtcattcatttttctcacctatctccactacttatccgatcacaaccctacatcattcacttctaactattttcttaataactgtgtccaactttaaaatttttatattctgtaatggagggagtaattaattaattaattgggtccggtttgatcttgattccactaaatgaaggcatttcctctttcttcgcaatataatactggtaatctgtcgtaatctttgaagaaagggagcaacaaaacaaacacaccagtacactactgattgttattctgaagtagtattattggtgcttaagggcccctttgaatcacaggaatgaagaaaacggaggaataggaaaaacataggat

SEQ ID NO: 36118 - DNA, 1693 bp, Oryza sativa
cgtatgacaggtaggactagatattaatagtgtagtatgtaaatattgtatgaataagctcttaaattggctatagatgaattggaggactatgctattaaacttgctctaatacaaaagcactcagctactgaagaaaaacaattccactcgcttcctcacctagccctctctccacgatacgtccagtccagccatacgattcgatcgatcgccatgggaaagctcaccgacgtgacacgctccaacgacatccagctcaagatcgtgggccactccttgacaatggccatggacgacggcgagttcttcagttccaggcggtattgcgtcggcggacacgactgggagatccgcctgcggccgaaggatccctgggttggcaggcgcgaccggccgctcacgctcaagctcgtcctgcgcggcgcgccccgcacaggcagcggcagtgtgaaggcccagctaagctgctgcttggtagatccgacgcagaagctgaggccgtcggagatgaagaccgtgtcgcataagttccacaagcccggtgactactcgccccgtgccgtgttcatggcaagggacgagctggaggcgtcgggctatctcacagacgattcctacgtcgttcagtgcgccatcaccgtgctccgagaacagccggagatagccgcggcggcggcagcggcgggcgacagcgcgaatgcagccgtggcgccgtcgtccgagttgcacgcgtaccttggcgccctcctggagagcaagaccggcgccgaccgacgttcgtcgtgtccggcgagtcgttcgccgcgcacaaggctatactggcctcgaggtcgccggttttcatggccgagctgttcggggcgatgaaggtgaaggcctcggagcgcgtcgaggtcaaggacatggaggcgccggtcttcaaagccattcttcacttcgtctacactgacaccgttccagagctcgaccaccgtgatggcgaggagacggaggcagcgtcgacggcgacggcgatggcgcagcatctgctcgccggcgccgacaggtacgggctggagaggctcaagctcatctgcgagagcaagctcgccgagcgcatcgacgtcgacacggtgtcgaccacgttggcgttggcggagcagcacgactgctcgcatctgaaggccaagtgcgtcgagttcattgctgccggcacggctgaaaaccttgatgctgtgttggccactgatgggttcaaacatctggaggcgagctgtccctcggtgttgactgaccttgtcaaggttgcccgtggaagaaagaattaaaatgcaggtacgtgcgtatcagagatgtcatagctgaactgttctattgtgaaattttctctaggatttggcaatgcatcatctctgtttgtgctagaagttttgattgattcttcccagtcatgagtagtgcatactttgtacaagcccattatttgtcactactcactagtactagctagtattaccttggtcattcttgtatttttctcacgtgttagtacaatactactactgcactgcagaaatatgcttctgcgtttcaagcctttcaggctatgagaacatgcctgttgccactagtaatcagtacgtttatttttcagaaacatttctttaagcaggagaaccccttttttttttttcagaatcatcactagctt

SEQ ID NO: 36119 - DNA, 1654 bp, Oryza sativa
gtcttcaggaccctgctccacttcatctacaccgacactttgccggagcaagatgacgacgacgtcgaggctgaaacaatggcgtatggtcttctcgaagccgcggatcggtacggcgtggagaggctgatgctgatctgcgcggagaaggtgcacgctggcattagcgtggacaccgccgcgatggcgttggctctggcggagcgccatggatgtaccaagctcaaggctaggtgcatcgagttcatcttggcttctcaggagaatttccacgcagtcgctgcaacggagggttacaagcttctcatggatagctgcccctctgctctgaatgaccttctagtggctgtttttctgaggtacaaattaactgttctgtaaccggaacatgtacgggatagaacaacgttcctagatagagttgagtattgcgagctcgagatttgaagaagaaaatagtgaattttcccaattacaatactccatcagttttaatttatttattgttctagcatttaactttttttaaaaaaaatatttatctttctcgcatttcaaatcatttttactttggcccgttctaactttataaagatacatatttttttctcgttttccgttggcacgcttttcaaaccgttaaacggtgtattttatgcgaaaaatttctatatatgtgacctttcctcatgttattgattagggtcgcagactcgtaatgcgtactccctttcatattgtttattagggtcgcagactcgcaatgcatactccgtttcatattgaaaaaacattttgactttttgtaagtcatactgctatttatgtctcattagttttttctataaatttagtcaaactaaaagaagttgacttttagaaaaaacacgatataaaaaggagggagatagggaatagatcagacaaagcaaacaattgtaggataatttctcaggatatgaaaatcactaggatgcttgatgtagtgagagcatgtctaatgtataatttctcaagagtgtaaaggtgggatccacttgtgtcatagcaactatagatgaaaagtccatcaacgtataaaatccaccattgatcatatagttcacaacatataagatagcttctttgttggtttagcggtaactggtctggtgttaggtttctcttaggttttatataggcactatcgggcttggtgtggtggtggtggtttttttctttcctggttaatgttttacagggtgctagccttgcaatttttgaacctaagaaatcaaccatatgccagcaatttttgacagaaaagtgaagtagagacttctagctaaatattgtggctaagtggcttactcaaagtactttaagttggcaagtcaaatattaaagtaatggagtatatgttagtcaaacttacttaactgaagtgctactacgaattaaacacgtctatatcttactctagtggataatttattttaatggttactagaaaggcatgcccaaagccatcaatctgttataaaaggagtataatttgttataaaaagagtatgttataggtagcttctttgttagtctagtgatgagttttgtgttagttttcttctaggttttgtatagacgctgctcgggtggttatttttcttttcttttc

SEQ ID NO: 36120 - DNA, 963 bp, Oryza sativa
aatactgtatttttagactgattacagtgagcgatgatttcacagagtaatgttttgagtgatcttttatttatcttgcgattttactaccagaatgtggcatttgttacttaattgtgttgttattatgtatatctaattttgatacaaatacctattaatggtttccatcaatgcccaacacttgcttgcaagaggcacaattcccttttacaaaatcactgtaatgcaccacggtttctttaaactttggttctcctatgttgtgtaagtcaaatgcaaaatccacctctgtaacattttggttatagaaagagccacatgtttaaagtgcagtagtcctcaaaaatccccatgccatataattgggttatgttaaaatggcaaatgaaactgaaattgtatgttcaaaaaagggcagcagctaaccgtgtttctatgcttgggataatgttctttcgcccccctttttgttttctcttgtcctctgttgtaatgcaatcaattttgtcttttcagggtcgcccaaaaggtgtaaccccgaagtacagcttgaagcctcttgttccgcgcttgtctgagcttcttggtgttgatgtatgctataaaaggataaatcatatttattattctgcaattctgcttactacaaactggtagaccatcttatatttccatgttttgatgatgtccttgtcgtaggttgtgatggccaatgactgcatcggtgaggaagtccagaaattggctgccactttaccagatggtggtgttctgcttctagaaaatgttcggttctacaaggaggaagagaaaaatgaccctgaattcgccaataagctggcatctgttgctgacctttatgtaaatgatgcctttggcacagcacacagagctcatgcttcaacagagggagttacgaagtatttgagaccttctgttgctggtttcctcatgcagaag

SEQ ID NO: 36121 - DNA, 2635 bp, Oryza sativa
ccctgccctctcggctctccctcttcttcctctctgctctccctcgtcctcgcagcggagcaacggcggcagcgggcagagcagaggcacaagcggagcggcgacgacctcgccaaggacgccacgcgtacctccgacgcgagaggagcggtgacgcatgccggccggcgggagggagggagaggagcggcaggggggagctgcacgcagctgccggcgggagagcatcggcggcgcacaccggccgacgggtgggagggagattagcggctgcgcgcgcagcgctgccggagagggcgtccgacgggagcgctgcgagggaggaggcaatgcgcgccggccgacgagagggagggacaggagcaacggtgcgagggggtcggcagccggcgagtgggcagaagaggagcggcagccccccggcctctctgcccttgtcggcattcccctcacagcgagcggcggccgtcgaccgtctccgcccccctcgtcggctgtcggctttttccctctccgtgcgcgcttgccggccgccgaggaaggatggccgggagggagagagagagaaggagacgcggtccggcggtccatcgtctcccgtcgtccatggcatggatagaggagggtgggacccactaacatgtagatcgtactatttttccttttgtcttactgacatgtgggcctcgcagtttttgtttttatttttttatatattttgcttccgttgccacatcatctacaccaaggacgaaggcagagttaaactagccatgtatgtgttacatcagccaaaaccatcatcaaaaccgctaaaggacccgttgtatctggtttttcggttgaaggacgaactcaaatacattcacaagttaagggaccttaagtgaacttatttcaagtaccttccacagtcagtctcaagtctgcgttggtagaagggcgcgttgaaacggaaagatctctcaaaatctctggatttaacagagcgctgcctgggaaaacgcaagcacgattcgcgaaacactctcgagagcggtacaacggttcgcgttcacccaagccgtgcagacatctgtatataacgctccctttgctcaggctcgttcgcctccgctagcttgcctgggatccgcatcaatggcgccctcctcaaacctcacccaggccgcgcgcgccgtccacaagttcaacgtcaatggctactcggccacgaaagccatggccaaacacgagcatgtctcttccaagcgtctcaccgtggccgggtatgcgtgggagatccactacaccacaggccacgatgcgcactggcactactgggtcgccttcaagctcgtcttcctcggcatcggcgagcaggcgcagcgcgccggcggcgacgacgacgacaacgacgctggcgccatcaaggcgtagctcagctgctgcctggtgcacccgtcgaccacgcgctcccatgcttccgaggagaagagcgacagtcgcacgcgttcgggtccgcgaacgagagctcgccgtgggttctgctcgtgaagcggagggagctggaggcgtcgggtttcatcaccggcgactccttcgccgtgcgctgcaccatcacggtgctcagcaagaacaccatcaactcggccgagccgtcccccgaccttcacctgcagctcggtgagctgctgcggagcgggagattcgccgacgtcgagttcatcgtttccggcgtgtccatcgcggcgcacaggtgcgtgctcgccgcgaggtcgccgtccctcgccgccgccgtcctgaaaggtggcacgaggaagaaggatgggtcggtgcgcgttgaggtcaaggacgacatgagagccggcgtcttcagggcgctgctccatttcatctacaccgacacgttgatggagctcgactggagagaggatggttctgatcccctgctgccgaggacgatggtgatgagcttgaatgaagccgcgggtcggtatgggctggagaggctcaagcagatttgcgagaatatgcttggatttgacgatgcttgtagtgcagattgtgctgtcatgtaacgcatgctctgcatgctgccaaccgttgagaactcttttcttatcgttgtttgctacttcgtcacgagtcacgacgagcaacgaaccttagatctgtgactcgcgagttgtgaacttgtgatgggtgtgctaatgcagtgcacaatctgtgcttttatttacatccgacatgtactcgtgtatggagtactggatttgagataatgaaaatggattacatctccagcttctatcataagacacacagtcataagtttaataataaaaaagggtaaagataaaattaaaattaaaatgagaaataaggcgatgagacaaatctccaacttctctttattatggactagcgttaaaccacataatgttctttagctagcaattctaatggaactacgccacctatagtggaataagagactattggctaccgatttcaaaagtgtagcactgtcgacgggtgatacccgtagaccggatatagagggtattggggtacgctggtacaaagatctacgtagtacgacatcgagcaatcaaaagacaagaattatactggtttaggccccttgacaggt

SEQ ID NO: 36122 - DNA, 8583 bp, Oryza sativa
tttcgggatgaatttatcaggacgtgacaaatccaccccccttacaagaatctcgtccccgagattcgaggaggctagcaagaagataggttgggcggtcttctcttcttgtctgacttcttccgtcgcgtcttgacaaacttccagcaaaacttcaccactcggaactgcttggcttgacctcctgttgcagatggaatcttctcttcacctgacttggaccagggtgcaccttttggctgactcagactaggttgcggtagttcagtgatgcttccgttccagaacttctcatgattcctatcttcggagtcaacctcggacaagttaccacttcacgtcatgcgtcaacactagcttgtcattactaggatactatgtttgtcatcataagaatatcatgcttgtcattcacttctaacttgccatcaactgtctcatattagctttcctggtctccagtgctaggtacttctgctattcgatgccagggtcaaccactctaactataagttatgcttcccaagagaaccatcttatcccacttgatatacttttgacgtcttcccaaataggtttactgctggacttcttattgtctgatcgttatccggccaaatttgaagcttcgttgttaggtgtgattttactctgacctctgtagactaccttcgaacatatcacttggttcataactgggaatagctcccacgaacaagcaactccgattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgggtagcatctgataccgagtggaagatttcactctttgccttcatagaaacacttttacctaggtcatcttgctgacttaatgacaaggtgactgttgcgggggggggcaattactatcaggggtcttctttgagcgatgctgagcatgtttctgtttatcaatcacctttcggcctacttctttcatgctagagaacatctttgccaatctcttttatcaatcttctttcggcttatctctaacaggtggtattctttaatgtggattgctgacgcttctggggatgatgaggtcctttggcttgctgcctttcagtgaaaccttgatgtggttcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccagataaactaattaccaaccatcgactattatgttctcaaatattgatgtctcctggatctccttaactgttggcaggtatatccgatcttatcaatgtagaggcatggcgggtacccttaggggtttcctccaacactccttatcttgatctgtgaaaggcgtatccaaactcctatcctcaactactgtctcgttggctttttaacccaacacagtttaattgtttttcttttccattcacaggttggttattaactcgaggttagaatatagttcctctgacacgagaccctaggtctcctttgtcagtaaacaattatacacatgatcacatatccgcatctttcaaacgaatcctcatggaacttgtctgtattacacatttctcccttattacatgaatacgaggcactgccttaaccaaaaagggacggtgcttaacatcggtacattgtatcctcaacatgaatcatctctaaacatagcgagctcactgtttacagacatgattatatttatgaattacatgattgctgcaaactttcgattacaccatgataagtagcgaactgaaaaccacaaacatggctgctcattttgattctggagagatatagctggcattgttctagtgactgcatccttgattggttctgtgatgatgtgataggactgcataatgctatcattcacaggagaagcttccttctgattgttggttgcagcggatgacggtcttctgcttggtatcgccctccggaggttgattgcccttggctcggcctggagtaggtcggggagagacacaactccttccatctacgacaattctttgctgaggctgtcgttgcagagaatggttgctaagatttattgccgagtcaggtgcagcaggtggagcattggtgcattgtttctgctatgggttctgattaacacgaggccttacgggtacggcgtttgctccagtgaccacaatacgattggaatgtctgcttcgtgtaaattggcgaaaatgtggaggtcggggacagttttttggagtaatgcccttctccactgcagttgtgacaaacaataactttcttacactcgggttcttcatcttgtacttgatttctcagctgctgtattggagcttccaaaggtacaacgcagatactggcatctgtcttgtcaactggtggctggggctgaaattgagcattgacaccttgtggtagtgcactcattggaattggagctgttgcaacgcgggctataggactgcttcgggatgcatggatgaccattcgttgaggagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttgaaaccggcgggttggttagccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgtccgatttctccacaacgagagcatgccttacgttccattttatcctggttgaaaccttggggagatttctcatcttcatcttctgaggagacttgatctgaatcttcactatcagacactctacctccattagctaaaagatgctctgtcaactgtggtgcacctcggaaggtgtttcttctctgacgtcttgtcattcctggtggaggccattctgtgctggtaatgatcatcttacgaacttcaccttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacctgaggttgcatctgactcgggttcaaaattggcatccgatgctgctgtagtatctctataagcaatttgttctggttaatcaggtgttggaccactgccgcacaactggtgtcttgtgcttcattcactcgggagcttgaggtaccaatgtcctgactcctgaccttattgcctttctcattgtcagccatctgttgcaaaggtttggagagggagagagggaaaacgaaggggagagacagattagaaactaaggataggaccttaacagatctaagtcttttgctgttatgatgtatgttaggcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagccggcttcactgcttcctccacttcactcgcagatcctgcagtcttctggaacttcggcaaacaactgacgatgtcctcttcttcactgacctgaccatctagtactagttgaaaatccgaagaaggaagaacggagtaaaccttttgcaaaaagcattgggggaaggagaaaagaggaactttcgcaaataatttttatttataaaatatgtccttaggttttatccacttggcttttcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgaccatcaaaaataaacagcagcggactagcgggcctacggctccatcttcacaggcgctcaactggggtataagccaggactccacctaagacctctcctccaaagcttctcttactgaagagggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccagctcgtcccaagccaacccaggccaaccattccatattttagttgttgagcaaattttaagaattgaaacactgacctgggtacattgctaggcttgcccatatccgagggctcggctattcgaatagatttactctgatcagaggtgtacatctttacccacaagacacctctccctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccatcataagccaaccattccatggtgtccaaatgatatgagaatttcccaagtctaaagttataaaaaccacctaatgttgcctaattaatcagcgaagcatctacctaaattcatacttgtggaaccatgaatagagtgtccactagttgaggttttgtttgtctagggtgaacaaggtaataataataacaataacaataataatatggtcataacaaaggtaaataggcatggctaagtaaaacagtgataacgcgggaatttaaataaagcgataatgcaataatttaaatcaacataattttataaactgggattcaatatgatcaagatgatgtgtcttgccttgctcgttttcccactcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttacgaatttcttcatttaattttcaattaaaaaaccggattattgcgtcagccgagggagcggggcgcgcggaccgggtccacgggaagtggggcccacgcgtcagccgctcggtccacggtggaccgggcgcacgcggctggcggcggtcggcgccgtgggtcccgcgcgtcaaccgcacccgcgggcgcgggcggctgacggccgggcccacttggcagccgcgagggcgcgcccgaggcggcctcgccggcgcggccgacgggagcgacgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggagggagacggcggcgcggctcgggatgacgatgacgacggtgctccgacggtcggcgagcgaaacggaggcgcggacgaggtcgacggcgatgcggcgatgccgagggaggtgtcgccgagtcgggaggaggagcggagcggcggcggcggctaaccgaagcacggcggcgacggcggagagaaggtgctacggcgcgagcacgattccgacggcgagagtgagcggcgagcggcggaaacgaaagagcggagctcggggagggtttaaatagcgccgggggaaggaaagagcggccggagagggaggaatcgcgcgcggaagattcggctccattgattgcgccggcgacgattacgggcttgattcgaacgaatccgagggagagagagaggggaaagagggggaaacgggggaggggaacgcggggattaattcccccctcttgattgcacgcggggcggacgggagcggcgggattcgcggcggcggcggcgctagggcacgggcgctggcggcgggcgcggcgagaggagggagatgacaggtgggtcccacctgtcagcgagagtggcgggcgggcccgcctgtcagcggcgcgcgcgcgcgcggggagccgatgggccgcgggagaggagagagagagagggagtgttgggccgagccggcccaagagaggaaggggggggaaagaagaacttcttttaggatttttctttttataaaccttttcaactttgtttatttcttttcaattattatttgtgctctgaaaattccactaaaatttgagggctccttttagaccaaggagaatttaacaaaaattctccgggtaacatttgaatttttcttgtacgtattttagtgtttgccaatttcttttcgaattttaattaattctattattccttttagaagatgatttttattttcgggatgaatttatcaggacgtgacaaatccaccccccttacaagaatctcgtccccgagattcgaggaggctagcaagaagataggttgggcggtcttctcttcttgtctgacttcttccgtcgcgtcttgacaaacttccagcaaaactttaccactcggaactgcttggcttgacctcctgttgcggatggaatcttctcttcacctgacttggaccaggatgcaccttttggctgactcagactaggttgcggtagttcagtgatgcttccgttccagaacttctcatgattcatatcttcggagtcaacctcagacaagttaccacttcacgtcatgcgtcaacactagcttgtcattactaggatactatgtttgtcatcataagaatatcatgcttgtcattcacttctaacttgccatcaactgtctcatattagctttcctggtctccggtgctaggtacttctgctatgcgatgcgagggtcaaccactctaactacaagttatgcttcccaagagaaccaatttatcccacttgacatactttgacgtctccccaactagtcttactgctggacttcttattgtctgatcgtgatcctgccagatctgaagcttcgttgttagaggtgatcttaatctgacctctgtagactatcttcgaacatatcacttggttcataactgggaatagctcccacaaacaagcaactcagattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgtgtagcatctgataccgagtggaagatttcactctttgccttcatagaaacacttttacctaggtcatcttgcttacttaatgacaaggtgactgttgcggggcaattacaatcaggggtcttccgtgagcgatgcagagcatgcttctgtttatcaatcacctttcggcctacttctttcatgctagagagcatctttgccaatcccttttatcaatcttctttcggcttatctctaacaggtggtattctttaatg

SEQ ID NO: 36123 - DNA, 24112 bp, Oryza sativa
  unsure (1)..(24112): unsure at all n locations
actcatttatgctcaatcttttccctcttcagtaagagaagctttggaggagaggtcttaggtggagtcctggcttataccccaattgagcgcctgtgaagatggagccgtaggcccgctagtccgctgctgtttatttttgatggtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacacacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccatcataatccaacaattccacagtgtccaaatgatatgagaatttcccaagtctaaagttgtaaaaaccacctaatgttgcctaattaaccagcgaagcatctacctaagttcatactagtggaaccatgagtagagtgtccactagttgaggttttgtttaatctagggtgaacaaggtaataacaataacaataacaataataatatggtcgtaacaaaggtaaataggcatggctaaataaaacagtgacaacgcgggaatttaaataaagcgataatgcaataatttaaatcaacataattttataaaatgggattcaatatgatcaagatgatgtgtcttgccttgctcgctttcccaaacgacggcttcaacttccacgaagagcggatcttccgaagctgcggcgtctacacgaccaacggaaaaagaaaaagacttttactctaataaactccaaacaacaagcaggaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaaaaacggattattgcgtcagccgagggagggggcgcgcggaccgggtccacgggaagtggggcccacgcgtcagccgctcggtccacggtggaccgggcgcacgcggctggcggcggtcggcgccgtgggtcccgcgcgtcagccgcacccacgggcgcgggcggctgacggccgggcccacttggcagccgcgagggcgcgcccgagggcggcctcgccggcgcggccgacgggagcggcgcgcacccgtgccccgatggtcgccgccggcgaccaacggcgcggcggagtggcacccgagagagaggagggaagggggaaacgaaggggacggtccacggctcaccccgggacaacgacgacgacgagaatggcggacggagcggaagaagacggcggcgcggctcgggatgacgatggcgacggcgctccgacggtctgcgggcgaagcggagcggcggacggggtcggcggcaacacggcgaagcggatggaggggtcgccgagtcaggaggaagtccggagcggcggcggcggcgggacggagctcggcggcgacggcggagagagcggagcacggcgcgagcacgattccgacggcgagagcgagcggtgaacggcggaaacggaagagcggagctcgggcaacgattttatagcgtcggaagggagagaaggcggccggggaggaaggaaaccggccgcggagatctcggccgccattgattgcgccggcgacgaatgcgggcacgattcgaacgaatccgagggagagagagagggggaatcgggggaaacgggagagggaatcacggggagtgattcccctctctttaatgcgcgcggggacggcgggatgcggcgcaatccgcggcggcggcggcgctagggcacgggcgcggcggcggcgcggcgggaggagggcgatgacaggtgggtcccacccgtcagcgagagcggcgggcgggcccgcctgtaagcgacgcgcgcgcgcggggaggccgatgggccgggggaaagagagagagagagggagggaatgggccgtgccggcccaagagggaaaaaggggggggaaaagaacttcttttaggattttctttttataaaacctttttactttgtttatttcttttcacttattatttgtgctctgaaaattccactaaaatttatttaagcattttaggcttttaggaaatatacaaaaatcctccaagcctcatttgacttttatctttgcacattttaattgttggaggctttcacattgaattttacttattcttttgcacaatttcgaggatgaattttagagtcgatttgggacgcgacaaacctaccccccttaaacggaatctcgaccccgagattcggaagaactggcgaagagatcgggatgggctgccttcagttcgtcttcgcgctcccaagtagcttcttcttcggcgtggttgctccactggaccttgcaaaaacggattacccggttcctggtcctgcgctccatggtgtccaggattttcactggcttctccacatacgtcaagtcttcgcgaacttcgatttgctctgagtcggcctgctcggatggcactcgaagacatttcttgagttgcgacacatggaacacatcatgcacgttgcccaaggaggcgggcaactccagctggtaggcgacttctccgcgtcgagcaacgatacggaagggacccacataccgaggtgcaagcttccctttcgtttgaaacctgtgcacacctcgcaatggcgtgacccgaagatacacaaagtcatccactgcgaattccagatcacggcgacggttatctgcataacttttctgccgagactgtgccacctttagattatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttgatagctgttattgtaggagaactcggcataggggagactcttatcccaagtcttcccgaaatctaggacacatgcgcggagcatatcttctaggatctgatttagacgctcggtctgtccatcggtctgcgggtgataggcggtgctgaaattcaatcgagtacccagctcttcttggagcttcttccaaaagtgagaggtgaattggcttcccctatcagatacgattttcttgggaacgccatggagactcacgatcctagcgaagtagagctccgctagtttattccctccataggtggtcttcacaggaatgaatcgagctaccttggttaatcgatccactattacccatatagaatcatatccaccttgggtttttggaaggccggtgatgaaatccatcccaatttcatcccatttccattccggcacttggagaggttggagaagtccggccggtcgttggtgttctgccttgacacgctggcacacatcacatagagccacaaactctgcaatttcccgcttcatgctgacccaccagtatttctccttcaagtctaagtacatcttggtactgcctgggtgaatggaataaggactctcgtgagcttcctgaagtatcagctgtttaagttctcggttatctggaacgcatacccgctttccgttccatagggttccgtgttcatcctctgtgaaacctgcggctttaccctgtttcatattcttgaggagtccatgcatgtccggatcattcttctgagcctcgcggatttgatcgagcaaggtaggcttggcttccaacgcagccaagaatccgcgaccaactaggcttaggttcagggcttccatctgttggttaagttcgggtggaatgcctcggacgttgagagtgttgcagtggctctttcggcttagagcgtcggcaaccacgttggccttaccaggatgatagtgtattcccacatcataatccttgatgagttctaaccatctcctttgccgaagattcagatccgactgggtgaagatgtatttcaaactcttatgatcagtatatatttcacagcggttcccaatgagatagtgccgccagatttttagagcatgaaccaccgctgctaactccaagtcatgtgtagggtagttgccttcatgaggtcgtagctgacgtgaagcataggctaccacatgaccgtcctgcatgagcacgcaccccaatccttggcgcgaagcatcacaatacaccatgaagtccttgcgagtatccggcaagattaacactggcgaggaaaccagcttttctttgagagtttggaacgccttctcgcattgcgggctccacacaaatttctcttctttcttcaacaactgtgtcatgggtcgagcgattttggagaagttctcgatgaatctccggtagtatcctgccaaacctaagaaactgcgaatctgagtgactgtcttgggttgcttccaatcggtgacggcggtcactgtttcggggtccacagcaactcctttagcagatatcacgtgccctaagaatttgacttcggacaaccagaactcacacttgctgagcttggcatacaattgatgttcccgcaactttcccagtaccagacggagatggtgctgatggtcttcctctgattgtgagtatatcagaatgtcatcaatgaaaaccacaacaaacttgtccaagtattccatgaacactttattcattaagttcatgaagaaggcaggagcattggttaagccgaacgacatcaccgtgaattcatacagtccatatcgcgtggtgaatgcggtcttcggaatatcttcttcccgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgttttgtctttcttctccacaaaaatcacaggagcaccccaaggggaagtactcggacgtatataccccttttctttcaactcttccaactgtttcttaacttcggccagttcatttgctgccatacggtagggtcgcttgtacagaggagtggttcctggagcaagatatatccggaactcaatctctcgcttgggcggcataccaggtagttcttccggaaacacgtctccgaactctctgactatggggatttctgacagacctatctgatgaagttctgaacttctgacagaggttggaggtgcaaagaaaacaaccggctgttccggtcctcggtacagagtgacagtgcgcctcgcgcaatccactactccttggaattgagccaaccaattcatcccaagaatcacatccaagttctttgtgtctaacagaatcagatccgagggaaaaggaatcccctgaatttctatagggacggcagggctataatactttgctgtcataacccctccaggggtggtgatgagcagagggtttctaagcctttctacccccaactgatttttccccacgaatggcacagatataaacgagtgggaagctccagagtcgaacaaaatggtagcagggatggaatgaacgaggaacgtaccaacgatgacgtctggagttgtcagcacgtcctcggccgtcacatgattcacacggccccgaatgacatccttcccgccgttgttggagcggggaggcacttggccttgctgacgccttggcttcgggcatttatccgcaaagtgcccgggctcgaagcagttgaagcacagccgctgcggaccttgagcgtccctgcgaccttgaacaggctgcacagttggcgtaggaggacggggtgcacgagtcccttgctgattctgctgctgctgcggctgtggaatgcgcaccacgaattgaggtcgaggcgcggagcgaggttgctgctgctgctgctgctgctgctgcgaggaggatccccctgggtagggattggtgtagcggaccctctggttagcaccctgctgattgcggaaattcgccaagcggcgcttgtgcgattccagctccttgtgcttggcttccaagcggatgctcttgtccaccagtcgttgaaaatcaggatagtccccagagactagacgaacggacagctcagggtccattcctgccaagaacttctcttgcttctcctcatcttcccgcacatcctccggggcataacgggctagattgttgaactcatgcaaatactccatcacggagcggctgccttgcttcaactctcggaattcccttttcttaagagccacgactccggcgggcacatgggttttccggaaagcggcggtgaagcgagtccaagtaataggttgcccttctggctgcgtagcctggaagtggtcccaccagagagatgcgggcccctgcagctgatgggcggcgaagacgactttctcctcatcgctgcactgcaccgtgtctagctttttccccacggcatgcaaccaatccaacgcatctacgggattgttggagctagagaaggtgggtgggcggatgcggaggaattcggcgagtttggagtgttggggagggggtggtggagcattctgttgtggcggattttggaggtggtggaggaaagcattcatcatgttggcttgctgggcgaggatttgggtgagaatggcgttggtgtctggtggtggtggtggaggtgggttgccttgggggttggggttgctgccctcgggttggttgccttcaccggtgttaacatttctcctggtcgtcaccatctgaaaaccccacacagaaccagcaaacagagaaggagagctgacgattaaaactaaccacccacgactactataaatcttgaatttatcactgctattaaattggttcattaatgttcaagttgcttaggcaaacaaataaagacaggccccgacatagttacaccacacaccggcgtaaccatgccccacacgactcaaaaagacaaacgaggaaaaacacacgcgcaagcctactaactgctcgtctaccgctgcgacgggccaggacggaaggtgagcaacagcgcaccctccgagctaccaacgccggaggcttccccctcctgaggaaccacgggcgcaggctcggcacgaggggtctcgacgaagcaggtccacgccagggactgacgaacaagctcgggcctggaggtgctcttgcgggcggtgatcttctggctgcggcagacgcggcgacgcttgggacggctgtcctctccctgggcgatcttgagctgatgcagctgcgcctccaacgcgtcgaggtccttcttgagctgcaaattctcttggcgcagctccaggatcttcatgttgttctccaccatgccacggcgcaccatctgatggaagtcaatacgagctgcgtcgtatgcctccaccatgcgtgccagatgcacgacggtagcgtcatgctccgagctggcgtctcggaaggtggcgtagtcgcgggctcctccgcgacgagggtggtagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagcggcctggcctggtaatccactccatgtggataccccaagaccacgcacatgccccgcagctccaagacgaagccagtcatgtccaaaccacgacgggtaacgctgccggccatctacaaacaaaaagaaaagcaacatttgaaagatcagattttgatgataagtgaagcagcaagacaaagagagaatagcgggttttcacaaataataaaggatttttatttttgaaaatattgctaaggcttgggatctacggctcgtcctagggtcaagggaggctctgataccaacttgtcacgaccggaaataacccaacgggcattccttacgtgcgtgcattaatccttgtcccaggaggcaaggtacaccaaaagttgatacaattcagagtttaacaagcggaagcgtatataaaattattacacgggcagcgaaggcccagcacacaaagacaacgaataacagcggaagactagggcgaagaccacaggcgcttgacggcaggcacgagatatacaccgaagccttcatcttcaagaagctcctcatctgggtttgggaaaaattgagcaagactgagaacaaccaccgtacccaacaagtcacacccacaaatgcagaataaatgcaagggagtacaagggaattataatataaggggttagagttgcagtaaacagcatttgaagacgtttagttgctcaagctattttgtaaacacgatcctagagctatacactgttattaatcaaggccgtgaaccctcacgaacctgccttaacccaaggcctacgatgattcagaccgaactggcaacccgacctgggtcccagctcgtcccaagccaacccaggccaaccattccacattttagttgttgagcaaattttaagaattataacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttgtaaaacctcctaatgttacctattaatcagcgaagcatctacctaaattcatactagtggaaccataaatagagtgtccactagttggggttttgtttattctagggtgaacaaggtagtaataacaatgacaataataatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgttttccccaatcgacggcttcgacttccacgaagagcggatcttccgaagctgcagcgtctacacgaccaacggaaaagaaaaggcttttactctaataaactccacataacagcagaaacaaagcacaaaaatgggttctttacatcttaaggaaaaattagagacttgaacggtccaattccgagttcaaatggccaagatatggccatttgaagtttatatgctctttaaatggatatttacgaatttcttcatttaaattttaattaaaaaacctatttattgcgtcagccgagggaggggacgcgcggaccgggtccacgggggtggggccccacgcgtcagccgctcggtccacggtggaccgggcgcacgcggctggcggcggtcggcgccgtgggtcccacgcgtcagccgcacccgcgggcgcgggcggctgacagccgggccccacatggcagccgcgagggcgcgcccgaaggcggcctcgccggcacggccgacgggagggaacgcgcccgcgccccgatggtcaccgccggcgaccatcggcgcggcggagcagcgcccgagagagcggagaggagggggaaacggaagggacggtccacggctcaccccgggacaacgacgacgacgagaacggcggccggagcggaagaaggcggcggcgcggctcgggatgacgatgacggcggcgctccgacggtcggcgagcgaaacgaaggcgcggacgaggtcgacggcgatgcggcgatgccgagggaggtggcgccgagccgggaggaagaccggagcgacggcggcggcgaaccggagcggaggaaggcgacggcgcggttcgggatgccgagggcgacggtgctccggcagtcggcgggcgaagcggagcggcggacggggtcggcaaccactcggcgaagccgaaggaggtggcgccgagtcgggcggaggaccggagcgacgtcggcggcgaaccgaaggtcggcggcgacggcggagagagaggagcacggcgcgggcacgaaaccgacggcgagagcgagcggcgagcggcggaaacggaagagcgaagcacggggatcgaatatatagcaacgggagggggagagcgcggccggggagagaggaaaccgcgcgcggagatctcgggcgccattgaagacgccggcgaacttcgcgggatgaatccggacgaatccgagggagagagagagggaaaagagggggaaacgggagagggaaacgcggggagtaattcccccctcattaaggcgcgcggggaaggcgggatgcggcggattcagcggcggcggcggcgctagggcacgggcgggcggcgggcgcggcgggaggaaggcgatgacaggtgggtcccacccgtcagcgagagtggcgggcgggcccgcctgtcagcggcgcgcgcgcgcgggggagccgatgggccgcgggggaagagagagagagggagggactgggccgagccggcccaagaaggaaggggggaaaagaggacttcttttagggtttttctttttataaaccttttcaactttgtttatttcttttcaattattatttgtgctctgaaaattccactaaaatttgagggctctttttagaccaaggagaatttaacaaaaattctccgggccatatttgaatttttcttgtacgtattttagtgtttgccaatttcttttcgaattttaattaattctattattccttttagaagatgatttttatttcgggatgaatttatcaggacgtgacaaatccaccccccttacaagaatctcgtccccgagattcgaggaggctagcaagaagataggttgggcggtcttctcttcttgtctgacttcttccgctccgctttctataacaaacttgcctaacaaagcttctccactctggactgcttggctcgatctcctattgcagatggaatcttctctgcacctgacttatccctggttgaacctttagctgacttcgactgggttgcggcacttgaagatggggattcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagggaaccaacttatcccacttgatatactttgacgtcttcccaaatagttttactgctggacttcttattgtctgatcgttatccggccaaatttgaagcttcgttgttagatgtgattttactctgacctctgtagactatcttcgatcatatcacttggttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctcccaagacatggcgtcgcctggtaacctgggcttgcacttttcactccgtgtagcatctgataccgagttgaagatttcactccttgccttcatagaaacacttttacctaggtcatcttgcttacttaatgacaaggtgactgttgtgggggaggcaattactatcaggggtcttccttgagcgatgcagagcatgtttctgtttatcaatcacctttcggcctacttctttcatgctagagaacatctttgccaatctcttttatcaatcatctttcggcttatctctaacaggtggtattctttaatgtggattgcggacgcttctggggacgatgaggtcctttggcttgctgcctttcggtgaaaccttgatgtggttcgtcaaaaagctgcactgactaccttcagggaaatacattgcttgctatctgtatctatgccactagggtttagtgcttccttgggatggggagcatccatattgttcttctgccatatcacctttgacccttttctgatacctgatcgactaattaccaaccatcgactattatgttctcaaatattgatgtctcctggatcttcttaactgtttgcaggtatatccgaacttatcaatgtagaggcatggcgggtacccttatgggtttcatccaacaatccttatcttgatctgtaaaaggcgtatccaaactcctattccccaactactgtctcattggctttttaacccaacacagtttaattggttttcttttccatcaacaggttggttattaactcgaggttagaacatagttcctttgaaatgagaccctaggtctcctttatcagtaagcaattatacacataatcacatatccgcatcttccaaaagaatcctcatggaacttgtctgtattacacatttctccctcattacatgaatacgaggcactgccttaaacaaaaagggacggtgcttaacatcggtacattgtatcctcaacatgaatcatccataagcatagcaagctcactgtttatagacatgaatatatttatgtattgcattattgctgcaaactttcgattaccccatgataagtagcgaactgaaaaccacaaacatggctgctcattttgattctggagagatatagctggcattgttctagtgactgcatccttgattggttctgtgatgatgtgataggactgcataatgctatcattcacaggagaagcttccttctgattgctggttgaagcggatgacggtcttctgcttggtatcgccctccggatattgattgcccttggctcggcctggagtaggtcggggagagacacaacttcttccatctacgacaattctttgctgaggctgtcgatgcagagagtggttgctatgatttattgccgagtcaggtgcagctggaggagcattggtgcattgtttctgctatgggttctgattatcacgaggccttacgggtacggcgtttgctccagtgaccacaatacgattggaatgtctgcttcgtgtaaattggcggtaatgtggaggtcgattttgccttggttggggacagttttcggagtaatgcccttcttcactgcagttgtaacaaacaataactttcttacactcgggttcttcatcttgtacttgatttctcagctgctgtattggaatttccaaaggtacaacgcagatactggcctctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcatatagtggcacacgagctggcgacatgaccgatttctccacaacgagagcatgccttacgttccatttcatcttcatcatctgaggagacttgatctgaatcttcactatcagatactctacctccattagctaaaagatgctctgtcaactgtggtgcacctcggaaggtatttcttctctgacgtcttgtcattcctggtggaggccattctgtgctggtaatgatcatcttacggacttcatcttcggttcgcattggtgtttttcttttctgctgaggacgctcccttgcatagtgcacttgctcatcacacgtaaagcaaatgttacttgcttcttttgggtcaacaggtggcacgtcatcatgggtccttcgggatgctggcggcatgctgacttgtggggtgagtgcttggactgcctccaactgcacttgaggttgtatttgattcaggttcagcattggcgtctgatgctgctgtagtatctctataagcaatcggttctggttaatcaggtgttggaccagtgtcacacgactggtgtctggtgcttcattcactcgggagcttgaggtaccaatatcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaaggggggaaaagattgagcaagaatgagtacaaccacagtactcagcaagtcacaccggcagatgcatggttaatgcaagggggtacaaggagataacaataggggttaggtttttgcagtaaacagcatttaaaagtcacttagttgcccaaagccgttttgtaaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccatattttagtcgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcctacctacggccgggatacccgggacaggcaggtagaactgagcccctagcattgggcaccaaccctccgccgtatgacatctcgactaccgggccgcagctcgtgtagccttcatttgccctggagaatgtccatcgacgcccgacttcatccatctccaatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaacataagccaaccattccatggtgtccaaatgatatgagaatttcccaagtctaaagttatgaaatccaactaatgttgtcctattaaattgcgaagcatctacctaaatttaaactagggataccacgagtagagtgtccactagttgaggttttgtttactctagggtgaacaaggtaataatcataacaataacaataataaggtcataacaaaggtaaataggcatggctaaataaaacagtgataacgcgggaatttaaataaagcggtaatgcaataatttaaatcaacataattttacaaactgggattcaatatgttcaaggatgatgtgacttgccttgctcgctttcccaaacgacggcttcgacttccacgaagagcggatcttccgaaactgcagcgtctacacgaccaacggaaaagaaaaaggcttttactctaataaactccaaataacaagcaggaacaaagcacaaaaatgggttctttacttcttaaggaaaaattagagacttgaacggtccaattccgagttcaaatggccaagatatggccatttgaagtttatatgctctttaaatggatacttgcgaattcttcatttaaattttaattaaaaaaaaacggattattgcgtcagccgagggaggggacgcgcggaccgggtccacggggagtggggcccacgcgtcagccccacggtccacggtggaccgggcgcacgcggctggcggcggtcgacgccgtgggtcccgcgcgtcagccgcacccgcgggcgcgggcggctgacggccgggcccacttggcagccgcgagggcgcgcccgagggcggcctcgccggcgcggccgacgggagcgacgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggagggagacggcggcgcggctcgggatgacgatgacgacggtgctccgacggtcggcgagcgaaacggaggcgcggacgaggtcgacggcgatgcggcgatgccgagggaggtgtcgccgagtcgggaggaggaccggagcgacgtcggcggcgaaccggagcggagggagacgacggcgcggttcgggatgacgacgacgacggtgctccggcggtcggcgggcgaaacggagacgcggacgaggtcgacggcgatgcggcgatgccgagggaggtggcgccgagccgggaggaagaccggagcgacggcggcggcgaaccggagctcgtcggcgacggcggagagaagatgcgacggcgcgagcgcgattccgacggcgagagcaagcggcgaacggcggaaacggaagagaagggcacgggggacgattttatagcgccgagagggagagagggcggccggggaggaaggaaaccgcgcgcggaggtctcgggcgccattgaagacgccggcgaacttcgcgggatgaatccggacgaatccgagggagagagagagggaaaagagggggaatcgggagagggaaacgcggggaataattcccccctcattaaggcgcgcggggaaggcgggatgcggcggattcggcggcggcggcggcgctagggcacgggcggcgacggacgcggcgggaggaggaagatgacaggtgggccccacccgtcagcgagagtggcgggcgggcccgcctgtcagcggcgcgcgcgcgcggggaggccgatgggccgcgggggaggagagagagggagggagaagtgggccgagccggcccaagagggaaggagggggagaaaaagaacttcttttaggatttttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttagtgtttgccaatttcttttcgaattttaattaattctattattccttttagaagatgatttttattttcgggatgaatttatcaggacgtgacagcggcctgggccgagcaggccgggagggaagaggggggggaaaggcagcccgggagagagagggaggagggagtgggccgagggaaaggggagcccaagagaaggagggagagaaggagagggagagaaaaagagggaggaaagggagacttttgggctgggcttggcccaaaggaggaagagagattatttttaggttttctttttttaaataaactttgataattgtttttgttgcttaataattatttccggtgctctgaaaattcaagtaaaatttgagggctccttttagaccaaggagaatttaacaaaaattctccgggccacatttgaatttttcttgcacgtattttagtgtttgccaatttctttttcgaattttaattaattctattattccttttagcgaatgaattttaattttgggatgaatttatcaggacgtgacagacacagattctttcacccaaccatacagttccgtgctcatcttccaagaaaccaatagcttttcctcttctcatattcttcttgatctcttgaatatcaggatcattaatttgggcttctctaacttgatcaattagagtgggcttcgcttctaaagctgcaacgaaacctctaccgacaattcccaaatttaatctttcaaattccttgcataattccaatggcaactgtcgtccttctgtagcattgcaataaccttttctgctaagagcgtctgctacaacattagcctttcccggatgataatgaattcccatgtcataatccttaattaattccaaccatctccgttgtctcatattcagatccggctgagtaaagatatactttaaactcttgtgatcggtgtacacttctgtacgagtaccgaaaagataatgacgccaaatctttaatgcatgaacgactgcagctaactcaatatcatgagtagggtagttcttctcatgcggacgtaactgacgagatgcataggcaaccaccttcccatcttgcatcagaacacaacctaacccaagtttggatgcatcgcaatatacttggaaacccttctttggatcaggcaaaatcaaaataggagctgatattaagcgacttttcaactcttgaaaactccgctcacattcttccgaccatttgtacttcacatctttctgaagcagtcgtgtcatgggcttagcaatcttagaaaaattctctataaacctccgataatatcctgcaaggcctaggaaactgcgaatctctgaaactgtctttggttgcttccaattggttacggattccacgttactaggatcaacggcaactcctccggctgagatgacgtgaccaaggaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattctaacaacccatacctagtggtaaaagctgtctaaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaattaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcatacccggtaaatcatctgggaacacatcaggatactcccggactataggaatctcttccaaagttatttgattcagtcttgaccttaaagactcagaagacaatgcatgaacggttacaactcgaccatcatagctgttgagagttacttttctgttggcacagtctatcacacctttatgtctggctaaccagtccatccctaggatgacatcaaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcaccttgagcttctgcagcagcaatatgattgacacgggcctttgatgctggtacagcagagttactctgggcagggacaaccttcacgcgttggggcttcggacacttgtcagcataatgtcctggatctccacagttgaaacacaccacgggcttgctgccttgctccctcttggcaggttgttgctgtgctggagctgcaacaggacgtggagcttgattacggatgttgttgccagcattgttgttgaagaactgacgttgcggacgaacaacagacgaagaacctccctgtggcatggactggggtcctaaagtaagacgcggcttctgattatttccctgttgtgtcttgaattgagcaatccgacgtttcttctgctccatgcgattgtacttgtcttcctgacgaatagccttatccactaatttctggaaatcagggtaatctccaaccataagtgggtaagaaagctcatcattaagtcctcccaaaaacttctcctggcgctcttcatcattgcgcacatcttccggagcataacgagcaagacgattgaactcgtgcagatactccgtaacagagcgagatccctgggtaagcgacctgaactccttcttcttgagagacactacccccgatggtatatgcgtcttccggaaagcagcggtgaattcaagccaagtgataggttcagcagtagtcctgttaagacggaagtgatcccaccattcagaggcagggccatgcaactgatgtgatgcaaatgagaccttctcctgatcagtacactgaagtaaatccaacttcttctctatggcatgtagccaatcactagcttcaacaggattagtggtactagagaaaacaggcggcctcacacgaagaaattctgctaacttgttctgtggaggtgcatgattattcccttggttttgctgattctgaaattgttgcatcatcatgttcataagctgtgtctgctgagcaagaacttgggccagagtgggattctctccattgatgttattattggggttgttgggaccattcccattgctacgagtgttcaccatctggtatggataggataagaagagaaaacgggggaaactacttaggacagagaattactttaacttttattgatcttaactgagtttcattattacaaactgaagactcccacaccactaaactctccaacttcctaacactcaaaagcaaacaaacacatgcaattacatcccaccactgatgtaaatcacatgcgagacccacacacacaaacaaacttaaaacaagcaaactaacacaacgatctaagacaacgacttaacaagtcactctagttcttccgagcataggaggtcgattgaaggctcatcttcatcatcttgagttgctacccactcaatcttggaattgatgcgcttggattcttcttcttcatcactacttatgatgatgaccggaggatccgcttgagctggggcaacttctttctccaccacacgaacctttggcgccagttgatagcgagggacaaataaagctctcttccttgcggtaagacgaatcctggccttctgcggcggtgcttctcccttcaatgcggctaattccttctccaaacgatccaccttgtcttctagcttgcaaatcttaccacgattccgatcttcacgatcttgagctgctaacacagtctccgcacgactttcatccatagcccacaacatctcaaccaaatgtcttgtggtaacatcattctcaattccttcagtctcaaggtaactgccacggtcacttccctggggttggcgaggatgatagcgatactcagtgtcgaccaactgatcactgtagcgatcacggagctctcctatggcgatccttgccacctcctgacatgcatggatgtagtttcttcctccagcttcaaacattactgaggggatatcttcactattgctgttcaaggtgactttgactcggcacttttcttcatgacgatcatgacgaatctgggcataaaaaggagcattcccaaatccaatgacaaaggacatcgtacgcaactcctggacaaaaccctcaacgccaaacaggtactcaggcttgtaacacggcatctaaagacaagtgaaaggagggagttaagacatctatccaattaatagcacaagtttttggattaatttgaataaaggtagaaaatcagaataaaaaggtaagtaaataaagtaaacnnnnnnnnnnnnnnnnnnnnnnnnnnnnnnnnnnnnnnnnnnnnnnnn

SEQ ID NO: 36124 - DNA, 738 bp, Oryza sativa
cctcttcatcaatttggtctccaggttctgaggtagtctttgtccagagcaattggcctagtaatatcagactgttgtctctgccctgcactttccgaaaagagcaacttgcagcagttagtaacttcatacatttgcgttacctagacctcagatggtcacgccttgaagaattacctgaagccgtatgcaagctttacctactacaagttttgaacataaagcactgtccgtgccttcttcatttacctccaaggatagccaacttattaaactttgagcatctgattgctgatgaaggaaaacatttactcacaggagttccatgtgttggcaatatgacttccttgcttctgttggataagttctgtgttaggaaaaccaggggctttgacattggacaactgaaaaggttgaggaacctaagaggtttgttgaaagttcagaatctcgagaatgttgatggcaatgaagaagcagcaaaggctagattgagtgacaaaaggcacctaactgagctgtggctgtcatggagtgccggttcttgtgtacaagagccttcagaacaataccacgtcctggaaggtcttgcaccacattcaaatgtaagttgtctccatattacaggctataggggcagtactaccccatcatggcttgctagtaatctcagccttagctcactagaatatctttatctaaattatggttctgaattggaaattcttcctccactgg

SEQ ID NO: 36125 - DNA, 1374 bp, Oryza sativa
aacatctttttagatttttccagtgtactgctactgcatccctctagcgtatctaactgattggagcatttactgaaacttttcaaatgaatacaatatccattgcttcgctgtcagcctatcactctaataagtaatgcatatttgttttcctgcttggcagtccttaaagatctaaaatatgctgatactcatgagtgggtgaaggttgagggtgattcagcaaccataggggtcacagaccatgctcaggtaatcagtttgatacatttgcaagctgcaccagcattttatcagccttcaatatgctatattactgggtctcttgctgagttgataacttcaacgtgttattgacatgcattacagcatttttcctcaaaatagaattttctgtgatagtgtgatggcttaatatgtcctgtttcaattccaggaccatttgggtgatgttgtgtatgttgagcttccagaagttggttccacagtatcacaaggaacgaactttggtgcggttgaaagtgtgaaagcaaccagtgatatcaatgcaccagtatctggagagattattcaagtaaatgatgaactaagtgaaaaaccaggatttgtgagtcgcaattgctacccttgctagactaatttttgagtaatcactgctatgttcagttgacaatttgcttctgcaattttacacagataaatggaagtccatatgagaagggatggatcatcaaggttaagataagtgatccaagtgagttaaactcgctgatggatgatgagaagtacaagaagttttgtgaggaagaagatggcaaacactgatcaatcccctaactgctggatttcaagaaactatgcagcaactcaccatcatgacaatgagccatctcgcctctcctaccacattatattattctggatagaggagtcccaaggaatgtaataagctgaaacatttttcttgcaaatcagacatgaaaattttgtagtgtcctgatcattccgtttgtgctccatttgaaattcagctcttgatttgcttatcatctgaatacaggtggaggattgggtttgtttaaactttgattaagtgacagtgacttgattgtattgagattgcagctcagggattgtgggtttgtttatcttctgaattcaattctggagatagctgcatgaaacgtgatccacccgttttccagctatattattccagtttgaataacaaaatcagatttataaaacattaaaacaagcatcattagacaagtcgataactctgttctttcaattcaatcgatcgttttgccttgagaaagtcaaaactacattacagcacgaagaatctagcttattaccctcgatccgggc

SEQ ID NO: 36126 - DNA, 3191 bp, Oryza sativa
  unsure (1)..(3191): unsure at all n locations
aaagggagctgggccgagaggggaggaggcccaagaggagggagagaaggagagggagagaaagagagggaggagggaaggacttcgggctgggcttggcccaaaggaggagggagggttgtttttagattttctttttaatagactttgataattgttgttgttgtttaataattatttccagtgctctgaaaattcaagtaaaatttgagggctccttttagaccaaggagaatttaacaaaaaatctccgggccacatttgaatttttcttgcacgtattttagtgtttgccaatttctttccgaattttaattaattctattattccttttagaaaatgaattttatttcgggatgaatttatcaggacgtgacagcaaccgattattttaccaagtgggtagaggctattcctttaaagaaagttgattctggggatgctatacagttcgttcaagagcatataatctatcgatttggtatccctcaaactattacgactgatcaaggttcaatttttgtatccaatgaatttgttcagtttgtcgatagtatgggaattaaaatgttgaattcttcaccgtattatgcacaagttaatgggcaggccgaggcatctaataagagtttgatcaagttgattaagaggaagatttctgattatcctcggcaatggcatactcgactggctgaagcattgtggtcttatcggatgtcttgtcatggatcgatacaggttcctccttatgaacttgtttatggtcatgaggctgttttaccatgggaagttcggatcggctcgaggagaacagagttgcaaaatactttaacagccaatgagtattataaccttatggccgatgaaagggaagatctggttcaatcacggctacgagcccttgcaaaggttactagggataaggagcgagttgcccggcattataataagaaagtagtacctaaggacttttcggaaggtgaacttgtatggaagttgattctgccgattgggactcgggatagcaaattcggcaagtggtcgccgaattgggaaggaccgttccaaattcataaggtggtgtttaagggagcatacatgttgcaaggactagatggagaagtttatggccgagctctaaatggcaaatacttgaagaagtattatcccagtgtttgggttaatgcatgatcggctagtgttgccgatgcatgatagccgatgtgtttgcatcgccttgggatggtcgatattgttatatcgcccttagttgcttttcactattgtaatcggttgtggtttgccgatgtacgaatggccgatattgttatatcgcccttagtcatttctataattttgtcaatgttttcaacattgtaaaattacgggggcacatacatagaaaattgcaaatttttgcaaatttttgtgtcttagccgattacaacagtttcttacagactattacatggaaatcactgagacaagtatcgctggatagccgatatagccctttgcctaatctgatttatttcttcgatggcttgggcgtcttgagcatcggttccaggaatgactttcaaggatttagtcatctcagcaacgttcttgattgccgattttagccttgccttctgctcttcgacagcttgcaggagatcggctaacttcctgtgctctagatccagttcagcattgcattcttgaagttgtgccaagagttcaatcttgcgagcttcaagccgatcaatattggatttgatcaggccttcagataactgatcaagcttggctttctcttcatgaacaagctgtcgattggtttggattgtagcctcgatgtccttgtgttcccggagatcggctaacctctgcctggctttctccagtttgaattgatgctgctcgaggtagacagctggagtaagagcatcgactaattcgtccggaagagaggcttggatatctgcaaatcttgcccggatcgagccacagttggtcaccaggttatctagtgatgctcctagccgatgggagatgtcttcgagtgttttcttcacatcatcagacaggagagctgttgctttactggtggtgtcttcttctgtttcatcgaggtaatctttgatgtcaaaggagaatagatcggctaagacctgcaagagacaatatcatggatgattaaggatcaagatatgattggccgatctcaagtttatgttaataaaacttactggaatagtaggtgcagctaattgttcctcctcttcaacatgatgactacctgcagccgatggagtgcggccgcctgattctacctgcataagaggggaagaaggaggaggaggctgccaaagggataaatgttagatataatcagcccaagtcagttaatgagatgatagaagtatcttactggtggagctggtttaggggttggagtaaccgatttcttcctcacggcaattttctttctctatatttattaaaattgtgaggaatcggctataaagtaaatgactgcaaaagtggacagagaaagttgcttacccttgccaattgagctggagcagaagggaatggaggagcctgcttaggtgaagccgatggtgttttttcagtatcgcttatttcggctgcggcttggtcgatgtcttcctcgatttcttcttcatccagagcttgttcgatggatggatctagggcgggtagatcgtcagctggcttagctttctttgtcttagccttcttcttcggagccggggctgaagtatctgcagccgatgatctggttctccgcttcttgccggcatcggctggttctctgatgagtccttggagaagtgctgaggtctttggggcattgtagccgatggcagaaggagatggcccacctccattgggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36127 - DNA, 549 bp, Oryza sativa
tggagctatacaatattattaatcaaggccgtgaacccacacgagcctgccttaacccaaggcctctgatgattcagaccgaactggcaacccgaccctgggtcccagctcgtcccaatccaacccaggccatccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacgtacggccggaacccccgggacaggtaggcaggactgagcccctagcagcaggacaccggccctgtgccatgacatctcgactaccgggccgcagctcgtgtagccttcatttgtcctagacatgtccatcgacccccgacttcgtccatctccatccg

SEQ ID NO: 36128 - DNA, 314 bp, Oryza sativa
gcgggaaggtgtgggtggtgtacggcttctccggcgaggagctggacgacgtgcactgctacgacccgggcacgggcgcgtggtccacggtcgagaccaccggcggcgtcgagtgcggcgacaagccgtccccgcgcagcgtgttctgtgccgcggggatcgggaagcacgtggtggtgttcggcggcgaggtggacccgagcgacctggggcacctcggcgccggcaaattctccgccgaggcgttcgcgctggacacggagacgggcgcgtgggcgaggctggacgacgcgggcgagcaccacccggggccg

SEQ ID NO: 36129 - DNA, 664 bp, Oryza sativa
atgccacctcggatttgagcttagcgccaacaaaagttggcgctgagacgttatagctcagcgccaaggtccatggcgctgagttcacggcctatttttggtgaagttttttgcagggactagtttcgaaataagtttttaaaaaagactaatttgttaaaaaaacggtggttgtggcggctccattttggggaattttttttgacttagattctaatttgctacatcaatgtctgaacccaacaaaccaacgtaggtgtccatcaattcatctagcaagaaaaatcatagcagcatacaagtggtaaaacatgttgaaggatacaaatatattacattgtgaatctatcaaatattaattaagagagccatcaatgcgagcagtgcttttgcatacgtagcaggtcgatgaccacatccaccaccctagaatccattgccacctctagattggtgcacccttcctctccactaccaccattccgccatggctccaccctcattcccccatggctctaccctttgaagccctgccactaccaccatcgctgaaaaaaaagtaaagggaatatagggactcacctacgctggctagtaatgatgacaatgatggacgaggcgttgctcggtcgatccggatggggcgggagctcggtaagaagag

SEQ ID NO: 36130 - DNA, 1340 bp, Oryza sativa
ttccttgaacttaaagtggaagcaactggaggaccatttccatgggcttgagcagtcgctcaagaaaaagtttgatgatctgaaaaggcaggaagaggagttcgaggagacggttgcaaagtcagagcagatgctggagcaacaagaggctgttgtcgtggcaaaggaactgacttctcttgaaaaactgcagcagaaaagggatgccgcgttggctgtgatctttggcaagtccaagctgaacttgtctacgcctcttatcaacccaatcagcaaatccgtgaataacaatgctgtgtttaatggaaacatcggtggtagtctttctgttaagtggcccaaacctgcaactgcgcatggtgcatacctgcaagatgaaaacactgctgtgaagcctcgttctcaacttgttgtcctctgtgaagagatgaatgttaacgggcttcataagttcatatcagacaatcgcaaagacttaacatccatccgtgaggaaatccccgttgcacttaggggagcaactgatccatatggcttggtgttagcttctctagaagacttctattttggagacaatcttatattggatggcaaaaaggatggaaaccttctgggtgtacgcaggacgtgcctcatgttgatggaatcaaaagctcagctgcaaactgatgctactactggtttcatatcggaaggtcaagtgcttactgcaagtatcaagaagcgtgcaaaaaagattgctcttgagtggaaatccaagttggatagccttgactttgatgctagcaatgggaactgcctggaagcacatgcgtttcttcaactcctggctacctttggtatatttgctgaatttgcacaagatgagctgtgtaagctacttccctcagtcagtcgtcgtcgtcagacacctgagctttgtagaatacttggattgtcccagaacatgccaggtcagtgctatcatcgattaataatgcagcttgttccattgagcatcaataataaatggaattttctatttctctttgtcactcagatgtttagagaacacattctgaccacttcaataattgttcatatatctatatatctataccatgggatttattttctagttagtggctgcagcaagagatgcctacaagtaatcagaattgtagcattgctgtttagataatttgtatggaaaatctgcaggctgctacttataatttggcagccgcacaccgaacctcactatctagtatctgtattgtacttagtggcagcaaagtttccacagcttctaagctatgttatatgctcagttgaggtcttaatttaactgaatgtattta

SEQ ID NO: 36131 - DNA, 1345 bp, Oryza sativa
agtacctgttcagtgtctctgctgatttactgataagaacatgctcaattgtttcagtattgtttgagatgtataagaagttaatatccttcctgtatattctcattggatgcaccttctgtgtttttcaggctggtgctcagcaaccgctcaatgctgcacctgttgtggtgccatcatctgttcctatgccttcaaaggtatcttcgattactaccaccaatgaaaatgagggagttagtattagatctgatgaggttactggaaaatctagtacagatggaagtacaagttcagccgctggcaaaagtagtaatctatctcttgatgctttagccaaagctaaaaaagcattgcaactgaagaaggaactatcagaaaaactcaagaagctacctgtggtaagaaatcacagttgttggtagtcccttgcttctatatttctattttacctttctaacttattgtgttttttggcacagcttaataataaacttggtgttactagtactgatacacaaattcctaagaaagaaacacagcctgtttctagctctggtgcatctgaaatggctgtgggtgcagctcttactgagaagatggcagctacagcaggtgcagttggtattccaggccttgctaacattcccaatttggatgctgtgaagcgagcacaggaacttgctgctaagatgggattcagacaggatccacaatttgcgcctctcatcaatttgtttcctggtacatcctctgaactaactgtgcctcaaaaacctgcgaaggcacctgttctccgtcttgatgctcagggtagggaaattgatgaacatgggaatgttatcaacatgaccaagccaaccaatttgagcactctaaaagtaaatctcttattttactagcatgaatactatgaaatgttatcagtaactcttctgtgcaatgactgtcacttttggttataccttgtaggttaacataaataagcaaaagaaggaagctttccaaataatcaaaccagacttggattcccttgcaaaatcaagtgcacactttgatgaaaggatgggcatcaaccaaaacaagctcctccgccctagaaggcctggatttcagtttattgaggagggaaaactttcaaggcaagctgagctgcagagaattaaggtctgtaaggatcaacttttaagattagttttcaaaatgtatttacttatcatatttccttttacttaccctaataatttgaccttctagaatcaatttggtgaagcacaagctaaagaacttaaagtaaaacaagctcaacttgcaaaggcaaaggcagaagtagtcatgaacccga

SEQ ID NO: 36132 - DNA, 414 bp, Oryza sativa
ttggatattattgccaattttgataattttgctattagacatattgctaggcatgataattctagagcaaatgacttggcacaacaagcatctggttataatgtgaagaaatgattatttctgatattagaagagtcggtgcttgattttaaatctttgtgcgatattggcaaaactgaagaccaggagcggtctgaccggcattacacggccggtctgaccggtgaccaggggcggtctgaccggccacatgccgtcggtcagaccagcgaccccgagcggtctaaccggcctggtgtcacgcccagaaattcccgaatagaattccaagcagaatgtgcattaaaatccccgtccaggaccggccggggtacacaaacgacaatattgacattcagatccacgtcttacaaa

SEQ ID NO: 36133 - DNA, 1643 bp, Oryza sativa
ttgttgctcaagcatctgctccgatttcgcgactgtctccttgaactccttttcctgctctttcagctcatcaaactttttcttaagcgactgctcaaggccatggaaatggtcctcaagttgcttccactttaagttcaatgaaacagcactctggctctcaagctcggcaaatgcacgctgaagcagctgcagcttggagcctgtagactccataagggctgtcatggactccatgtcggacatggcggcagctcctgcaaatgagtaaacaacggaagctgttggttcgcgcaacccaaatagcactgcaaacaaatccccgcacagtacagcaaaaacttcatcgaaactacgcaatatctcactaaaatggttcggttaatttcttcctgcgcatggatgaaggaacattgaagggaattttatacgctattgcacacaaatcggagaacatagcaacatcatctacccatggacggatctaacgtgggacatggtatactgtgatgtaaatttttttgggggaacaaacaaactgttatttgtaaggtgatcaaaattgagagaaaagaagcttccagatctggaagagaagctagaattaacgcagggaaattcaaggaaaaaagtgggtgggtagagatgaacgagaaagaggatggatactcaccaggatgcggcggaagcagcaggacaaccgacggggatggagatcggcgcagggcagcggcggccgaactcgcgacacgggactccacctccacgcccagccgacgggatgggatggggacaccctcaggcgaggacacaatgattttggccagcagatatttcctcttttcttttttttttcactactgttcaatcgcctaatccctactacgtctctgtttctttccttatccctaagttataaaaaaataaaaacatttccgtccgaaatttccatacattttccgtatttgatttgattattggtcgacatttctgattcgaggtgagtctagaataaatattataccagcccaacctaaccagtccacaccatctcgtcacctcatcctcatcctcacccccacttggcgccgcactagcccctccctcgatcggcatctttttctctttccatttttcttttttctcccaatcatcctaattctcttccgatcctttcaatctcgtctattttctcatttttcttttctcttccgaatttctcttctcataaatatttttcttttgaaattataattgttaaggtgtgtatgcggcaagtttattactttgcaaatactttccatttacagtaaaataatttcactaattgaataatcaaaattacaatcttcggtcaatgaggtatagcaaaatacacgtgtcaaataatagaatagccacccgatcaatttgtgaggccttaaaatttgcggaaagtgtacatgaaggatccttcatatgatgatgcatgaagctagtgtgctcaatacttatatatgatttctgactttgttttgccatggttttgtttgtcttgtttcggtttgtcgtttaaattggtagagtttttatcaatcgtgaaattgtctttacctgttgtaacgcacatgcatctttgttgctccctccgtataagatgtttt

SEQ ID NO: 36134 - DNA, 3185 bp, Oryza sativa
ttccacctcagctgctccttcttcctctgctgcacctcagcgttctgagtcttcttctcccataaagaaggctcttagggctatcttttgcatgtgtgccaagacagctaagaaggtaaagaagatagagaggcgtcaaaaggatagattggacttgcagcaggcaagggatgtcttctgacatttctgatgatgaggagtttgttgatccttttgctgcttatgagactgctcgagacattgctagtggtgagggtccctctggcacttctcgtttcttcaatgaggagtcctctcactccgaggagagcagtgatgatgaggagtcaaatgcccctaccgagaatgttcttacagatcccgatgaggcagtggacgccgccgggcaagacatcgactctcctcactccggcgacaccgagatcattccttctgatggcgatgatgatgaggcttgatcctcttcttcccttgtgattttgtctctttttggtgccttgatgccaaagggggagaaaattgcaaacgaaggggggtcaaaattttgtttttgatgcttactgcctgctatctgtataatccggaagttccggatcctcttatctggaagttccggacctgacagctccctctccttattgtcatgtcagcttatccggaagttcctggtattttatccggaagttccggacctggcaatcctttgacccctattcttaagaactcatggacatgttctaattctctatttgtgtgaatgtaatgtctattagatgctcttagccgccctttatttatactgctcttcatttatgctatgagtgtcttatttgttgtttgtgttatgatgttgattttatcctcttgagtgctcaccatgtcgtatcttttgcatataatatctattcttactgctttttgcatcccatgaatgagtagggatgaaggaaactctcctcggttgctcccttatatatatgcatatgagcttctctcatatcttccatatgcatacattaagggggagtttcatttacctttaaccattcaaaacaaaatttaattcaatcttttgtaagctttaaccatgttgtcatcaatcaccaaaacgggggagattgaaagtgcattaatccccctagtgggttttggtgattaatgacaaatgtggttaagggactaatgagttcattgagtgactttcaggtgcattagtccaaggtgtggaagatggatgcttggagacccccaaaaaagtacaaaatcaaagcggaccggaactcgagaagggcataggatagtttatcttttgaaatcgagtttttaggaaaaactgtactattaagaggggttccaggtgatgctctgagatatatcaagtgctcttagtgtgaaccaagtgtcaagtttccctaggagtcatttttgcaaatactccatctgtccaaaaatgcaagtccggaacttcctgtcttccaggtccggaagttccggtcttgtgaaaaagattttcctaagtgtagtccggaagttccggtctttcaggtccggaacttcctgtctagtttccagttcaaatttgtgagtaacggctagatgacgttacctagccgtcatacatatacagctcgattccagctcgttccttggccattccactttcatttttcaaacctagagctattgctagcctctcccaagtgtttcttgtcttctccactcaatctagagcctaattcttgtgagaaagagagattgagagggagagaagaagatttggagatgtgtgaagactaggatcttgggtgagcacttggaatatctcgtgggctgtcatctcggtgcttattactcttggagatgatctcctagatggttaggtgtcgcccgcgagaatccgttgcatattgtggatgtcccgggtaagtttgtgaaggatttcctctcctccgaaagggaacgaggtaagttggtgaagttcttgtgctgagattctagaggctttccaagtagagcaacccacacttgtggtggatttctagaagtaggttgagttggatcttggtggtcactcaattctagaaatttgcctaggggtgtttggggttgaaggctgtggatttcctcaggggtttttgcacaagtgaggcaaggggttaattgagacccagctctttggagctcctcaacggagagtaggatcgcaagattcgaacttcgggaaaaaatcgctcttgtctctttctgtgatgtttctgtgaatgattctatgatatatcctctgcttagaatacctgtgcaccatcttgtgaagattggcttagtctcctgtttcaaaatttgaatttcatctctgttttgttacccggaagttcctgtcttagcacaccggaagttccgggcctagcaggccggaagttccggagttccttactaggaagttccaggtctgtttgaaattttaccgctgcgatttgtttttaagatttcaggggacagcctattcaccccccctatagacttcatcagcgagttcaattggtatcagagcaaggtgctcttgattcaagcttcactgctttgagtgatccacgatgtcggatttagggggaaagaacggggaaaatggaaatgaagatggaacgagcagcaaggaaactccatcacccaagggagctactataccttttgattacagcaaacttaccattccccctcacaactttgtctccgtgccttctaggcgtgctcctcaatttgatgggacacattacgccgcttggaagcacaagatgaagttgcatctaatctttttgcatccaagtatttggaaagttgtttgtataggtattgatgtaccccatgatgacatggagctcacttcggagcaagagcaactcatccaccgcaatgcttaagcttccaatccaattctctccgccttgagtccggaggagttcaacaaggttgatgggcttgaggaggccaaggagatatgggatactttgcaattggctcatgagggatcacccgccgttcgtgaggccaagattgaattattggaagaaaggcttggaagatttgtgatggatgacaaggagacaccacaagagatgtatgataggatgatgatccttgtcacaagattaaaggacttgggagtgaggacatgacaaatcactttg

SEQ ID NO: 36135 - DNA, 1318 bp, Oryza sativa
attcaacgggccaaatcttcttgtccatttggaagcctacaaggtgggaatttatggccaatccgcacagaatcgtgaggtcaagaaaatttcctctagctcgatacattgcgccaccgcttctccatctcgcgattgcgagcagacgatgccaccgagcctcctccagcgagatgctctcaccggtcctccttattcggtctacccctaccgctctatccctctctccttagatcttgggtatgcccttcttctttcccctcttctcctagagtttccgggtttcctatttgacaaagttggtgatgagccgctctgtcctaaagtgaacaagagttatgttatggttggcatgtctctatcttaagaggatttttccattggaatgggttagtttatctcttagatttagggtattttatataaatagatggccatattgaaagggtcttgagaatcgttaattttgcctagaggaggggtgaacgggtgctttgtgatatttcaaaacttgcagcgagattagaactaactagacaaaccgacacaacttccggtagtccaactatagatgagttggatagttcgactgctgtaggacaatccgattagtgcaacgataggaaaaatgataggttttgggaactccgattgtccaattgctgcaggacaatctggttaacacaaggatagaaacttaagtgatatagtaagaaacaaactagaaggtccacttaagcatgctttctacaagggcaagtgttgacggtcattatcgatcagttgcgaccgtcaatattaccaaaatagaggagaactagttatgcttgcaatacatatacaagttagaataataatattccactagtattgggtgtactaaccttttgcagagaataaccataaagtggaggagaatcgacatcagcacatacgataaatcaatcggacgatgtcgagaatcaaacttatgcatgaatgggccaagaactcagaattgacataatgaattgggccaaaattcacaagtctaagaagtgaagtaatggaggaggccacctaccgaattcggccgaaccccctagcaccgttggatgcagggtttcttctggatggcgtggatcactccccaatgacggttggagagcaattctgaccattccaactgccaccgaccatccccaaggagttcactctcttcacttcaacacacacctcaagcaagagctctctcatattctctcaagttagtttagtattcttaagctagtggaataggaatatagtagaaattaggtatggctctagtggctttcct

SEQ ID NO: 36136 - DNA, 802 bp, Oryza sativa
ctcttgctttctcatacatatgcaattgattgtgtactgccttgatctataccttttcataagaaaggtttggttcagttttgggggaatttttttggctgagatttgttcatgttgcaagagtatttggctatttgctgcttcgagtgatggttatggacatggattagttgggaattggggcttgtttctgaaggttgttcatatattttggggagggttgtggattgaccctgctaggatgaaactttgttctaacccaagaattttgacatttggggattttttttttctagagcagatcactaaggaatcagaacatgaggcttagaatttttgtttttaaggaattagacttcgaaaattgagtagcatgttcagaagctagggatttcagattataaaaggttggggtttaattagcgaagaagtttcaggttgtgatgctatgctgcggtgttgattgggtaacagtgacggattgatagccatggacatgaaaatgagttgggaacttgggttttatgttggtgatagtaactgtttgaagattatataaagggtcaaatatcttcggtgtatcttgttgattccagttttccaaggtttgttgacaatgaagattattcgggagggcgttgtcagaatccatttcagtttcagctctctggagttgaccaagggattttgattccaaatttccagggcgatagcaaaatgctgacttcaaatttatgtgtcaataacatttccagtcagttttgagaagtacaatttgtgttattcaggtgtttctgaaaac

SEQ ID NO: 36137 - DNA, 987 bp, Oryza sativa
gcgttatatttttcatcaaaaatagtcggtatgtatttatattgtaagttcctaaattacatatttaattttagtgtatttataatgtagctctcatatttatatacataagtcgcaaaattacatatgtaagtcccaaataaatttacatatgtaatcagtatgtaattatagtgtaagtacgatgtaattagtatgaataatttatccactagtgatatagtttaatctccaagtataaaagcaaatactagcacaaatcttgaagataatctgttgagttgtgatacaaattcatttgcacttaataaatgctagcttctaccgtagtaaagcggaggcccgtcgccgggaggcttgggccggagcgtagcggacgaaatgacagtgggcttgctttccgttcccctattcctaatttgaagagctaatttgcgggattaacaagaggatggtagtggacgttcgacgcctcaagtcctcaacgcccgcatggattcaatgcaagtaacaaaaatggggtcctcctatctgttggactgggggccatatgtcatacaattagtgatatacctggcgccagtaatttttgagtggggtccagggcccccacaccttgtatggtaaatccgcccatgcgcacaaccattgctagtggactagattgctttctgtcgcctacgtataatatccttttaggtggccatcataacctagccgttgcgaaaacattcttcattagtgactgctttacgacaaccgccaacgaatatattgcattttctgtgaccttcggtcgctggcgtatgagattctcgccacttaaaacatgaaatggatgccaaggattaacggttatcctttttatagtagtgaaatgtagcctctactctatacaaactgtagagaatagcgtggattgagagcaaagtgtattttttttgaattgagagcaaagtgtataggggttatataatagagataatt

SEQ ID NO: 36138 - DNA, 654 bp, Oryza sativa
tatgcagcaagacctggtatactaccaccatttaggggtgttcgataccacctgaaagagtacgaaggcgggaaatcaccagaaacacctcaagaattattcaatcttcgacattcctcccttcgcacatctgttgagagagcatttggaaccttaaaaaaccgtttcaaagttcttgctagcaagcctttctttccatataaagtccaagtgaagatagtaatagcgtgttgtgtactgcataattggatccttgataatggtcctgataacatcatatatgatgaagctcgttggtatagtaagctacctagatcagctagagtagcgacagattatggcgaggagcaccaacagtgggtagaatttcgagaaaatctagctaatattatgtgggaggaacattaacagtggtgttgtatggcatggatattgttctatgactgttagctatttctaatgaattcttctttcagctcttcatattatagcattttctactttatgtttttttgttggatgccattattacctactgtgcattgctttgtagttcataacatggatataggaggaagcaacaaacatggcaagggaaaaagtaaggcacgcaaaggagttgggggatcaggtgtgaggtcaaaacccataaat

SEQ ID NO: 36139 - DNA, 471 bp, Oryza sativa
acgtattacggtgccatcgaggacatatgggaacttgactatggtcctctcaaggtccctctgttctggtgccaatgggttaagttgactggtggaggcgtaatgattgatgacagtgggatgacaacggttgaccttaacaacgttggatactcagacgaaccttttgtccttgccaatgatgtaacgcaagtctttttcgtgaaggacatgtatagcaaaggaaagaagggcagagggcctgacgagcctaagcgtcacgtggttctcccaggcaaaagaaaaatcgtcggagttgaggacaagactgacgaggattacgatcagttggatggacaaccccctttcacggtgacgattgaccctagcatcctcctatcaaatgaagacaccccttactcacgtagcgatcacaatgagggaacaatagtgaggagaaagtacgtgcggtcaaccgtcaccgccgatgta

SEQ ID NO: 36140 - DNA, 591 bp, Oryza sativa
tgagttttagtataagattatttgagttttaatataagattattagatttgtaattagacttactatataatttattgactagctagggtcctataatatacgtcacctagacttagcatatgattgttagcatataagattgttaaaacataaatgtctcatgacttagcagatgtttcctgtatgaacagatggctgatcacgatgaggaacagatattgtacgatacaatcgcggagggaagcagccagtactggaacgaagaagaggggaacgaggacccaaaccagtatttgaatgaggaagggaacgtggagagggatgcggaggggaaccaggaggggcacgtggaaagggatgtggaggggaaccaggaggaggaggctagtggaagtcaaccctccgttggacagaagagggcacgtgggcaacgaggtgccacgaagaagcttgagggtcggcacatcataacggaagtggaagaagatggacgacctagtgccccggcagaagccaccaagaactatgtacgtcacagcggttgggttgtgcgggataacgtgcctgtcattacggtgtattggcgaaga

SEQ ID NO: 36141 - DNA, 251 bp, Oryza sativa
aataacttgcaccatttaaggaccaaagtatttatgattggttttgacagaaaagatttaggacataaggcgcataatacctagaatgttcaggaccaactgctcgcagagctcatacaattgattggcaaccatataacgaactcgccatgatttgtcctatttaatgagttacagagagtaaaagatgtcataattatggtaacacatacaacagaagcaactcggagcatcaggaacctctagcaact

SEQ ID NO: 36142 - DNA, 655 bp, Oryza sativa
gttttgtcttgatttgcaccggcattttcttaggctggtttataaattcaattttaggcttaggaggagaacttagggtgtgacacctggtatggccggtctgaccggttctaggcagagcgctggagggcacgtttcaatcaattttaaggccgaattaattgtgaattcggacatttgtgcccaagaaacagaagaagattggaggattcctttgattcgatatttgaaagatcccacgcttaaggttgatcggaaaattcgacggcaagcattcaagtacacattgcttgatgaagatttatatcgccgaaatatagatggtgtcttgttgaagtgcttagatgaagatcaatctaaagtggctatgggagaggtacatgaaggaatttgtgggactcatgaatcggcccacaagatgaattggttgcttaggagagcggtgttctattggccgaggatgattgatgattgcttcaaatattatagaggatgtgaaacttgtcaacggatcggcaatgttcaattggcgcccgccgccgtgttgaatcctataatcaaaccatggcattccgaggttgggctttagatttcattggtcaaatttatccttcgtcatcaaaggggcataggttcgtgctagttgctacggatt

SEQ ID NO: 36143 - DNA, 562 bp, Oryza sativa
gttaaaagctagtacatagttaggaaagagcacattacgctctctccatcagtggatatatggtacctggtactgaacctgatagccattaccataatatgttgtgtgggcaggtgagatgccatagggagctgagcttatcattgtgggatggtgatgggcctcagcaccatacacatactgcctctcgtaagggtaggaatgcctctgcggcggagcagcctggtagaagcttttgtcaggaaagctagtatgtggcgcatatacggatccattggcacgaggcctcttagactgtggctttgcagcttcaacagccctcctcttgtctgccttagctttctctagctggataactcttttctgaagcaggtcaatcggatatttctcatcaagtttgtgctcctcgatacacttaatagcagctttcaaggcagacagctctcgttcattcatttcattctgaataatatggtaattcatcagatatactacaatcacaattaattaggaatgcacgcagatatgcttaaaaatgtacagaccagcaagaagagaaaat

SEQ ID NO: 36144 - DNA, 375 bp, Oryza sativa
tagaattcttttaacctatgccgctcaccatgatttcaggttattccaaatggatgtcaagagtgcctttctcaatggacctatctcggagttagtctatggggagcaaccaccagggttcgaggatccaaagttgccaaaccatgtgtacaagcttcacaaggcgctctacgggctcaacaagcccctagagcttggtatgaatgtctccaaaattttcttttgaaaaatggttttgaaattggaaaggcggatactactcttttcactaaaaaatttaagagtgatttattcatatgccaaatttatgtcgatgacataatatttggttctactaattcatctttttgtgaagattttaatactattatgact

SEQ ID NO: 36145 - DNA, 660 bp, Oryza sativa
aaataatatacataattttttttgagaaataaaatacataattgtgcacgtaaataaaattctattcccatagtacgataagacaatacgaaataaaatatcaaaacatgaactaacagttaacgcgcataatttcataacgttataattttatcacaccatggggcaagaaataaagctaagtatcaaaatgtcatcgaaatcatataatcataaaattctacctcataatactgttgaaccaaaataaagcaaaattaacattagtatcaataaattaaatttctagctgaatttcttgttagttccatttagctacacatgatcttcattgcataagaaagtttataatgcaactttatggcatcaaataatggcttaaacggattaaaatgcatttatgtaaaggaaaaatcactaattcggcccgataataagggaaaagtaatttggcccgaagaccagtcacgacccagaggccagagctagcctgtgattgggcggcccttgaggcaagcatagcccattaaccaatcatggcccgtcagtgtagccgtccgattctgatggacggccacgatctctgatgggtggctgatgcggcgtatgagagtcatggtgttatggttacggataaggcggttgtagataaggcatacc

SEQ ID NO: 36146 - DNA, 346 bp, Oryza sativa
ttctggccagagggtctttactatgattcatatgtaatttccaaaaattcagagggcaaagtggttgcttattttaatgggaattacaatgatgagtaccgcacttgtgtgtgggtgccaaaggctttggtgactaacatcaagggacccaaacttcgacaagtttgggttcctaaatcccaagcttgatctcttttgtaggcatactcctccgatggctcaagttgggttgtggacagtggctgcaccaatcatatgacgggagagaggagtatgtttacaagtcttgatgaggagggtggaagtcgtgaaaatattgtctttggagatgatggtaaaggaaagg

SEQ ID NO: 36147 - DNA, 1462 bp, Oryza sativa
  unsure (1)..(1462): unsure at all n locations
aagcagtgtaccgttcctggatcataatcacccccttataaaacaaggcatggactccccagcgacccccgtgagcttatctccgccacttcttagtctagtgctccgcaatgaaccatgctatacaaaaggtaaagccgttgcccatgctggcttgtggttggcacggttaatgtttcacaaccgaaactcgtgaaccggtccttaattgtcatgcgcacgaccatcaaaactatgtgttcacaacccaccattatcaagttttagttggcacattaattaattaaccaatcacgattgaccatcgtgagcttccattaaatatccataagtgatagtgaagcatgatttatcccattagtgagctattgtttctaagcatggctaagcatctattataagtatctagctgaaccaaactaatatataaggttctagctaatcaaattataacccataaaaaaataaagtcatcttcggccataattaaatgggaaaggctcaccacccggtgacattcgaacataaatgcacagttgaaataaatagagaatttaaatataggattaacatgctcaaaggaattgtgtttgggatctgtgtgacttgccttgcaatattcggtcttcaataagtcttctggaacacttccgacgcactttcgaaccttcgaaacgacggaaacgacaagctaacacgccanannaaaanaaacgaggagaaagactaataaaaaccaaataaacagtacataaaagtaaacaaacatgtagatcatgattttacataaatttagagacttgaacggtctcattccgatttcatatgaattaattacaaattttacaagatttaattccaattaaacctattaaagaaaagactattccaaattaattaaaccatttacaaatgatttataactgagacaaaagattaaagcaacctccagaaaagattagatcatatttggtagatgacatatattaaaaaggaataatatgccattgaaaagaggagaggatttatatcgattttggacgactgagattaatcttgaccgagagttgaccaagatcagatggcttggattgatctggcaagcgagcctcacgagataccgactcaacgagtcaattctacatgacacgggatcgcctaaatgattagccgaaaccggcgaacggagccggcagctctgacggctctaaactaaaggacgactccacacggatgaatgaacgaaacacggggaacacctcgttcgaacgaacgagcgaacaactcaacaacggctgtggctaaaccggtggactagaaacgattcacggtaaagccccggtacggcaaacgataggccggtaggaacctagggatgtacctacggctagacaactcgactaccgagcaacgagctaaagcggtggctaggtttaaacggcacacagctgcgacacgacac

SEQ ID NO: 36148 - DNA, 2262 bp, Oryza sativa
  unsure (1)..(2262): unsure at all n locations
ggagcccagggatcgagcccacgacgacgggaaaaactcgggaaagtttaggatttcgccggaaaaaggaaagattgaaccacgaaattggaaaggatttccatagaaacttttggggatttcttggggaaaaggaagaggagattgagaggattccattcccgcaactaatttggaaaaaggagcaacgaggtggccggatttcggaaggggatcggcgacactgtgcacggcacgggagacagtcggctggaggaggaagatggagtactgtagcgccaggaaggtcaaacagacttttttgcgggctgagaggaagggagggaatgggctgaattcggcccaactgatgaggaggacttttattacttttccaaataaattaaccaatgagatgatctttcaattattaaaaatacttccaatgctcaaataattccaagaaaaatcttgaacatacttggacactcaaagtatttaatataataatatccagatcatttaatgattaatttattatttaaataattgctaaactgttctttgtattattaaaattaagaattgagctctgaaaaatccgagaaaattccaaagagtatagttaatcatggagaatttaataaaaattaaatccaaccatgctttatatttaggaaattttatttcccacatttaacttcacttgtaaattaatgaacttttaatataaattctattaataatttattaaataatttataaatcctgaaacggaaattcaggctatggcagtaattaagagttcccgaatttaccaagtttagtggtgaagatggtaggaccacatgggagcatgtaggtcaatttttagcgcaatgtggtgaggctaatagtgatacttttanattgcgcttgttttctttatctttgtccggtaccgcttttacatggtttacttctttactggcaaattctattcatacttgggctcaattagaggagagatttcatgattatttttatactggagaagccgatcttaggttatgtgatttatcatcggttaagcaaaaatataatgagcctgtcgttgattatattaacagatttagggatgttggaaaccgatgttatagcttaaatatagctgatagagatttggttggtcttgcttttaatggtttaattgctcctcttagagaaagagtagatggccaacaatttcttgatgttagtcaacttatgcaaagggctctggctcaagaaagccgggttaaggataataaatatattgttagaccatatgagaaaaagccttatgttaatgtgattgattaccctcaggctagtgatagtgtaagatcagggtgatcatgatatgtatgctgctgaatggtcatggactaccaaaaaaaagccttttgtttgttctaacttaatgccgactcctcgcaaagatcggcaaagtgaggttaaatatagttttgatgtggccaagtgtgataagatatttgattatcttttacaagaaaaaaaattagattacctaaaggccatatcgtaccatctcaagaagaattgaaacgtcgacgttttttttaattggtaaatggcatgattctcattctcattccactaataattgcaatgtgtttcaacgacaggttcaatcggccatagatgaaggacgattgaagttcaccgatggctccaagatgaagcttgatcatgatccttttccggtgaatacaattaatttcaatgcaagaaggtgttgatttggccggagcaagccgaatctactaaaggaaaaggagtaatcattggtgaaccaaggccaaagatgatagtaccaaagaagccgtaggttggtgtttggaaagagaataaaagtgaagcttcaacttctaaagctcctaggaagactaaagtgacccttgatatgcttttggagaaatatgaaaagcagggtggtgagagagctcacaacaaggggaaaagaccaagatcacctctttgggagcgatttgttcactcgctaagacggtcgcattcacctccatatcatcatccacaagacatgtcatggggttcttattcaatgccgccgccgagttatacttatccttattatatgccatggggggcaacatcgccaatgttcaaccatatgcctccaatgcaattcaaccaagggtggggaggaccaagaaggccaattcatgagcgtttttcttcaccaaacaatggccagttttatggtaggaaccgggccaatga

SEQ ID NO: 36149 - DNA, 609 bp, Oryza sativa
agggcggatatggcggcagagagggcggtggagatggcggcggagagggcggcggagaggttgaggcggtgacggtggagatggtggtggagaggacggcagcggtcgagagagtgagtgaggaggcggtggtgaagagggaggcggcgatggcggtgaagagggcgaagatggcggcagatagggcggcagagatggcggaggagagggtggcggagaggttgaggcggcgatggtggagatggcggcagagaggacggcggcggtcaagagagtggcggcgagaaggcggtggagaggtcgaggcggcggtggagagggcggcggcgaggagggcggtggagaggtcgaggcggcggtggagagggcggcggtggggagggcggcggagatggtggagagggcggcggtgaagaggtcgacgcggcggtggagagagtgagtgagtgagagtgggtgccggatctggatcgatctagaagatgtccaaccctaggtcaaccctagtcaaactcacttgtgacgggcgccaactatgtggccgtcacaggtggcctcacctgtgacgggcgccaaccgtggagccgtcacaggtaagacaacctgtga

SEQ ID NO: 36150 - DNA, 596 bp, Oryza sativa
caaggtaaaggaaatgttttatttttaaaggaatcttgcctttccagatagaccacatttcagtatctttaactcccccaaaagttaaaagcctatacattgatttagcagtaaaagacttattttttgtgtaaggccaaatcacttcatccctgttaccatcaagctggacagattggaggatatccttcacaccatgtaattctccctctctctctaaatttaggcttctcctaaaaatcaaattgcagtcgccattagcccacatctccctaacagtagctttttgttgtaaactcacttcatacagcttggaaaggtcactttcagaggtgcatcaccaagccaaacatccccccagaagtccaccctaccgccatcatgtactatttttttgcaccaatctttgtaagtgacttttacaatggtgtaagcccttccagaattgagagccccctacctctaaactctggaagaagcttcccttcaagtattttctcctgagaacttcatagcacatgtcagtagctctattatccaatttcataatccacttgctgaagaggcaaatattcataattctagtgtccaaaaaa

SEQ ID NO: 36151 - DNA, 8654 bp, Oryza sativa
cagcacacccatgctgcacaggcccaaccatcctgaacaaccatacccggctgtacagatctatctccaaaccaggaatgtaccattccaaaccaggagctaatcaaattattaccagttatagcatcacttattatggtgagaagtgtgagactaatcatgaaagacattgttagacccgcccataaccgcgggcacggctattcgaatagttttactctggccagaggtgtaccactgtacccacaatacacaactccacaatatgtcaccatatcatcatgtgcccatgctgaacatgtcaccatttgtgtagttgtgacaagatccctcgcataactcaacccaaagcagtgcaccgttcctggatcgtagtcaccccctcaaaaccagaggcatggactcctcagcgacctccgtgggcttatctcctccacttctcagtctggtgctccacaatgagccttgctatacaaagtgtccagccgttgcccattctggcttgtggttggcacggttaatgtttcacaaccgaaactcgtgaaccggtccttaattgtcatgagcacgaccatcaaaaccatgtgctcacaacccaccattatcaagttttagttggcacattaattaattaaccaatcacgattagccattatcatgtccatcattaagtagtagtgaagcattagttatcccaatagtgtgctaatgtttctaagcatggctaagcaattatgtctaatatctagctgaaccaatatataaagctcaactagtcaaattataataacccaaggtatcaaggaatagagtaaacaatgcaaacaggccataacaaaggaataagttcacaccacctggtgacattcgaaaataaatgcacagttgaaataaatagagaatttaaatataggaccaacatgctcaaaggaactgtgtttgggatatgtgtgacttgccttgcaataacgggtcttcaattaatcttcttgaacacttccgatgcacttacgatcattcgaaacgacggaaacgacaagctaacacgcaaaacgggaaaaaagactaataaaaaccaaataaacaatacatataaagtaaacaaacatgtaggtcataattttagatgaattatgagacttgaacggcctcattctgacttcatatgaattaattatgaattttacaagattaattccaattaaagcctattaaagaaaagactatttcaaattaattaaacaatttacaaaagatttttaactgagacaaaatattaaagcaacctccggaaatagattagattatatttggtagatgacatatattaaaaaggaataatatgccactgaaaagagagaacggatttatatcgattttggacggctgagattaatcttgaccgagagttgaccaagatcggatggcttggattgatctggcaagcgagcctcacgagataccgactcaacaagtcaattctacgtgacacgagatcacctaaatgatcaactgaaaccggcgaacggaaccggcggctctgaacggctctaaactaaagaacgactccacacggacgaacgaacaaagcatggggacacctcgttcgaacgaacgagcgaacaactcaacaacggctgcgactaaaccggtgggctagacacgattcacggtaaagccccggtacggtaaacgataggccggtaggaatttagggttgcaccttaggctttgcaagtcagctacgtggcaacggcagcgaacaaaccacaacaacgacaacgcgggatagcggcggctaggtttaagcgacgcacggctgcgacatggtatagcagcaacggcacggcacggcacaacacagcacggcgaccagtggctcggtggttgcagtagcgggacggcaacaacttggcacacacgagcagcagccaaacagcagatagcggcaagcggtaacgcacagcaggagcaacatgattgtggcagggagggcacaacggcggctaggcgactagcgcagcagcgacggcaagcaacaacggcacaaccggtagcgacggtgcacgggctagggcagcagcgcggcgaacaacaacgcaacgggcacggctgcggctgcgacgaagcggcttggcaagcgtggccgatgggttgaaatctaaaccaaggagacaaggatagacgtctcaccgatccaaaacgatcggagagggagggatgatgacaacgttccgatagcaacacacggagacgacaacgctagacaaaccacggattagattatattggattaagaccctagggaaaaacctacaccggcgaacggcatgggagcggcggttgccggcgaaccacggcacaataatgcaaacggagggcaccgggaggaagagcgtgagacgacggtccttaccaacacttacgcgacgacggacggcgacggaagatggccggcgacgagcttcgaagggcggcgaggtactgtccatggtggcgatggctttccggcgacgagagacgacaaccgaggggtggacggtcttcactgtttttggaaggggatcggtggcactgtgcacagcatgggagacagtcggttggagaagaaagatgaagtactgtagcacggggaaggcaaaacagactttcggccgggctgaaagaaaggaagggaaaaaaatgggttgaattcggcccaagactagaaagaatgattttattgcttttccaaataaattaaccaatgagatgatctttcaattgttaaaaatacttccaatgcacaaataagttcggaaattactagtgaatttctgggcgtgacaatctggtaatgcaagaactggtgctccactgagagcttgattcacagcttcaaaggcttgtttctgagcatcactcccagattacttgagttccttttcagcaatgtagtgagaggttttgtcatcacaccatatacttggatgaacttgccgtagtaaccagccaaacccaaaaaatctttgagttgcttcaagtttctaggtacctgccattattgcactactttcaccttttcaagatctattgctactccattggtgccaatgatatggtcgaagtatttcaattcctgttgggcaaaggaacacttgctttctttcacaaaaagctgatgttgttgcaatagagtgagcaccattcttaaatgttttacatggtgttaacaaccaaatttggtaatatcggcatcgggaaagaagtttagatcgaagcggagtccgaggcggagatcgagttcggaaacagagcaggaatcggctggagtccagatcggctatgattaggatcggctggatttgagtcgaactaggtaagctgatgcagccgattccgatagtgcaacttgatgtatgatatcgggttgaattgaggcgcttcaaggtgattgccgcacatggatagagtcctgagaaggcaattgtatctattaattaggatgttttatgtaatttccttagagatacgcattgggcaaaagtctgccgcaaagacttatggtatcttagagtttgttagagatggtagtcgtgtccgttatggacatatcttgtaattctcgggtataaatagacccgagccctatgtaacttttaacacacatattcaatacaatttcagcacatcgccacccttttgctttagttttgtttcgacgagttcttgctttcgagttgagctgcatcggtttcgatcttcaacaagaggtaaaacttgttatgacggcttgtattctcgggattagtgcttccatctttatgatactctaatcttgtttatgtaattcgtcgagttatcatatattttacataatctctggcaatatcgctatctgtcacgcccggaaattcactagtaatttccgaactaatttgtgcataaaatcctcatccaggaatcagccgaggtacacaaactgacaatttaatatacaaatccatcttaataataacgttacatacttacaaaagaaaagaaaacagcagcggaattaacgatctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaaggatggcataatataggctcatttgcaaaagcagcatttaacaaagatttaagaatagtaaaatagtagagtaattaatcatcaattttaatcaacactgaacagcacacccatgctgctcaggcccaaccaaacctgaacaaccaaccccggtcgtacagatcaaacctccaaaccaggaattatccattcaaaaccaggagtcaaattaattaccacattattaccattaatgagtagtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatctccccctcaaaaccagaggcaatggactccccagcgacccccacggacttctcgccgcttcacagtctggtgccccgcaatgaatcaggctatacaaaagataaagccgttgtccacgctggcttgtggttggtacggttaatgtctcacaacagtagctcgcgaaccggtccttaattgccatgagcacaaccatcaaaaccatatgctcacaacccaccttaaccaggttttaattatcaattaattaacaccacacaatttaccatcgtgtgcgaccattaaatataaccataattaataataataataatataatttatatttaacccctttagttagcttatgtttctaagcatggctaagcaaaatacatataacatttagctgaaccaatccaatatataaggttcatgctaatcaaattataacccataggaaaataaagtcatcttcggccattatttaattgggaaaggttcaccacccgatgacattcgaaaataatgcataagttgaaataaaacattagctttaaatgggttcaacatgctcaaagggttgtttgggatctgtgtgacttgccttgagcttccgcaaacacttccgaaccttcctcaacgaaaacgctctcctccagaacgtcggaaactaaagcgaaaaaacaaaattcaacaaaacagtacaaaaacaagcataaacagtacatgtggatatttttaacatgtagatcttgattttagaaaaatttagcaacttgaaccacctgaaacggatctacggttatttagttatgattttcagaagatttaatctattagaaaaacgggaaaaaggaaaaaaccgatgatgacatgatgacatcatcaatggtggccggctaggatggcaagctcgccggagattggatgatcggctgcgaatttggaggacatgtacgcgtagaggacgacgagacgaacccaccggtactcaccctcgagccaaacgacgaccgacgacgaccggcgacgaaggggcggcgacggcggttcggcttacacggggacggcgggctacggcggccggcggcttcggggaaggggcggccgagcttctcctcgctcccacgcacctaaacgcggcggcggcaagcggcgacgacgacggaggtggcggcgctacctcgccggagatggccggcggcaaccggtgagctaggcggcggtggcggcaaggctacgggacacgggagaccacgggacagggggaaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacgatttgctccgattcttggggaacagaatagaggaggataagaggaatatttcccctcaactaattttgcaaacggagctcgggatgtggcggatttaacgaggaagcggtggctgcacagggcacagcacgggcggctcggctctgtccaagcttgaagatgaacagtgccagggaggcaaactagactttcggctgggcttctacttccaaggactgattaaaggagggacacaaagcagacttcgggaaagagaggaaaagggctgcaggctgagaggagactgggccgagagtgagaggacttttcctaattcggcccgaaaaggaaaaggtgaactttaattacttttccaattaaattaatcactgaaatgatctttgaattgttaaaaatacttctaatgctcaaataatttcaagaaaaaaaacctgaaaatacttggacactcaaagtacttaaaaaaattacaatcagaccatttaatgattaatttaatatttaaataattgctgaacttctctttgtatgattaaaattaggaattgagctccgaaaaatccgagaaagttccagagagtataattaaccatggagaatttaataaaaattaaatccatccatgctttatatttaggaaattttatttcccacatttaacttcacttgtaaattaatgaacatttaatataaattctgataataatttattaaataatttataaatcctgaaacgaaaatcagggtgtgacactatctaacttacaatcggctaacatctatcgaatagagcaaccgattaggttagattttgacgttgattcagattatataagatatctaccactctatgaaacttctagcggcttgattgtctagatattgttcttcttttcatacttaatgctgcatcagttgagtttgatctattaagtcgtgtttagaatgtcaatctctagcatgccttctggttgccaattagggtagcatcggagtttcagccgatcttatctaatttaactatatttgctctatatgcttcattgacatgttaaatctgccctttatgtcaaggtattgctgtatctaagtatattaggccttatgtttgatatattatacctgttttaatatcctgatatagagtagtatcggagtattagccgatacatgctagatctatctgatcggctatgctataaacatatatagtcctattattaatatatattttgatctaagtgatttatactgtctcgacatgacgaccgatctatcccaatcacttgattcaagtatatatcgatataagaactatatattggaaatatctatagccgatcgaatagatttagttctttattgtctatttacaactgccgatcgattcacatatgacatcggctcaaagataaatgatatgtcatcggcatctagccgatcggctatcatttatagatttaactgcggtttctttgcttttatttcttgttgattacaggatcaaatcaactggcacgctagcacacccgaatgcgagctttggacctgcactggaattaagcagatctcccaggcctcgtgttttctgtcaacacatggtcatccagggtcttgttgtatgttaatatatcatccacaaatacaagcacaaactttttgacagtattcatgaggccttgaaaggtggctggtgcattggtgagcccgaagggtatcaccctgaactcatacaaactttggtgggttctgcaagctctcttgtgttcatcatgctcattaattagccttatctgatggtacccagaccgcagatcttgtttagtgagcgaatttgcttcagctagttcatccaacaattcatctaccacatgtatgggatacttatttttcacagtgatgtcattgagcccctgtaatctacacagaatctccaagaccatccttctttttaaccaagagtacaggtgatgcaaaaggacttgtactagtgtatataattctctatttcagcattttgcaccacttgctgttctatctcatcctttcggcgtggggaatatctgtatgtcttcttagtgactgtcttagcaaaaggaagtagaggtatgtgaaggtcaaattgccaatttggaggtaactctgtacgttcctggaatctgtcttgaaactcccttatcacttgttccactgattatattaaatcagaaattcagatttgctttcttttaggctacataaataaaatgtgaacgtttcatgttcccaggaataacggataaaaccaatctttcaactttaaccgcatccttgagtagcaaaaatgttgtatcctctatttttgtgcaaataagctttctatgccagaagtaaaataagaatggtttgttataataagggagattgaaccaaaagaggcaaagaattagaaccagtgcacgctcttgcctagcacccgtctcgccagcaggggcggagctagaataaaatgaagggggttccacttgcttgctttactctggtttgaatcaaatttagcttgggtgcctaagtttaaactgatgggggtat

SEQ ID NO: 36152 - DNA, 1109 bp, Oryza sativa
tgggaccaactttttatcttatttgccacttcagaaaacctcattgtcacagtcttagtcaaaatcttcaaaattacattttgcaaacaaataggtctatactgcttgattttatttgcatcttttattttgggaagcaaagttatcaccccatagttaatcctatcaatatctagctcccctttatgcaaatcatcatcatttctttgatcagacccccaaaatggctccacagatgtttgtaaaaaccaactggaaagccatcaggcccgggtgcagtgtttgctttcatacttttgatcaccttctccacctcctccatagagaaaggtctgaccattcttaccttatcctcttcacttaacctaagcctatctccccaagcatccccttttagatgaatgttgcagttgtcctccttaccaaaaagcttcttatagtacccatatatatgctgattgatttgttccttatctgtgatcacctcccctcattttgtagagagaaaattaaactcttccttttcctaccattagcagacctgtgaaaaaggaggtgtttgcatctcccctaagcagccaagtctctccacatattttctgccaccaaatctcttcatgagagtaaatatcctctaattctctttctaattcatacctttctgcccactcatgctcaaaaaggtccctttcatctgctcttttgtcgattgcttccaattgcctttctaaagctttttttcttcttttttgttcactgttcaaattagcaccccaaccccttaaccaccttctcagaataggcattaagacatgccaataatccaacacccttttctgtaatcttgttggcataactttaattaaatgatatgaaagtttggatgctggaaccaccccatctcaaacctgaaaacatcactccttgtcttttcctcatccctagtgtcaactagtggatatcgcgttttgaaagcgtgatatcgaggttcgcaacgggtcaggcaataccgccacgttaccgccaataccaattcgtgagcgagagtgtgacgtcagctatggatttcctgctagtcttgagcaatgaaagagcaaagacatttgagc

SEQ ID NO: 36153 - DNA, 263 bp, Oryza sativa
aaagcgtgaagcagcgggaaaaaccagccgaaggcgaaggaattaggggagctcatcggcgcgtgaggggagtggaactccggtggatttccggtgaagaggggcggcggccgaggacatcctcgtcgttgcggagccgaaggaggcgacggcgcaggtcagcgtggacgggaccggcggcgaaaggcggccggaggcggcaaaagcagcggcgtcctcggtttgcagtggaggtggtgtttgggcgccgttttggtggagaa

SEQ ID NO: 36154 - DNA, 1302 bp, Oryza sativa
ggtatgtatgcacatgtgctctcctcttcctccctatgtttttttctcgatctatttctgtcggggggtttgatttagttagggatggcgctccatcgtacctgcttgctagttgctatcgtgttggaaggtgaggtgatgttatcgtgttggtcatcgtcagcgctgcgcctccccaagtttttaatttaggttcccttttgaagaggtgttgaggatcattacatctaaacataccattagtataattacatcgcaacccagtagtattagaaagggtatgtataacccacataatttttgcaactacaagatgtttcttaagagtgatcaatgagcaacattagttttttacaacatacacctttgtcatctcgcagatcggtgggctgctgtccagcaatgatgtcgatggcctccaccaccgccagccccttttgcccttcacccatgcccagaggacgcaaatgcacagttcgagttcaaggtatccgtctactcaatctatgcagtactctgtaatctgatcgatttctgatttcttttgcttaatttgggggtacacagctggagctgccggagcggatgcatctgataagtcgctcgagattatgcgcaaattctctgagcagtacgcccgccgctccaacaccttcttctgttccgagaagtccgtcaccgccgttgttatcaaggtaatggaaccaaatctattttctacttctctcttgaatcctcgttaaactttacttttaaaaaaatctcactgcgtgcacatacaaatcaaatactagcaaaaatcatcttagccacaaacaaattcttctatgctgctatttcatgtgttctgtacctgcagcttgataagaagattattacgccctattgctgctgttgaaagttgatgcagtaggcttcaatcttaggtagaagagaacctgccagtatgcccctgattttccattggttagcaaggccttccatacacctcattggttcaacacgctaagttaacacacagttttaagtatcctaggttgcattgatgtagaaggtgagtgctgcgtactgcctgagattttcagagcacaaaaggaactttgaatgcaacatgtatttctttcccagtgctgtttgggatatgaaacaactagagcagaaacagtgaagcatgccagctgaatgctgattactgaactaaaatgtatatgaagagtgtattcacagcaatctcttcatgaaaaaaaatagaaaacccaagtccaacataataaaaggcatatatttgagccccatcctcta

SEQ ID NO: 36155 - DNA, 813 bp, Oryza sativa
aacttcttttccttcgtgcttattattcgcttgatattcgtggggtatccagatggtacctttatactctccaagcattcaaacatactttccttctctgccttgctaagagtgtagctggctggactcaagtaatggcttcctttctcctttggttccaggtgaaggtcgccgcgttgttccatatgcttcagatcattacgtgcttccagtgtatctttcgactttccgtgtacacctaggaagccaagaaggtttacgcaaaggttcttagtgaggtgcatcacgtcgattgcgtggcgtacgtccaagaattcccaatagggtaactcccaaaatatagagttctttttccacatcgccgcgtgaccatcttcgctctctatagactggcttccaggcccctttccgaacactacttttagatctttaaccatagcaaacactgttttcccgttgcgatgtttaggcttcgtacggtggtcagccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgattggtacgaacagcagtgctcgtatgttaaactactcctgtttgtcctcgtggcacacggggacaccttacttcttccacaacatcttaagatctttgaccagtggtcataagtatacatcgatgtcgttacca

SEQ ID NO: 36156 - DNA, 548 bp, Oryza sativa
  unsure (1)..(548): unsure at all n locations
tttccagaacacttctttcctcatccgaagctgactgatgcaagttgtatcactcccattgtacaaatcatctaatcttgttttcctgaccaaatctctatccaccaatggaccatacttccttggatgtcgtctatttcttatacgacgtcgccagcgaataattgccaacacaacagctaaaacacccaaagttctagttcgttgatggacaatatactgatgagtagaatctagatccatctgagcatcacacgacnaaaagggcggngcacgaaaaaaagaaactagtgaaaaaaagcacacattttgacatagttttacttctaataggcatactctctatggatccttgaataacaaagcancnnnanannnnnnnnnnnnnnnaagggaactgccacggtgttctcaccttgctgcagaaaatcgtggcaaagattgtgggggcttggcaatctgacgcgcacagaggaaaggagagagttagaaattttgattcccttcagatctggacaaagtactcttctttttctacttacctgcta

SEQ ID NO: 36157 - DNA, 652 bp, Oryza sativa
ctttttattttaatcgattgaggcattgggcgatagaattgtgttaggtttatttctagctttgccgtactatcaagaggggtaataactttggtaaagaagtgatcaaaatgacacattatgtcatttgcatgatggcttggtttgatagttttatttatctatctttctgtctagggctggtcagatcggagtgtcctggcaagtttgaccgagccaagctcggtctgaccgggcggcggatgagtccattgcacggcctcggcttcgcgatccatagccaccagagccgacatcggtgttaccaggtcgagacgggtctgactggagctgctagcgttctaactatccgagccacggtggtctgaccaacaagtgttcggccacgcattaaatgcaatcaacggctagttttttagccattgcccatttgccctaaggctggtctgaccgaccaccccttggtggtctaaccgacaggtatccgagggttggggttttgggcccaacggcttgttttggtgggtagggatataaacactccctcaccagcaacaagggttctctcttggcgcattattcactcgcatacaccccttgcattcactctcacaccaatagagctctagttcattcattgtggttgtttgaa

SEQ ID NO: 36158 - DNA, 787 bp, Oryza sativa
  unsure (1)..(787): unsure at all n locations
caaccatctccatctagcaaagagctaaacctagatgggttttgacaaataaaccggctagcggagccaatttaagataactacccgtctcgtgggcaaaacggaaggttttcaggacaaacctacaaagagatgtcacactctcgcagcggcggcagacggtttacgacgcaaaccgacaaagatggacaaactaagagaaaactaaaagcaatatgaaaaaacgattcaattgattgattgtagattggatttttacgatgaanaaanccccccccgccatgtcccttatataggggttggtcttgccctctacaggccctcctccacgtccaactcggggtagaaactaaaggaaacccgaaacatgccttcacgagcaaggaaacctcgaaacccgacgaaacacagtcagacttggacctgccggttagaccggccacacaccgcaggtctgaccggccctcaatcggcggtctgaccgcccaacacacggcggtcagactggcccactcaaagaaaaccggtggacttccaaattttggcaacctttcctattttaatcctaggtgccaaatttgggtgtaaacacatgccccctgcctttttgatgaacaacgtgaatctaaaagcatagaacatgttttggtcttagggcgataatctaattaccgggcatagtacctcctaagcgtcttgccacacactcgggaagtatttcttcaagtatttcccattgattgctcgctgaaaacgctcccttgaagtgtctccaaaaaatatgcgt

SEQ ID NO: 36159 - DNA, 442 bp, Oryza sativa
gaatactccgtaggggaagtgctggatcggtatatccgtgcgtttgcggatttcatctatgatcgttaagaaataccaaagcatttctggcaccgttgccggggaacggttgctgatcatttccgaacctagttaatcctcgtatctctgttccattttttttgttctacctttacccctgctacccagagaagtgctcctgtaaaaccctcctcgaccatggagcaacctcttttcgagctatccctttggggccccctaggggcgaattctatgagccacctccttcatcggagcccatttatacaattggctatgaaattcgccccgaactaatcagcatgtttagggaaaatcctttttctggcttcgatctagaaaatccctatcatcatctgtgaaactttgaccaagtctgctcatgccttaagattcgtggcat

SEQ ID NO: 36160 - DNA, 480 bp, Oryza sativa
aaagtagaccagggttactcagctcccgacttggatcttgaactctgaaaattgaaatgaaaaaagtgtacctgtactcccggagacatctttccggtcttgacatgtgacatactcttgacctccttcagataagctttcagtaattcgactggttcaaactgatcagtcagctcaaatgcataagccaaattaattgcatcaatagttctcccattttcaatcaaaactccaatgacacctgatgtccagaaacatgaacatgaggacttaattgtcatgaacaaatgttgctgacttgtaaaaacgaaaagagcatgcaagaggggaaaaggcacaaaagacgaaagacaaaattaaaagaatggagcaaagggtgaggcaacaaatattgcacaaaaaataatgttcagttgcaatgactgttgaaactgtcaaaacaaaagcagatacagcagcagctaaacaataagcaatatg

SEQ ID NO: 36161 - DNA, 635 bp, Oryza sativa
atctaccacgtgcttgcgctcacacaccttgcgtacctcattgaagactatattgttctttgaggacatgtactgccagtctagccacttcatctctaccactagatgagatcttcccatgatcatagagttataccaatcaacctgcaccaaggtcctgaatctgtcatcctgagagtcagctggcagagtatcaggactaaccattctgtcctttccacactggagtagattcttcagatagttcactcttgtgcgtttaggatctggatcaacagcccttgtcttgtacagcctcaaaggattgcttttagaacccggctcatcctcaatgccaccatcatctgactcagatgcaccttgaaaggaagagcggggtgcatcacgaatgacaatgctaccagccctcctggaatggatcggaatctgactcccactgtaaaaaactccaactttttttttgtcccaatctccccctaggaccacgaaccggggggctcgagtcagcaggaacatcttgagaaagcttctgtctcttctcacgaggcataatgaccactgcaacaagaatcaacaaggttggagtgcaatggttaaatgaaacagtagcagaatcaaggttattggctggctgg

SEQ ID NO: 36162 - DNA, 2040 bp, Oryza sativa
tccgagtgaactgcctgttttgcaatctaatgtgttttagctccaatgtatttaaggttgccttgaagcgccccattagacgccagttcaaagcaggatgtggatagtgctagcaaggaatgcccatagaaaagaatatctccctcactattgctcagaatcctatctaatttgcttagaatcgggtttccctgctcattactccaagtgaactacctgttttgcaatctaatgtcttttagctccaatgtttttaaggttgccctgaagcgccccataagacgcctgttcaaattctggttattcttatccctagcctcatatatgatgttgaagtctcccatgaccaaccatggcgtgtctgttggtggcttggctgcgactaattcggcgaggaaattttccttgtcacagtcttctgagggtccataaactactgtgatgatgaagctgagattatcagttatggtcgttgccatcgctgaaagatggtgtgttccttgggagaaattcaccatgttaacaattgtgtcatcctagaagatggcaattcctccacaagttccattggcaggaaggaaattgaagttcgacagcttgcttcccccgatctctttgccgatccattggtctatacaacttaattttgtttcttgcaagcacaggatgcctgctctggccagctcggctgcttcgaggactgcctctcttcgtgctgggttatttagtccgcgaacattccaattgagaattctcagatgttgtaacatttgggcgaagtataacacacaattttttccaaaaggatcgaccccataatgttttccaaatgaattagttcataagcagatagagggctacatattttcttccatgacctacaactacaatccaaacatggccatgtagaagcaatttcattatcttctagcctgtctactctgctactaaccggctgaaggctggtgcctaccgggagcgctattcgcatcaatcgactaaggagctccggcttaaggccgttgcagcatgggagcgctagtcgcatcgaccatacagcgagcagcggcttaaggccgcagagaaatgtaaaggatacatgcagatgatgatggaagaccattcctgcagctctaacactgatgcggacaatcatgacagctgatgacttctctcaggccgcgacagcgcgcgcctcagaccaccatcgttgcggtggttccttcctctcctggcaccggcatgtcgtgcactccatccatgcgtgtgagcgcccgcagaccggcgatgacatgcgacggaggcggtgtgtcaaaggactttgcataagcccctaccgccgcatccccgaccggttcacccggggtgagcagccccatctcctccatgaggcgcacttctgcgcgcttggacaccggcaccgatgagaagcgcgccttatggccgctccaccgcgacggcatctgcatcaccttgcgtccgcaccccttcgtcttggccacgccgggcggcgctagctcgagcggcgcctgcaggatgatcggtggttgcagctgcgagaacagaggagataagatgaccttttcacattcaccttctcctccgtggatgggctgagtctggaccatggcctggtgttgctcctcgcagtcggcctgctgcaccagggtgggctggtctcctatggaagcttgggcctcgtcatcttgagtggactgagtgaggaggtccatcttgggggcctgctgcgcatctgggccgagatggcccatcttcttctggccaactcagctgccgatgccaccttatcctctcccagtatcgctttttccccacccgtcctcttcgtctcgttctctgcctcccgtgggaacttgggagcgatctctgccaggagcggcagcatcgggtcgtggcccccctggtcgtctgagaaggggagcaggggtgaggagcataggatctggatcagagggcaatgatgtaatgttgaaggaaaatttaaatttaagcaccattgtaccctctctttcaaacact

SEQ ID NO: 36163 - DNA, 7110 bp, Oryza sativa
ctgcagcccatgctaatctactaacaatccaaagaccagctcgcctccaaccatctaagatgtatagtaatttgaattagaatcccatgcagtgatattgtacaaatcaaaagcgagtgtgatgtttaagaaaaagaagaaagaaagctgagtgtgttgtaccactgcatgccggtgaggttgaactttgaaggcttgaggcgaactcgtgttctgcgtccaccgaaggttggaataggcgtccctgtcaccgtcgctgtagaggtcctctgacttgctagtcggatcaatatcagatggttccctgcatgatagagagtaacagacgaagatatcctcaattagtgcatttaactctagatggattcagagtaaacaacacatggaagaggtcctaaagcgcgggccagttcaatggagggggaggacttggtgctttgctgctgaggaaaagtcataacagtttggctaagctttgctagctacgtcatcatcagattcaacaatcagccacctcttacttttaggatcagcacagtatccgtcttcggagttcgggctagctgctgctctcttttttttcaccctttgatcagttccattgatctttggaccagtagctggtttccatggggactgctgtcccatactcggagggcgagatacagttgattttcatggaaatttaaggaatgttacattataggcttattttaacaaggaaaattgtaaaaacaatgatgatagaaaaaacttaggagtatgaacaagaagatatgtattgagcaatgatatgtgttcaaaggcttttgttcggtagtaggaatctcaattccgttagagaatattttatgcatcctagccttcaattatccaaagattctttaatttcacgagatccatcttttgtaggttgcaaccttgattttatgaagtgccaagtgacatctaccccaatcaatccttgccctctcatggcagtaaatctagcgatgagtgtgctgactttggacatttctttgtctgaaggacgcttaatgagcgatgtactaactaggggaagtcctattcaagaaaagaattggggtttgagaagtagaaccacttaacatgccaatcctttggaagatttcaatggaagggaaaagtattggtgaaaggaccttaatgtcgcctagagagggggggtggtgaataggcgttcctaaaaaaattatcacacttcatagcatattagaaaaatgagaactttcggttcaaattggaactttcctgtatggtttggaaattccggtctcaaccaaaaaattcagtggataatggaataaagcactagctatgaacttgtaactcgaataaacaaaatatatatgaaccaaaaggtgacaaataaggtacctaagtaagatatacagcttgctagcctgcaccaaaataggcggtggtctcccatatagattttaggcaattttttccttgattcaatttctgatttcagttcattgttccatttttacttgcacgaccctttccaaatgcttagagaatcaaatgatatcaaaatcagattcaaaatgatttttcaaatcattgtttaggttctcactcaattgtgtacttctcattcctaatgtgatgacatccttcatatggcattcaacctaatttttcttcaacatgtatacgctatcaaaccaagtttgcttgctcatctttttcctcaaaatgtcaaagtgatgtattcttcaatgccctcatactcaaacatgcatgtactaaaaagcaatagaacatttgtgtcttcattcttcagttcatgtagatggttgatagcattctacataatttgaaaggtgcataacccatgccatgcttatgtaaacacctcttcaaccgccttttccatagtcaaatcttgatcgatatagaatgttttaggccactttccattatgagctttcagaaaagtctcaaacaatcacttgaaagactcaaatgtttcatcatacatgagtgcagaaccaaaaaccacggtttctctaaagtgattgaaccctacaaacacacaaaaaggcctgctctcgttatttgtttcaaaagtggtgtcaaagctaacaacatcaccaaaatgtggtagtccatgatcattttagcatcagcctagaatatatttgcaatttgctcttcatagtcaattcgcagtgcatattggaatgatgggttctcaacaattttgtcatgaaaatacttaagcacactaccttcttggccatatgccatctcccattggcgcttgctccgtaaatagttcttgttatcgtgaagggtgtagctaagattgagtgttccgccttgtgccgcttttagcccaattcatgcatcatccgtcgtttcaatttaaaaggcattttcctttgtgacaccattaaatatagagtttcaggcaagtgtagtgggtgattgtgttccaataccagatcagactctttgtatatatccttctttccatctactttcagattcatgtagacttgacaattggttcagtttcagctcgagggcattttgttaaatgattccttttatattgtaatcgataaccctcatttgcacaaacaaatctacattatgtgatcttgctatcggattgccttttgttttaatacatttttcttacctcgaagccttcttgcccaccgtagctaagccaaaatgcgcaagtttcatttggatttgtaaattccattccaaccttagataccagattaggaacctatgattgctgaccaaaaaattggaaaaaccatactatgattgttgtttacatatcaccacacatattgctaaagacacaatcataacattgttttacacaaacctatgtccttccatcgcatgactattagacttgctttagtggcaagtctcagattgacaagcgacagtttcttccatgagaaaagggaaagctcgatcaagctgaaagaaacatgacgatgtatgtttgattgatttagtgagccatttatgagaaagaaggtggtcgagagacagattgttgagatttacctagaggattgaaggacggagaagctcaccccatcagtgattgcctcctcagctcctcgcaccaaaactctcgtccatggtgcctcttctcgtgcctttttcttattcttgtgcctctactcgctatgcttatgggccaaaccaagcagctgggcgcctgagctaaatcaatcagctaggccaaacaagatgtatgggaaggagctgctgttggatatgaatcaagttgaaggattcaatgttatctgtgcaatttggccacttttacaacatgtccaatttaaatgattaataaagcatatcagtaaaaaccaagagcgcatcagcgccacatgctaggccagcaacacatcgtaagtataaacggcacgatagggcgcgctataacgacatgttggctatcgagagtcgatgatcgatggttgggctgcgtgagagaatggacgctatggagaataacgtccacgctagagttgggctgcgtccatactactttcatagcatctagattggatgctatgatgcagttggagggatccggctcctctgactttgagtgaaaacgtcagaggcacacagtgttttggggcttacgctacagtacaaaacagttcctctactgtagtcactgtagcaacggcagaaaacaataaaaaatattgtttatatatcatattgtagcgatcgatcttgtccgttcactgcagttcagaccgttaaaaataccacaattagaggactgtgcgcctctgacgttttttcccaacgtcagatgatctcattcccagttggatatagtgtccatagtattttcatcagtcacctcacctatccgatttattactacttatttaattcaaatgaaaatgattagaaaaattaaagagtaaatttcacaaaactacacattttgtggtctaatttgcagaaaactacacactttgacacttggtacttaagtatatatattttggtagtgtagtttcaccaaaccacactatcaatgaatgtattcacccgtgagatggcgtggttgtttcaactaggacgaggacatggcatcctattaccagccatcgcacgaaattaataggatgcaacgtcctcatcctagatggaacaactatgtcatctcacgggtgaatccattcatcaataatgtggttttgtgaaactaaactaccaaaatatatgtacttaagtgctgagtatcaaaatgtgtagaactactattaggagcgcagcgcgccaaacatgcaccagcccaggccccccccacctcacgtcccgtcatcccactcttaccattgtcggaataaacgatttactcctatcgcgcgcctcaaccacccacctttattcgagtaaacaatttacttcgataataaaaacaactccactgcttccgatcccaccccacgtctcgcatcgtgcacccaccattatcagagtaaataatttacttcgataaaaacaacttctctactggcggtatatattctatttttctcgtacccaaccaactactctcgcccccactctgttttttcctttttttttcggatctgaatcgatccaccatcccagcccacagatcagcgacacaccatggaggaggacgacgacaccgtggcggttgatggtggtggccggcgagcggtggccggcggcggttgaggcgaaggcactatttcgagcctcgctgccggacgctaggcaacaccttaaccagcaaggaggtgttcacctgggctaatagcaacaaccaacgactgctccacgtcgacgacattgatagaacaagcaagtaaggaaataacactctgatttgcatctgcatactttccttcaacttcacacatgaagccctaattttttttgcaaatcaaattaacatgcaatctccaatattacctgatctcaattgatgggctgcacaggttctacatttgcacatcgtgctccatgtggctggccgcagaggatagggtggagtccactggtgatggagattgtttgctatttttcttttgctcatcatctgtattacatgaacgagaatgtttttgcattttttttgtgcttgctagatgatggatagctgctattgcgcaacgtcgagctcatctctataccacaccgctacatccttccatgattccataatggattttcggctgaatcatttattttcttttctagtttgattcacctgtgagtaattttatagtttgtgtgtgattgagcctgtaactttttcattcatacgactattttgtgatacagatcaataatactcttagtactagtttttacatattactacacggtggctacaagatcatggctatatcgagaggaaggtggtaattgttttactcgcataccacaaaatctcagtttttactcttatactgtgtattgaacacatcagtaaacatattactacacggtggctattacatcatgggctatatcgagagaaaggtagtaattattttactcatagaccacaaaatttaaataatattggtaaaacaattactagcgttgtaagctagtagtaattcttttacgaccatctaagtatggcgttatacgatgtggaggcattcatgcgagtaaatttattactttagaatgaggcattcatgcgaataaatttgttactctagaatgagcagatgtgggaggctaggagtaaatcaaaaactccacggagtaaattcgttatttttgagacgtgaccgggcccattaatgaagcatgataagatggaaaagagaaaaaaaagaaacacacaagatgggtggtaaaaaacgaaaaaaatcaaacgagaaaaggtgcgatgcggaggaaatgtggggtggtaaaaaagaaaaaccgggaggagaaggcggtgtgcggcgctcgaattattattccgcgctgtagcacgtggaatagcactaccgtcaaaatatgtgttgttttatacaacttaaatcacaaaacaatgtatttttatgaaatttactcaaaattaaaacaatcggcatatcccctcccccgttccccacactctcctcacagtcaccaatgccgaagcccaaccatcgtgcccgctccgccgctgccggcggcggcgggggcggcgggggcccgatagacgcggattggaagtacttcctcgacaatgtccgcgaggaaggccactcctacgccgtccgcgtccctgccgacggcgccaacccttcctactacctccaatacgagaagcccctcaccaacggcgccgcctccacctcctcccggggcggggctgcacgcaagcgctgccggatggaggaggaggaggaggaggagagctcgtccggcgaacccgaacccgcacccgaccccgacattgaagaggactaccgcgtgttccttcagaacgtgcgcctcgttgggcatggcggcttcgtgctggagcatgagggcaatgtgatcaggtacgatgcttcgggcgcggcgctcagctcggatgagtcttccgatgagtccgtgatgggtgctccggagcccgatccgcgtcgacgaaaggtttgccagctcgttctactttccatcttcttgtttactgttgttgtgcgcgtctctgacatacatgtttgcttgctcttaggcgaaaattgtggaggaggatcaggaggaggaggaggatgtgaagaatgaggttgccgttccgtctagaaagaaagattttaccatggtaaaagaggatcaggagaagaaggggaagagagtggtcgaccttcctgctaggggggaagatggtgccatggtggcggaagaggatcggaagaagaagctcagaaaagagttcaactttcattcctttcattctaaggggaaagatgatacaacaccagtgaaaaatctgaaggataagaagaaagaggttaaaaatccaaaggataagaaggttcatgggaagaaagaggttgccctttctgctaaggggaaagattgtcaattagcagagggtgggtaggttctcatggcccaatgttggttatt

SEQ ID NO: 36164 - DNA, 373 bp, Oryza sativa
tcgcctcggtatctctcttgctcctcatccgactcctgtacgtgtggatgtcctccttgaacccaatcttccaaggaatcacccctttccctcgtgttcgcctggatgctctggagtctgcagggcgagtgacagctcgtccctctctctatccggacggaacgtgccctgagaagaggcttccactgcgtctgttagtcaacgcgcagcctctcgtatctgatcgccgaagaccagtgagccatcagctgggtggagcgttccaccgtgagcacagtaccagaacttcgatcgttccggccaattagcggtggccggttcgatacccctctcaagcaagctagcctccatctcctcccacttcggcatcgcg

SEQ ID NO: 36165 - DNA, 1047 bp, Oryza sativa
tcactatatatgtagatcatccagagccactggagccaccagctgggcctgcaccaccaccgcctcagccacttaagctgactaagaaggagcagaagaaactcagaacacaaaggcgccttgctaaagagaaagacaggcaagaaatgatcaggcaaggcctcttggagccaccaaagcccaaggtcaagatgagcaatcttatgaaagtactaggagctgaagctacacaggatccaacacgtatggagttggaaatacggactgctgctgcagagcgtgagcaggctcatgtagatcgcaacattgctcgcaagctcactccatcagagcgccgtgaaaagaaagagaggaagctttttgaagatcctaacacattggagactatagtttgtgtgtacagaatcagagacctgtcacatccgcagacacgttttaaggtggatgtaaatgcacaagagaaccgtcttactggtgctgcagtcattgcggatgggatcagtgttgttgtcgttgaaggagggaagaagtcaatcaaaaggtacaataagctgatgctgaaccgtattgactgggctgctgcggttgatgatgatgatgatgctgatgaggaatcagacaagcctgtgaatagctgtgcattggtctggcaggggagtgtggcaaaaccctgctttaccaggttcagtgtacacaattgccgtagtgaggctgctgccaagaaggtgtttgcagatgcttcagttccacactactgggacctggctgtcaatttctcagaagattcatcttgagctgagcttctgttcagaacatggaggcgcctgctgttgaaacccctgcctagggattacgatgttcaattctcatgcagtaagtgatgagtagtagctaatttctcaccgtgggtaagtgtcctcttcaagttacgtacaagccttattacttgctctggaagcatttgtggactgagtaatacttcgtactgtcatgaacatacccttgtaagggactgctgatcttttcgatgcgggatttactcatgtg

SEQ ID NO: 36166 - DNA, 1104 bp, Oryza sativa
aaaactatgaattactcccctcaactatcgtggttgaccgaattaccacccccccaaacccacaaaaccggacatttgatacccctaaagtattgaaaccggataaattaccccccttggctcaatctggagcgattttgatcctatgtggcgccaatttggcaatccaatcataaaaaaagtaataaaaaactatgggcccacttgtcaattactcctacctcatccctctctctttgctgttggtgggcggggcggggatcggaggacaggaggcgactgcggacgtgacgtacgagtgacgggtgtcggtggccgcgtccacggcggcgatgcacgagatggagctgtgcaggaggcgaatagcagcgaggagggccggcaccgccgctcctccctttcccctctccttctcttccgactcactccccagtgcggtggcggtggtggtccgggcggagaaggcggtgatctggatgaagaaagaaggtcgcggaggggttgggcgagcggcgggccccggggagggcatcctcgctggagcgtaagttctctatcacgcgtggcaccagctccgctttcactaccgaccacccgatccggcgccggccgcacaggcgagctaagcctcagccgctcgccacccgggcgatctgtgcgtccgccgccaacctccagaacgagctctgcatcaatcgctcgttgaccgggcgtgctccgcctccaccgccggccacccggtccgcctcctctgccggacaggcgagctccgcctcagccgctcgctacccgggcatgctccgcctctgccgccggtcacctgttccgtctcctcttccgtgcgggcaatcaccgcctccggtcggctgcacgagtgacctccgcctctagccgcccccgtgtgggcaatctccgtctctgtggctagtcacctgagagagctccgcctcagttgccccccgcacgggcatgctccgcctccgtcaccagccatccggtccgcctcctccttcatgggctctgtagctgactgttcgagcgcgtgtgcaacagagagacccactagggaaggactcgattgaggcaggggtatgacaggtggaa

SEQ ID NO: 36167 - DNA, 441 bp, Oryza sativa
aggaggtggtggggaaccgatttcatgcggttcaggcgcgagggcgcaggcgggaggacccggaattggcggcgacgtgggcggcaacgaccgtccatggcggcttctgcctgggaagccgaaggtagaggaagagcctgacaggtggggtcgccgggcccacctgtcggggagggagagagggaggagaagccgggggttatttagactttgcgcgaggggaaggggaaacgggccgacggcccaagagaggagaggggaggccggtgaggaagggagagaggcgcgcgggccgtgggagagaaagggggattgggccgggagtggcccaaaagggagagaggaggtttttaatttgtttttcattttatttaattggttaaatgaactttgtactattcaaattatttctcgagctccgaaaattcgcgggaaatttca

SEQ ID NO: 36168 - DNA, 934 bp, Oryza sativa
cccccaccattttttattaatttgtgcgaaactgatgcccatacctaatttagtaccattctggaacttccttcgctataaaaagtatattggtagcaaactaaacataaatcctatcttactgtaaagttatcccttactaactccttaagcttgacatgtaaagatgccacatcattatccactaacaagatgccacatcatcatccactaacaatcatcacatttaaacatcatgtaaacatgctatatctttatagtttttataatttaaaagctttttaaatataaacatgttaaattatcattcaacataattcacataatgttttaatgtatatctttattatgttttaagatatcctatatacttatatagttcatcctcacttagttagtacttaaatgattaatctatggttcaaattatatttctcctttttgctctaattaagtcatatcacatcaattatttttggaaaaagtacgaattacccccccgaactatcacggtcgtccgaattacccccctgaacccgaaaaccggacattcttcacccccaactatgcaaaccggacgaattacccccctcgacccaatctgcggttgttttagtctacgtggcgtacacgtgtcagtccagtcagcattctatttattaaaaaattatgggaccacttgtcatactctcatccactcttcctctccctctctcactctctctctctctcttctctctctcactcttcctctctctctcacaaacggcaggccgcaggcgggggacagagcatcggcggcggcggccgcgacggcaagtgggggacagagcggcggcggcggcgcgtcgccaacgcggtacgtgatgaccaacttcggcaacttccagctcctggcctgggacaagagctcgttggagtggatcaccttcag

SEQ ID NO: 36169 - DNA, 8708 bp, Oryza sativa
ttaaaaatagcatacttatttttacctgaaatgtcgttcctcaccgaagtcctttgttgagccttcaaagcaacaggtactccgtctcttgcaattcttgagctttgtcttgtagccaccactttctctttctgcttccttttcttcttcttccccgatgagataaagccatcactagtcagctcttgccccttcacttctccagtgatcatctctagaactctgatatcatcctccatccgatccttagtgaaatctcattttcctcctcggcagccttgttttcttgttgtataacaggagtgaccccccctatattgttaccatcttctcctaattcttctaaaacatttgctccacttactcattaattccctggacctccttcccttgtgagcataaaaccacttcttctgcctcatctgaaatatctgggatatactcaggtatatccactttctccccttcccccaaagagtcttcctcttcttccaccatctcattgttcttgtgtctcttgtgcccatgatctccttcccttttttgggtgtccttcttctcttcttcttctttttttgattcccctttgtcagcctcatggctgtcctgagagtcttcctcatcatctcctctcctccctcttgatctgtatgcaggtttgggatcatcaggatcatcttggtgatgttgtcttactccttcaggattccaagtaatcctatacccaactctgtttagaaagatctcagacgtcccccctatcttcaaaggatccctgcaaaggacttttactctcacagcttctctgttcaagctaattgagtctacctccatgggatctccaatcaagtgggcaattttttcaataactttttcagatctagccaatggtgggactcctgtagctctgacccaaacctcctgaagctcggcaaaggcctcaatggttctctcagtctccctaacattagctctagcattggataattcaaagtcaaagcccttgagtcttgttaactccctcctagcatctttggatggaaattccaccaaatatttcttctgctccacctgtttaaccttccaatcccactgcttatgtttctcatacaggtatttcatctccataacaatcttcgagatcgaagtcagcccactttcgatggttagaattcctgtaactggacgcttctccacctcatcttcctggacgacaatatgcaaacaatgaaaaacttgaccagggtactgcggctgattttagcttatcaagttgaagcacaaaacaccaatatcatgcacgcatatattctctagtagaacttccgagcccttttccgagccgtttaggaagtaatcagatatagaaaaattaaactgaatagttattttgtactaccattagacagtatagatcaacacagtcatggattttggggaaacagatatttgagtcagaagattttaactatttgagtcatggattttaactatccatagtgcttctagcgctgcaattcaagttcacagtgtaaatcgaggatctaaatcaattaaacagcaaaagcaacctgaagaaaggagctagctactgctgaagcagcaatagaagttgagcactagaagatgttgaaaggctctgaaactcacatggttaaagcagcaaccggccaagaaggatgggccaaacatgtgtgtggatcacgtagcttgtaaatctgccgatcctcccgcttcaccgtgatgaccaaatcggtgtcagcagaatcatccgcctccacctccgcctccgcctgagagtaagtgcgatgaacaatacgtgctactatgtcctgcttggccggggaagcagtggatcgaaagtcgaaggaggagaagctgcccttccccatggtgcagagaaggtgccccggaacaatgcgcttggattccacctgcaactcaacgatggacagctccttcttgcctgtgcctgaacctgcaattcctggagggaagaccatgacctccatgtagtacactgaagccgcgccgccctttgccatggagcaggaaacgaagcggtggtcgccaagaggcacggcctgaccggtgaaaggcaggttcgtgtcgagcaccatctcccactgctcggcgttcatgtcgaaggcgcaggtgcccttgtcctggccctgctgctgcaccgacaccgagagcaggatgtgggagccgacgatggcgtaggccgcgacgcgcaccgccggcggatcgcggtactccagcgggttgagacggcacgggaagatgggcggcggcggcagctcgcgccatccgaagtagccgaggctgtcgaggacgaggaaccatggctcgaagtcccgcccgttcacgacggaggggcagcaggagacggcgtagagcttgccgccgtgcgagacgaggacggggttcaccttagggaacacgagccggcagccggcgcgcaccgtggaggtcttggggtcgtacacggtggtctgatccagcccgatgcccacgatccgcgtccccaccgccgcgaacgacatgccgcggccgctggtggagtggagcaaaaggcggacggtggcgccggcggcgacctcgattaccgagtgggtgggctcctcctccactccgtgcgccaacaccatgtacaccgctggctcctttgcggcagaaccctcggctggggcctccttccccttccccttcctcttcttgttccccgagcgaacgcggacaagccgagctaccggtgccggtgctggcgccggcgccgctgccgcaattttcttcctcttcttgtccggcatcatcatcttccctcgattggaatcagattcgcctcccttctcgaaaacgagtgggtaaacgaggttagctacgatcaaacaaattattattattaggtggaaagttcattgaggtgtcttaacttgtgaagggattcgattttcatccttcaaccagaaaactttaacttgtgaacggattcgattcatcattcaactagaaaactaatacaacgggtccctaaactgtcaaaaccaatagatcccatggcggtttggacgattgttttgggtgtcgtggcgcctacgtagatattttgactcggtcttcatctgatgtggtatatgaagcaaaatttcatatttttaaataaaacaaaatatatgggcccacatgtatgtggccccacttcctccacctcatcccctctcttctctatctcctgcccttctccttctccttctctatcgcagcctggtcaggcagggaggaaagggcggctccggcggctgtgggcggaggaggagggggtggcaagaggtggccctagctacggcggccggaggaaaggagctagtgtcgatggcggcgttcgacctcagcgagctcgagagggtaggagcggccgagagccaccgttgcattcctcaccccgccggtcatccgtcacgtttgccacgccggtccttgtgggtcggggcaaggggtggtgcaagcgcgggcgaggatgcgtcggtgagtgcggggagcgaggacgaggagtatgggggcggcaccaagggcgcggaggatggcgaggaggggcttgggctaggggaggcgggcctggtggaggaaggaggacgaggaggaggaggccggcgactgtcggggttctttagaaaatcgacgacctcttgcagctcgagtttggcctggtcggcgccgaggacgtcgacgaaggttacacaattctcgggcacctgctcgaacttgctcttggagcggtcgaagtccaagcgccaaccgaggctaccagggctggtgtcaggatcaccctgggcgcggcggaagatgaagaagaggctagcgaaggcaaggaaggggaagaggaggttgcctacgaaggcgaggaattcgcccaggccggcggcgtcaccctcgacgacggagatgtcgacgtcgttggtggcgaggatgtcaatgaggtcaggggcgttggggatgacaacgatggtgtaacgaccgtcgatggcagtaagctacagtactcaggtggtgtcgatgtcgacgtcgatggcagtgtccattatccacacgcgcctttgcacgctgccgcaactgggcccacaacagcctcgcgcgcgtgatttttcactgccgcatgtccgattaagactgcatcgccctctccctcgatttaaaaattgaagatgtttttgtaaaaactatggtatgtcatcagtatccgattcatgtcacgcgtaacattcattacaaagtcacgactcacgagcaaactatgaaagagagtctgtgtgatatggataccaagcgaatgaaactcgcagagtccgtgtggatatcacgtacatcattgcccagatcatccgattctgttcgtactacacgccatgattcctggaacatgttagcataatttcaagtcttttaagtcagtctccacgcatgcttgtacgtactagtagggatactgttacaataatccataaagcataatttcaagtcagtctccacgcatgctcgtacgtactagtagggttacttttacaataatccataaagaatcagtttactttcgaaaagaatatgccaaccaaaataaaggatgatcgaagttaatgattttgtccgtcatccattcctgcccgacttgagataaagctggacgacaaatcgagctcgttttttaagccctcattatttggcttatgcttattcctataagtcaaattttaaattttagaatttaattttgaatttgactttttggttatttatcgtactttattttacagcattttcttttgagtcgctgagaacgtgtatataaaagatttgcacacaaataatcatttatttggcaataatcgatatgtataagcacatgaataaacgaatcaatggcctgtgattatttatccacagacacatatgcacaaattaaattggctctacccattgcaatgcacgggcatcttttctagtgaggtatgacaaaagaaggataccaaattaattcttacggaaaatacaaaagaaaatctataatgtattttcaaataatatgttataataattaagcatgttttagagatacaaagcaattttagattctcaataattcttaagataacaatagatctagtaaaaatatgttctcaaaaacaaaacataggaagcattgttccttaaaatgaagatgtagtagtcaaacattcaaaaaatttatcttctgccggattttatttacacagaaagagctccaaccaattttaaacgattgtattactgtgaatacatgctaataagatgcagcacatacatgatatcaaataaaaaaaaatcctcatctcttggttctgcatgctgcagctatctcaacaggaagcactagcttctgtagttctgtgggtcacaagaataaatcatgattcccaataggctggcgaacaaaaaagaggaccagcaatcttgttttagtcttaatacatctctcatcttgtttgttcttccttctgctgagccatcccaactcccagtcccactgcacccacgagctacaaaaccaggacaaagaaaaggatatcagtaaactctcaagtgagaaaccaaccaccaaaaacaacagtcaatggaagatatagaaaacaaacaaaattgtattttctcataacaaacgtggtacaacattcgctacctaatggtaagaagtaacgcatctagtgtgttaaatcaacaaatcactactgtatgatcatacccaggtgtagggccacctatatctgtccgcaccccaaccgctgccaccacactgcactgtagctgcctctaccactgccgtgtacgctagcacacttggggcttattcggtttggaggaatttgacccataggaataggaaaaatgaagtattatgaatgtttgcacatatcaatccatagaaattttctaagaggtttgagtggatgaaaaaattcatatgttttctctatagaacttatagtaagggaaattttcctttggttttcctatacttcaatcctagaaaccaaatgacactcatagaaattaatccttagaaatccaattcctttgtttttcctccaaaacaaacaaactgatcttaccaaaaacggcccggccttctaccgcagcaactacctccgctacaccactgcagctcgctcctttccagttgcttgaggaagaaagaaagaagggttagcggtcgccgtcatcacagccgcagtttccaccccagcggtctgcttagatgatggtgagggagggagatggaagaaggttgcggcgccggcaaaatgagtcatcaccggtggggcagttattttttagagttgtgattgtaaatttgtctaaaatacatgttttgatttttagataatgggcaacactcggcctctgtattcttagatgaatgcacacggccaaaatacaagttctgatagtcttggtttcttggtaagtctatattcaaaagaacacaaacgtacatccggtcatgagaacgaaccttctcaatatcctctatgggacaatggcccttttcttcttatccttgttcttcttctgcccttccaccatttttgcctaggtgcaatagatgtgttaagaggcgcgcgtggcaacactaaacaaagcgtggagacttggacacaagctagctagtaccttctgccgatgcacactgccgttgagctggttggggtcaggaacacccttcaccggaggagcccctctacctgcgccatgatcagccacggcttctcctccatacctcaccaccaccccctcgtactccaccacgaagtcgtcgttctcgtagacacgcacgttctccaggaacagcctgtactcctcttcgatgtcagcgttggcgtcgtacacggcgggcaccgtggacgaggcctccttctcctcttcccccacctgcgccttcttcttcttgcatcctgctgccccgccgccccaggaggaggaggcggaggcgctccgcggtcgacggcggatgccgcggcgtcccttgacgctggtcctccccgcggagcctatctcgccggcggcttcgggaacctggtggttcggcttcggcatcgctggggatagtggggaattcgttcgatcgagaaccaaggtgaaaacgaagcgggttgtgtttggcggtgcggggcgaagagaggcgacgaaattttgggtgatgcgcctgtgaccgtgcgagatggccctagctagctgtcggaaaactgggccaccgtaagttgggccgagatgagcattatcttttttgggcggaataagttcatctgaggtcccttaacttgtcaacgaatccgattttcgtcctccaaccggaaaactagatacaacggatccctcaactatcaaaaccggtgcagattaggtccctcgacggttttaagggtggttttggctgacgtggtgcttacgtggctaatttgactcggtctttatctgacgtggcaatgacatggcgcttacgtggcaattcgatcttaaaaaaataataaaccccgtgggacccacatgtcagtttcacacaaattaataaaaaatggtggggcccacgtggccccacatgtcattctcacccctattcttcttcctcctctcttcatctctctctcctctctccagacacgatcgagagttagcggtgcgcggcggccggcgggagaggagggagcggcgcgcagccgcggaggcacatctcccgcagctgtgggcggaagaggaaggggcggcgggaggtggcgggaagcggcgggaggcggctttgtcctaactcctgaagaactaagcagcagcaaaggacacgacgtgtcagagatccatgcgagcgaggaggagaggagagggaggggagaaggtgtgcgtgcttacgtcactgtcgagggctacggcggcggtggcgcggtgccccggtggcccggtcggacggctcgatggcaagcagcgtgtcgaggaggtcgagcgccggcggcgagaagtccctgaacgtctcggcgatcttccgccggtacggccactgcggcttgaacagcgtcacgtccggcagcttcgccttcacccaatactatttcgacggcgacctgcacagcttgaagatcttgtgcagctgctcgatctgtgtcgatcagcaatggcaaatcagatgccgatccatttcatccacgcatagatgatatcatgacatatagatggagagttgaggttataatatttatttatttaccttggtttggctgggcaagaatgcaagatgggcttgccggcgagaagctcggcgaggatgcaggcatgcagccggtgctgcagaggtcgacggcgacgccgtactcggtggcgccgaggaggagctccggtgggcggtaccagagcgtgacgacgcggctggtgagcggctgcggccttgcggcgtcgaagaaggtggcgaggccgaagtcggcgatcttgagcatgcccgtcgccgtcggtgagcaggttggcgcccttgatgtcccgatgcagcacgtcccgttcatggcagctgcggagcccgacgaggatctgcgccatgaagcacttgacctgcggctccgtgaagtgcagcaccggcgtggcggcgaggtcgtggtccatgtactcgaagacgaggtagaagggtgagattgaca

SEQ ID NO: 36170 - DNA, 3850 bp, Oryza sativa
gccgccgccacgtgcaagtgcctcgacggcttcgagccagcgagcggcggggagtggagcgccggcaggttctcgggggtttgccggcggaaggaggcgccgccccggcgccgacggggatggtttcttggtgctgctgcggatgaaggtgccggacaagttctcgacgctcgccgggaacatgacgttcgacgagtgcgcggcgaggtgcgccatgaactgctcgtgcgaggcgtacgcccaccgcccacgccgacctgagcagcagcagtgcccggggggatttcacaagcatatgcaggttgtttcatttgctgttggtttaaaaatgacctgaaaactgtcaaagagaccaaaaaaaaaaatcaaaccagtttcgtattgcatttgttcataatacattgccatgcggagtgcgagcgccgcggcaaggaggatgcgaacggaggaggcgggtcacgcagagtgcaagcgcggcggcgaggaggatgcgaacggaggaggcagcggcgaggaggtgagcgcggcggcgaaggaggcgagcggaggaggcgagcgcggcctcgcagggcgggcgggggaggacggcgcgcgggggcggttggtgggcggcggtgcgagacgaggaggccgacgacgcggtcgagctcgtcgatggtcgtggcgacgacgatgttcccctccactccgcccccctctctctctgccctgagctcaccggtgtccgtgccgacgacgatgttcccctccactccgccctctctctctctgccctgagctcgccggtgccgcatccatctgcttccacctccgcgcccgtcgctggtacgtcgccacccccgccgacccgcacgagggggctgggaggccggcaagctcgcgccgccctgagcccgcgcgccccgggagccgccgttcttgggtcgcccctgcgccgcccagtgaggtagtgactccgtgagagagaaagtgagtgaagagagagaagtgactttgagagagagagagagtgagtgaagagagagaaagagaggaagaggggaaggggaggtatgacacatgggtcccactatttttttaaaaaaaaattgctgactggattgccacgtgtacgccacgtaggacaaaaccgctctgaattgggtcgaggggggtaattcgtccggtattgaaagttcagggtgagtaatgtccggttttagggttcaggggggtaattcggacgaccgtgatagttcaggggggcaattcgtactttttccattatttttagcctttagatgattaatctacagttcaaactatctccctacttttcttcttccataaagtcataccagcattttttttacgtttgaatcacaattctacatactatttaaatttaaattatcataaaccacattaatttacttaatctgatgttatctatctatcttacacgttattttttattgttatcatactaaattcccgcagcaatgcgcggggttttacctagttatataaagtttactctactaaagaattagtagtgccaaaatttacttacagtttagtactaccattgaattgatagagtagagaatcaaatagatcctaaatttgtgtacatgcatgtgccatggctctgaacaattcaatccgtctaatgcagggtttgcttcgttcatcggaaaggagcaggcggtggccaagtacagcagctcactgaagagcgtcatgtgcataaccagccaccggccattcctgtctgcgtgctgtccactgcttccgtgcgagcacagacgacaggttggggcatggccacacggggcactactccaccggctggaggctggagctgcctcccccgccgtccgctgctacagccagctcggctcattaaggctcggctcgtttgagctcgttgtcttaacgaaccagcttggttcggctcgttaatgttaacgagctaaaagactagctcggctcggctcgcgagcaggcttgttaacgagctatatcttattaatatcatattaataatttcaaatttaaaattttattatgtataaacatagtaatcaacactaactaatatagtactcactaaatatgaatagttttgatgtaattaaaagactaagcactagtcaataaacactaagttcatgaagatatggcgatattttatactaacgagctaagcgagcagcttgcgagctagctcattaagctcacgagctaaaaggctacctcgtctcgactcattaagactacgagttcgaatcgatccgagctgagcttgctacgagccgatccgagccacgagtttcgagctttttgtccacccctagctacaagtcatgccccaactcgcctccgtctctagcccattcctacaagtccaattaattgttcaaatgtgaacttttggataatgcaataaaatcccggcatttgctcaaagagctacagccaattattataccaattcaaacaaaaaaaagcataacaaaaaggtcgtaaaactaaaatgatagaaacacatgcaaagtactaaaaaccaacacaagaaattaccaaaaaaaattgaattctatttgtgtatctccacctgaagttggtaaaaaattgcataaccgttaactcaacattacgacatgcagctttaattaacttgatatcttcttcacacttttacagttatgcccaggaccagagccagtgtattgacctaaaaagaacctgcatataagatatagatggtgatttgtcaaaaaccatatcatttctattcaaccatagagcccaacatatagcagaagctcctagcaaaataagtttattagattttttatcaatccccataagccaattcccaaaggtatgagatatactatgtggaatatttaaaccagaagaaaactgtaattctctctaaagaaattttgcataatgacagtccataaataaatgatggatagtctcatttttcatgcaaaacaaacatttcaaactagcatgccaattcttcctagtcaagttatcctttgttcagacaaaccctttaccacataaaaatcttacttaaaaggcattttgagtttacaagtaaacttattcctttcaacgtaaccattattaagtacatagaatgaaccgagaagattccatctaaaaatatcattctactctgtcaaatgaagatgcacaattgaagcatacaaattatgcgaattagtcaggttctgcgctactaaagctctcctaaaagaaacattgaaagaaacggaatgcataacatttgcaaccaagaagtttctccttctttctatagcatataaagatgggtacctatctttaaaggaatagttaccaacccatttatcctcccaaaatataacttgttcaccattattcacaatccagaaacccatatttaggaacgtattcttaactttcataaaacccgcccaaaaatgggaattcccttgtttcctattaacctgggttagagatttattattaaaatatttcctttttaacagatcttgccaaacactttgctcattaattaacttaaatagccacttactcaaaagacattgattttgaatttgtaaattaggaactccaagaccaccttgatttttggacaaatcatatcccatcttgtaagtctatacttcttcttctgttcatcaccgcttgccaaaaaaaaaggtgatatataataatcattttttttagaacctcttttgaaatctaaaataagatatcataaacattgtcaaacttgagagcacaacattaatcaaaactaatctccccctacagatatatgttcagatgtgaatagcaagct

SEQ ID NO: 36171 - DNA, 3099 bp, Oryza sativa
  unsure (1)..(3099): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggtcatatattttgtgaccgcggatttctactagacctacttgcacttgtcccgccggacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctggtgttggggagggcgggtttgcgccgagcgttgacatggtttaactttcgcgaaaaagattataaatttcctaccattagactaaatagcattagagccaatgtaatacggggtaaactatgaaagatatggcctcagttttgctgagaaatatgcatcaattacaatcatttgcatgaagggataaaaagaggaaatcataacatcaaaagagcaagtgcagaaaatctgttcttatgcataaaaaaagaacaagtgtagaggtatataaccactgaatcaatcatgcaaatttaaaaaacagcagcagcaagggtacaaaatttgcatgattgacataaaacagcagcaggaggagtatatatgccacaggggtagcaatagcaggggcaaattaactaaaacaacatgtctagatatactcctcttatcaatccagaagaaaagagcaagtgcagaaaatctgttcttatgcataaaaacagagcaagtgcacaaaatctgttcttatgcataaaaaaagaacaagtgtagaggtatataaccactctacactggccatttaataaggaacaagtgaacaagtgtaggggcaaaaaaatgaacaagtgtagataatctgttcttattgagcaattcatcactggctatttaataaggaacacattgggcagcagcagcaagggtatataaatcatcaaagaatgacagaaaacaaaatgcatggagaactttggtgtctaggtcggttccgtccatggactacactgacctatcctttttcggctaaatgtaaacatgatccacaaaattcaataggtctagcaacatatatagcagtacacactccatgaatggttatatgtccaaatggcacttaaatccacattcaagttgcacttaactaacagttgcaaccataggcagcagcatgggcaaacatagacagcaagggcaaacatagacagcagcagttgcacttaaatccacattcaagattcactgcaccaaaatcatgtaatacgaggtatactatgaaagatatggcctcagttttgctcagaaatatgcatcaattatattcatttgcatgaagggataaaaagaggaaatcataacatcaaaagagcaagtgcagaaaatctgttcttatgcataaaaaaagaacaagtgtagatactctattcttatccataaagaacaagagtagaggtatataaccactgagtcaatcatgcaaatttaaaaaacagcccacaataagggtacagataaactgttcttattgagcaattcattacttattgagccacaacaggggcaaaaagaagaatagataaaaaaatgaacaagtgtagataatctgttcttattgagcaattcatcactggccatttaacaaggaacacattgggtagcagaagcaggggcaaagatactccacaggggcagcaacaacataaaacaaggaacaggtgtattaacaagtagcccacaataacagcagtagcaggggtgtagataaaaaaggagacagtactactaacttcatgtaaacagcaattcatccattcaattcaagcaagtgtaaataataaaacagcccacaatcatttatgtggcagcagcagcaagggtatataaatcatgtatataaacaacaattcatgcaattgacctattcatagacaaaaagggtatataaatcaacaagtttagataatctgcaaagttccttaatcatcaaataatgacagaaaacaaaatgcatggagaattttggtgtctaggtcggttccgtccatggactacactggcctatccaccaaaattccccatgcattttgtattttgtgatggtttgataacccctaactagctagcttaataaactatttctagctagctaccctacctacctagaaacactattgccaatctatcaatccatcctttttcagctaaatgtaaacatgatctacaaaattttaactggctacacattcaagttttaactaacagttgcaaccataggcagcagcatgggcaaacatagacagcaaggggcaagtgtagataataaaacagcccacaataatttatgtggcagcagcagcaggggtatataaatcatgtatataaacaacaattcaattattcatagacaacacgggtatataaatcaataagtgtagataatctattcttatccataaagaaaagaacatccactgctgcaaaattcatgctaagatcctctattgatgctaagattcactgcaccaaaatcatgtatataaaatctagcctctacattcatccaaaacatccacagacaacaaatcacatttaattcatctatacagcagcaccaacaatcgaaacaacaaatcacatttcattcatctaaacaatgcaattcatccatcgaaaaaagggctgcagga

SEQ ID NO: 36172 - DNA, 11599 bp, Oryza sativa
gccctacagatagagcccgtcacaggtgagtttgcctagagcaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcttcctcctcttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatcattgtacgcgttgttagccaagttgacagtggtgaaaccttcattgtcaacttttacattgcgaagatcgacccatcgacaacgaaacaacgggactttgaacttcaagtaatctagctccaatatttgctcaactttaccatagtattgatcacgacgaccaccgtcactagcagcctcgatgcgtaacccactgttctgcactgtgcatttgctgtcttgctttaccgtgtgaaagatgtatccatttatgtcatatccttgccaggtggtggcactccattcaggaccctgtgacaaccactaaagtgtttcactagacaacttaagctttctggccaaatggtacttcaagtagcactaccgtaccacacactaacaatactagccgtcaacccgtgcgttgcacgtgctctatctatataatataaataagtatggaagttttaatcagatgccgaaacgttgattatttatttttcaaaatatttctaaaaggcaattagcaggattgcccctacaactttaccttatttggatttttgattttcccacacaactctttaatagatagatagataataataaaaatatcaagtaatttaattatcttattgagaataattaaatttttttattagaacaataaaatcttagcccacgttgaacttcgtgtgtggcaggcaatgcttgcagtgcaagatttttgtaattattgaattgctaaagaagtcacccttttgattatctatttaaattagtaatacaaaggtttactggtgtcgtaattttagattttttttgattaagtaaattcaaactgtagaattaatcaatgcaaaagtactggggcatcaactgttctttgggtatataatctataatttcaaattttgaaaataataagtatcatgatgtacttgtctaaatatctattttgtacgtattttttttgttaatgtaatagttgtcaaaatttagaaaaaaactatattagtgagtcataactaatgtgacccatagttaacatgattatgttggtcgccaacctgtgcatcacatgtgctattatataattattataaatattaaaaagttaatatgctaaatgttacttttctaattatatctatttaaaccaaaaagggtccacatcaaggactgcatacaaattattaattttaaacttctgaattaaactaataaaatattataaaacaggagtcaacttcatatttatccattcaaattttggaattagcattttttaagaaaaaactgaaactaaagagtgtatgatatttattaattcaaattttggaatttttaggaaaaaaactgaaactaaggagtggatgatatttatgtaatattctattgctcaagaatatttcaattgaaacataatctgttgtgttttacttgaaattatacttacaatgaatagattaacaaaaactaattaatacaaccgagagttaaaatactaagttatttataattcatgcaaaatcttaaatcgagaattgatatttattaatatatgcatgtttgtaaataatgaaatctaattgaaactgcaatgaagttgtttttatatttgcatcatatgtgcaacaaagttgttctattttgtggatcaatacctaaattttatagtatcagacgttatgatggtgtggttgagttctgatctcatttcagatgagaaacatgtaaataaaacaaccaagatgaaaaaaaaagatcaactcaaaatctggatggagaaaatagtctgaacctacagagtctgaggttgtgtgtatccaattgacgtcgtcagttaagcagtgtatgcacacgccggcacgctgctgatcttcatgtgcaagacgaaggaggtcgatgtggcctccatcatgccgtactccagcgttgtgaagagtaggttattggctttgtctctgagtaatctgcgggcaaagattgatgaaaagtaaaatcgtaattacctgtggatgacacaatggatataagatcctcatagttaaaaattgccccataacatagattagttaaatttaataatatcttgaaaattgaacgtgaaccatatatatatgtcggtccaacgattaaattgcatcttgtctggcaaataaaattagtaatgaaataaccaagcaaaatggttgaagcgtagccaatcttttggaatgatacaaaaggagcagtacatcgtaaaaggtgtgggaaaaaaaagaactaaccttaaatgaatctgcatgatatgcatgataaagatagctataacaattatagtcattaaacttttgctctaagaaacatagcaaagtaattagcttggctaaaaacaataatatgtaactcaaagataaacatttgcatgtaccattgtttactggaaagtaatttgcaagtagcaaagtaattagctttcagttgaatctgatgcagatgccattgtcttgctgattggttacctctgcagatctatttaatatatacgtacgaaaaataatgatatatttgtaattaccggcacatgatgttcaaagagcagcttttctatttccatcactgttattttggctgcaagaagcaagatcatgttatcggtcaaatttgtgtacgcaaatataccgtgtggccacttgaaccaagcaatccgtattatgaattagtaacggcagaaaataaaatcaaacagtgcaagcagttatataatcccctctcctgttgtgctttctcttcataattgttctctctccttattgaggatctgcctgctcctgcagcagcgctgcatatatacacgcatgcgcttcttgttaaacacagataaagacggttagggaaataaaattagcattactttttacctaattttgaagcagaaagattgaagggcgatgtccatctcctcgcgtggaacgaagttgtcagtattctgggtttgatcggattaacgttgatggccagccggcgaatgcatctgcctggtttacgctctcgtcgttcccatctacgttccgctcgtataattgactggctattggagatgggatcgatggggtaggctactacggagagatatgatacagtgcgttacatgtaccgcaaggtggaagggctttaacgtgggccataacattaagtgtagagattggattttagatcaacggttacaatggtacgatatatctaaacaacggctagatctttctggttaacgtgagacctcgtagaaagtgcccaattagtataggtatagataattaagcttcctgatcacccaaattcacatctgactaaactgtctttcatctctagttggtgatttccttttcttttttcttgtaccatatcaccagctgtccatgcctcgcgggcgttggaggagcagcaagcaagaagaagtctggccgtgttctgtatgcatataactcagctgaatcattcaagtaaattgcatggagggagttgccatggatcagcatctctgtgttgcaagttgtaaacatctccggaaccttcgtgctcaaatttatcgatgttcgatatatacgttggtttcattaattggtatagtgggtatgttgaaattcaatggaactatcaactatggttgattatcaaccatgcaccgcaaatattataatgttgacctctctaagagcatccccagcgctcatccaaatatcatcctccatatacccatatggatggccatccaaaaaatattcctcattcatatctcttcccactctaacagatcatccatattacatcatctatatcacatcctcctatatgttactaatatctcccaactaaccttacacttgtatttttaagggatatattttgaacaactaaattttaacggtattatttatcacgataaaattttgaaatgagtaaattttaacgggtaattttttaattgatatatttgatttgggtgaatgatagcaagaaatatcataccaacacaaataaaataaacatactactactgtcttttctctcctcagtttttctactcttctcttcttctttacaggagtactactactcttttctcacagagaaaagggcgaggggcgagcgaggagggggggggggcgactgaggggcggcagcggacgtgggcgaggaagggcgggcgggcgcgcgggcgagctggtgaggggtgggggaggggcggcggatgaggtaggcggcggtgggcaaggggagcggatggaggcaggcggcggcaggcaaggggagcagatggaggcaagcggcggcgggcagatgggcgaggtgcaggtagcggtgggcggacgggcgaggcgtgggcggcggggtcgccgggcagagggcggtggcgggtggacagacgaggcgcgggcggcggggtcacgggcacgggccgcggtgtcgcggcggaggaacgacaggcggcggcgggcgggcctctgcctctactccgaacctccaccgccagatccagtaggtctctcctctctacctccatgccttcacctctacccttgcacggcacccatggagcgacgcgatccggatggtggcgtgagtttatccagagacgggcagttgctggatggcatgaggagagagaaacgccaaatttggagccccctatggcgtatctgttggagcccccttttctctcctcatgcgctattttcaggatggagcatgtgatacaggaggtgctggggatgctctaacccgagtcaccacaagctactccctctgtctgtcgctttagggtttaaattttgttacaaaatacttgtcactttagagcaccttttgtaacatcaatcatttggaggcatgtcacaagggctttcgaccgaacctgccgaaaccacaaagaaccccacacccgcgaggcgccagttgaagcccaatgggttagcactcgggcgaaacacctaggcgaagtcgaaggacagcgtctagagggttcaccaccgagcctatgggactcatcgttggatcttcactttgggtgaagccatggggcgaagcaggaaagattcgcccgaagaggaatcatcttcgccaggaagcccaaaggacggaacgatccaggaaggctattcaccattagcgggctggcccaagaagcccatataggggcccatagctagggtagacactatatgcccttactaatgcccctatcataaaggtatccatataaattcctctgtatatatattaaaccctagaggatttgagcctgtactgagactataaatagccatctaggaccatgtaatgagggatcccaaaagtttttaccaattaatatattgtctttactacacatccaatcctctaagagtgccacgcctttcgacgtggcatggttgtcttcccgacaacaatttccaattcaaaattttctccatcctacccccaactaccttctcacttccatccgtacattattgaataaagggcattatgtttattcttcgtaaaccttaaattttgctaaacaacctgtacagaggtagtattagataagtgcaatccatacgcgcaatgtagccacccatcctcatcatgtatatgatgaaattagacctattttttgtatagtaattacaatgtcgaactaggaagaaaggagatgtttaataacaaatagcacacgccagtccactaccaaggcatgtaccgtttgatcatccgcttgttagcgatgacccaacgctcgtacaccaagagacccttctcatactatcttgcaaaaatctcaattatatatttcaagcgtatactcatgcacatctaacccataggacggttgttacctatgcaccttcatctcaattaatgacataaagtaatatggataatattctaaacatagtcaagggtactaacatcgttagagttgcaggagaaaaacaaaacatggatcatggtatgcccgtattaacggcaaaatttgttaatgttctttagtggattcagttttggaaagaggtcgatcaaccaatgaaagtttatcaataagagaccgagttcaaggaggaatcgtgaagaccacgtcatggcagtctaattctatctattaattaggcaagatttagtaactttccttttatctttaggaagtatttatctagtgtctgaacatgacttgtagttttccttttatcgttaggaaacttgtaccatgtccaatcaggactagtatcaacccgtgagtataaatatgtcaaccaaggtcattgtaatctatctccacatatcaatacatttacttccgatgcatctgttgatgaaaaatccgcgctcggccaatagtgccaggtctgtgttggcgcaaactaagtcaatgaacacaacgacctgggagaactgcttagctccaatgcaggtctaaatcttggtgagatgcgggcgtgccagttagtttgatcctgcaactgacaaggtataaaattgcagatcaatgagccaatcggctaataagtcgaaggagtaatttcatccgatgctgatgccagccgatagcaatagggttttgagcaatcggctaaatatccaacgtagaatctaacactcgacgtataaaggcgatcagctgatgataatatagtaataatataatctagtagaagtcaattagctaacaatgatatgatagaataagcactgatccgaatgttaaagaatacatcagctggagtcccaatgtcataaaatccacaagattagattaaacagtgaaatctttgttgcgatcggctaaatccaacttgtatgtaatccttataagctgatgcaacgtctagataactcatcggctgaaaccccgatgaaacccttattggcaatcaattagcaggctagagattatggttctaagctcgacttagtagatcaaacctaattgatgcaacactaagtatgaaaagaaacataatatctagacaacttagtagatcaagcccttgactgatttttagggtggtagatgccttagctaatctaatccagtaaaacaatttagtcgatatcagcagaaaccctaaagcgagagacaaccgatagagctaaattgagattctaagactagattaacaaagacatatgataaataggcaagcaaatatatcaaccaaaccagagcaatcctagaggtcgaatgtactgatgcagccttgaacgacactattgtagccagtacaattgcctgggccagcagaacattggacttaccccttcgccggagatcgaagacccatgcagccccgcgtcagttgccaagttcgccgtgataaataaaaagtagaaaaggtaaaaggtggcgatgcaccgatttgtattgatcgtgagatggtttacaatgacctcagatgtacatatttatacccatggggagatactagtccttacaggacactaaacacactttcctaaagataaaaggaaactaacgaactattcctcattaatacataacttgccatgccacatcctcttgaactcggtcacttctggataagcttcctttaatagagtaatttccttaaccgaataaagcaggaattcaactattagcggcatgataattctcatcagctaattctaggattctgaagccaatactgactctaggccgatgatatcttcggggcttaccaaatttcactgttaacagcactatcaccctcttttacaatgtttttactaccgacagaatttggcacctgaatcacctgaatcggggctacatcggcttcgatctccagcgaaggggtaagtcctaagttttgctggccctggcaattgtatcggtatattttgcctacatgatatttcaattgtatctctaattgcactatgtttagagatgaatcggtttacttaggactgtctcagttagatctgttattctgatttaggccctgtttgattcagcttagaattattataatctggattattaggagtaagctgaaacaaacaagtagattattatgctagattattataatctataagccagattactataatccaataatctcctctagaggagctttttccagattattgagtggctaaagacccactacccttagatgcctctaataatccagagaaacaatcaactcgtagcttattttatattagcttactataatccagcttagagtaatccgatttaataatgtagattacaataatcttaagctgaaacaaacatggccttagttgagatatctctacaatcacaatattgttttagataaatttgttatatccatcacattaaatagatttcattggctcattgaatattagattattatatacaaatcccatgctgcatcagttaggttcgagctgctaaattgtcattgataatctaagtcttgttaagccgataggtttcatgccagtgttttatcagagcgctagccgatatgttatctttgcatcggacttccagccaatgtatgttttaaccactgagcctacatttattattttgtatcaatattgaccggttgcttcattggacttatatttcatcatattatcaccgaccgattggattgtttgttcaaaccgattgttgaaaaccctatcgacatcggcttgttagcccatcggctttttgatcgtcaacatatttatctatcttgtcagtgcaagatcaaattgattgacatgcccacatcttatcaagatttaggacctgcactaaagttaagcagatctcccatgccttcgtgtttttcgcgtcaatagcctgtccaaccctcgtacatgcaactgactagttataatcatcatgaaaattggtgtcactctgcacattaaagtattcatcacctacatcaaattctaaatgcaactaccattaatacaaagcaagagttagtaaaaaaaaatggaaatgcaagacctaaatacatgcaagctgagattaggagggccatttgtggtcacaattttcagcgtaaagcaaattttgctgtggtatatttttaaacctttaaagtaagtacaagtaaattattgtagaaacatcatcatgcttgctgccctccacggcaggaagccaccacatgtcagccactaaacccttcatttgtaacccctccaggaaggtactgctatgaaaaaaaatgccggctccatgtacgtagcacgtggtgtcagtataccttgcttccgcagctagggtacattgcggtagtgcatgtggatgacctagtcatcaaaaccagggaaaaccagcccacaatgatcaatgaccagaaggaaacatattcaaaaaaatgtgcatttggggttctagcaggatagccgactgggctagatttggaccacggctacgcagcctctagaattagtgcctttgccttgtttcaatgcacttcgccatggttcgcttggcttagcccttcaccgtgcttcgccaagcttcatcgtgcttcattcagcttcaccttaattattttttcacgattcgcatggcattgctgttacttgctttggctgacctacctccaacagcaaccacctgcacggctaaagggggtgcaacatttggctagttgcatggttgtggcggaagggtgtttcatctcctcgataggagagaaggaactacctatattcaagtggacccaagagactgaggccgccctccagattcaaaaatgtacctctccatgtccctggttttgactgtgcctagacccatggagtccttcttgccgtatgtcactgctatccaactgatcgtcagcacgatgctcatggttgagcatgacaaaggagaagtgaccgtctacttcgccaacaggtgctccaaggtgcccagacacgctaaaagggattatgcacaacctggaagccattggatgggcaaccaagtgggcgattgagctcgatgaagttgccctctaccttgttccttgcattgccctcaaaagccaatctgaagtcccaaaatccacatatgatcatccaatattatgatcacgcacatatggacatacataataaatttaaattgatgtactcaactttccatgccgaagggccaaaactctactaaaactttctcaattcaagatccaaataaaaaaccaaataaacaccataggataaggtcaagggtggacaagatgtataaaagtcagtaccattgaaatatatgttattcaccttctagggtttcctcatagtactgttcttctatattattacttatgcaagagtgagtacttatgtgcgtaattttacggtccatgaggaggtacgaaagataccatattttatagtgtaaaatttgttatgtctttacgagaaaaattagaggtagtatgcacctctaccataaaacttgctcgatcgcaatatccggttcttgtgcaagatataaagaataatatttatagttgagatgcccactagtttaccagcaagcattcaattccaatactcttgttccctaaaaaaaaattccaatactgttgaataaagcaactgatatatctagggaacatatcctgggtatataacttttacgtgcacactccatacacactaattaactaatgtcacaaaaaaatctaaaaaaacattgtgtagacattttgaaaaggatcacacctacttgtaaaattttagccgtaacaaaaaaaaaactgatagttttgagactataaatctattagaattttgtcttttatacataatgaatttgaggatgaaactttacaaatgtgatactattgaaagtacatgtgaatgtttactactccctctatattttaatgcacgacgccgttgactttttgtccaacgtttgaccattcatcttattaaaaaaaatatgtaactatcaattattttgtggtgacttgattcgtcatcaaatgttctttaagcatgacataaatattttgatatttgcagaaaaattttgaataaaacgaat

SEQ ID NO: 36173 - DNA, 1698 bp, Oryza sativa
ctgcagccctggtgatatttgttctttgatgtgtatggtgtgtacacaggaaggcttatatgtataggatacgttcttatacatctatgtgtatttcttcggaaagaattattacacatcaagcattagttatggttttccacgtgacctagcatcctattcgtgtccaagttgaaaggagcatatttatcattgagatgcccatgggctcaccagcaagcattgaattccaatgtattctgaatgaaacaactcacacagctcatcctccttgtcttggtgtcatggtgacatatatacattgtgctacacaactaagtaatataagctggtagtttaagctggccatacatgcatccatcatccatggctgggatatcgcagctcctcctgcgcgagtccaccatcaccatcaccatcaccaccaccactaatattcccggtgccggcgtcgaattgcccagacaagtgcggcaacgtatccatcccctacccgttcggcatcggcagaggctgctacctcgacctgccgggctccggcagcttcagcatcacctgcaaccacaagacggaccctccccaaccctacaccgccgatgccctcttggtcctgaacataacgctggagacagcggaaatgttcgtcgtctcggctggcgccctcgccgtggtcaagtacccatcagtaagagcaagaagtgccatcacgagcaaatttatcactactactcaacaagaagaagaacattctatgcaagtaaaagtaactgtaggaatgcctgtcacccaacaagtaaacatgacattcttaccaagcggatacaccttgagcgcaccgtaccggctttccccgacgggcaacatgttcacggccgtggggtgcgtcaccatggcgaagttgtacggcagcgtagagaacagcagcagcagcagcagcacgggggcgacgacgacgacagcagcagcagcaggagggcaaatgataggggagagggcgtatgcgtacgacgcgggctgcatcacctactgcccgagcctgagcgacgccgcggcggatggggcgccgtgcaaggacctcggctgctgcgagtcgcccatcacgccaggcctcacccagttcgccgtaggatgggggcgatggccaggtgcatccgacgacgactacggcgagttggaccccgaacagtactaccagtatgcctttgtggcccaggactggtaactagctaattccggacctgatgatgattctttgttatactatatctttgcaagtttttagatgttttcccatttctaattaataacttgacgttgcctagctacccaccatatattatgggttttaattggtgtttcccatatatatatctctagtaaagaaaatttcagcacaaggaatatatatagcacccatatatataatactaaaagaattggcacacgtatgaatttttaaaattgtttcaacagtaatgtagttcaaagactgttcatttcaagtcatctatagcatcaaaatacattacgttttttggaaaggacttagaagaattgcatgtatagtgtacactgctggagaatgcatatatactcccggttcacatccctctttaatcccgggtatgcaaccggaactacgaatcgggtgaaataaccggactaaagatatatcttctttagtcccggttggtgtag

SEQ ID NO: 36174 - DNA, 8753 bp, Oryza sativa
cctccccccccccccccccgccacgctcgctcctagctgctgcaatatttgagaggagaagatgagagcaagtgaagaagaggataagggagagggggaaagaggtggaatggtaggaggaaattaaaaagataaggagcaagtgtttgcgatagtggaggagaggataagtgcgagggattatatatactacatgttaaattttagtcccgattggtagtaaagattatttagatctttagtccaggttataagatcctcagccccctgacaggccactgacaggccttatcagggatgaaccgggactaaagttccaatcgggactatagatcacatagttccgatggaatttttaagcgggactaaaaatgcttttttattaatctagtttttgactgacccagcaaaggtcagttctccagttgtggtataagtcaacagttaattaattgttcaatactacttactccgtttcaggttataagacgttttgactttggtcaaagtcaaactactttaagtttgatcaagtttgtagaaaaaaatattagcatttttaacccaagacaaatttattatgaaaatatattcaataattgattgggtaaaactaatttagtattataaatattactatatttgcctataaactcatctgtgacgggctccaactccaacccgtaaaaggtgactcggtcccttttgacggggtactttagagcctagcacggatgactaattggtgatatagtcctcttgcaactcaataacaatgttgcttatagttggccaaaagcccgaggcctgatagcccggcccggccatggcacggggttttggtccggcccaagcacggcacgacctctactttggcacgatggcccgacccggcatggccaggtccaactatcagggatttaatagatgagggagccaaaatagacttaatccaaccatataaggcacggcgaaagagatgagggagacaaaatgaacttttcaaaggaggaacacggtaggcttcgtggcttcgagttggtccggcatgacccgagtcttattgggtcgtgcttgggccaaacgcgcagcaagtggatgggcacagcacgatccggcgtgtaggtcgggccgtgtcggcccgactgatatcggcccgagcccggtcatgctcgggccatgctagggcgggtgatccttttggggtgtgtttggttgggtggatgagcctggatgggagatgcatggccgcccgattttttttggtgtttggttggagggcagggtggatggggcggcccagaatagggaatcttccctcaataggttggataagtgcatctggccgatttggttggatgaagccatctagttttggtccgggtgatgtgacctattctgattggctatggttggtttgattttctgttaagcaagctctaaatgattttttttctcctaaactgtttatctaatttatggtttgattacaccattatatttgttacaattaaatctttaaaacaagatctcggatgattatattatgataaaaatatatatatatgacaaatgggtcccactatcttatggtttctcccattcatgctatatcccctaaccaaacaagaaattggatcaacatatccatataaaccaaacaaaaaattgaatcgccatatccaacaaaatatggatggccatatcccatccatgcatgaccgtgaaccaaacacacccttggccatctataatgctgctcaaccgtgacggggttatatatgttgtaatccggcaccaaagaggttttaccttaaaaatgtaactgctaacaaaatgacagaaatagagatatacattcctagaatccccatacatttcacaatcacataaattccaaacctcgattatttacaagtctcaataattggatgcctcacatatttcttcaacaaaactttaagttgcaagcctgaagaatttagggaactggacatgcatcttgaaaagagagctatcacacgacctgtgaatttatatacaatttgataaaaataatagaattagtaacgcaaatgttaccaacagcccaccatatatagatggttgtcatcggtcataggtttgatcacacagcccatcacagatgattgccactgtacgggctgcaggtctccgtcgctgattggctgattaggatgctagggttttgaagtagtaaggctaccagtgctacttccaaagtgccgaagagagtttctctaatagtgaaattctcctaatgactcattttgtttttgtgctccaaatttcatgcagtaccacatggggttttcatccaggggaaaagagatcgatacatttctatgcacataaggttactcgccgtgcacaccaactaacatatatacaagaaattacagaataattgatacatgtacatataatactattgcacctatatgttaatatgtaaagtctcaacagtataacatgaaaaatctgataattttctcagagttttgtcttctatgtctctgtgttcgctgaatctaaagtggagacgttacacttggatatgttgttctattataagtacatgtacaattttttaaggcatgttggtgagatttcttaacacggagcttttgtgtacatccgtttcatctagtctagttgtttgttggaaatctggtcttcatgtatctgagtatctctggggttttgatatcagtaaattctcaacttgtaacctagctgaacaaatcgagtagtattttttattcattggcgagttattccatcatatatattgtgatatctcacattgattgtaatacttttacgcaggtatacgttcaaacaagatcatcttactcactgggacatagacaacatcagtgttcctttcgttcttcactgggatatcaaggatggacctgcatgccgaccagagacaaattatgatagtcccttcggcgcatgtcatagcaaccacagcaaatgcgccaatgtcaccagtggtttggatggctatttttgcaactgctccgagggatacattggcaatccgtacataccagatggatgcaaaggtttgtatcccagcgctctactctccatccgcatgcttatgttttttttagataatggattaaaaacccgacctctacatccaaaaggatgtacacagcccaacatgtccatacatgagtacttagactccagccattacatgggacaaaaaaaagtttagaagacacgaaaagaagacagaattacaagttcaacaaacaaaacgaaatgactagaccaacaacctcaacgaccaaactcaaagaaccggtctaaacttcaactctctttctgaaattccagccacacctagacaaaaactccaaaactctcatctctaaagccttgcagcattctttaaccacgttgccatcctcttccttaagcagcaaagaccaaagtctcacccaattaatgcattcccctgaaaattacctacataaaagagtacgggtatgatccattaaaaaccacatcattcctactcaatcacaccacccagcacaatgctgaaatgcccacaaacacttgatttttaagcctaggattaacactggttagccaaataccaagtaaatgtgacactgtgtggaggctgatgccaaacgtgaaataaaccacgttgcacacgtacctaaccaatggacaataaaaaaaaggtgttgtattgtctcgttagaattacaaaagcaacatctaaggctacctttccaccttcttttagcaagattgtccttagttaaggtgactcctttctaaagtaccacaagaaaattttaatcttaagtggaagccttagcttccaaataaaagacttcgcatttcgaaacatgattttttttacatcgaattgacagaaaatattccatgcttatgttattagtcgatattgtcggaaatctataaacacccacatcccataggtaagtacgtacatatcccctgtaggataataaccttacacctatctagatcacagctgtcagtggaaaagtttgtacaaggatcggagctctcaagcttgttagactaattcttgctgattgtagaaagaccaactctcactgacgtgcttcggcttgcttttatacccaccaagcaccagcactctctctttctgtccacaaggagacatataatattgtatataatcattagcacaattagctctttgaagccgcgcgcaaccagtttgtagaaaaccaaacccagattcactactggatttggataattggccggaaggcaaaaatcacattagtcccggttcaaataggaatcccggttcaaaagcccaacagtactttttgatctttagtctcggttggtaagatcatttttagcccccgttgagaaagtgttaggcccctcactatctttagtcctggttgggttaccaaccgggattatagatcgacgcgtgcgtatataatctactcgtacttagcaacgcgcggtgcacttcgttgctctcgtctctcaatctcttcgaatcctcccctctccctctctctctctctctctctccctctctcagctctctgtctcgctccctctccctccaccgcaccacccgatgagagcggtgggagcggaggagatggcggcggctcagcagctcggaggtggcggcggcgccctggtggcggcccgatggctcggaggtggcggcggtggctccctccgcctgttcgaactcctcctcctccctttcctcatcctcttcctccgtctatcctcctcctctccgggagcatcgggcggcaacggcagagccctcccttctgtcggatccggtgtcccctcccccggatccagcgggaggggaggcggcaggcggcgcatgaggggcatgcggcggtgcacgagggggaggaggcgagcggcaggcgggcgcaatgatgctcattcttttttttttttgagaattttgtgatgtccattcgagtatgaattctatttgtgatattaactgtgaaatcgtgatgtgaaacatagtatgttcattcgatctgtgatgttaaattgatgtggggatttggggatttatatatggagcactcgctttggaaaaatcaatatgcaagtagcaaaaaccaataaaaagaagcaacccgaaactaaagggttgcaaaccaggactaaagagggtatcctcagcagttatttactcgccgctatacgcacccaaatccatgcatgtgaacacgagaattttgcttacagcgtactccctccgtccaaaaaaaaaatccaatcctataaatgtttttgaacattcacgttatccatatacatcctcaggattgttttttttccagagcagtatccctttgcgttaatataataggatagtgtaattgaatctggagttaatgtgatggatgtgtgatgtggcactgactcagcaaacaagtaaaggtaaaaattaaagttggcgacgaggaagactacattaattggagattcgtgtagcggtggctcgaggtggaagatgtgagtgaaaggattcagggcatatttggtagagctccaagcctccaactcttaaatttagcttcaggagttgggtctggagtggagttgtggagcagcctaaacccatctccacctctaaagttcattatgtgagagcgcttcacccagctctgctcccactttaggtggaactgaaactgtttggctgagctctagctctaggagtggtggaggtggagctatagctggagctatgccaaacaagctctcaattatgcagcgatagcgatgttgacaaacagtggattgttcctatgacaaataggatagatgcaattttggtttccagcgataaaatgggccacatgtatactccctccttcccataaaaaaccaacttaatactggatgtgacacatcctagttctacgaacctagatatacctttgtccagattcgacgtactagaatatgtcacatccaattctatattcgtttttttggttggatggagcgagtatatatctagctagccaataggctacggtcatctaggccaccgagccaggtcaggctcagcttgcttcattaaggagatacagagccaggccatatttccaacggtaatagaacatcccccaagaagatgagttcataagtcaatgtacatgaatgaatatattcacagtcaaatttagcatttggaaaaatttaggcgaagccttgggagggatccgagagagccttctcgctaaagctagtaagaacccttgtcgatctgaccggaatcctttgtcatgagtagaggtcatggatcggttttgtcatcagaatccaatccaaatccaatttggctcttcttgtgttcccttttttaggtgttagggtttttggagtactaattttctctaaagcctaattaaaccttgatacgcaagaccagccatactataaatatagatgtcaagcctattgtaggaaccaacaattaatcgacaaaatcgatttagtatctaacctctatcttctaccctacctatatcattcttcacttattccatccctattttccctccaatcccataattgctcacgtattttgtctcccctgcattagaggacatcctaactggcttttcaagcctagatcaaactggcccacactcattttgcgagttgcgttcctccattgacaatgaacatctacagtaccaccctttcgttgacttatttccgtgttcactactcttgaacccttcctctcgtatcgagaagcactgcatacagggaattttctatggcatatttcttgtactacgatatcaacgcggtcatggcgattcataactacgagtcatagatgacccctcattcttaacaggtgctacatcttagacgagccactctgtgacccgtaagagatgtaattatctgagacgagcatttttcacctatcatagattaatatgcccctgtttagcatcccaagtttaggctgtgcaagttttaacacagggccagagatatttaactacctatattttctccttcatgagcgtgtaagtaaaactaagaatagctttatttatttttatatttaacatctactgttttctccacttttcagatgttaatgagtgtgaaaacaattctatttgtggtgctgggtccacatgcaagaatacagaaggtagctatcgttgtgactgcaatttcggccaaagacgtgacaatagttctgataacatgggtaattgtgaacccatattttccagagctgccatagcagtcataggtgaggttcaatacatgaatgcaatgttgattgaaatttgcagcatgccatacattccacatataatatataatgctctaattacatgcagttctgcattccatgtatacaccatatttgcattgcactacattcaacttgaagctcaacattgaagtgtgaaaacataattatttccagatagaccatggctgtgcctaaatgttatcttttcgcatgagcatagaccatgtggttgtgcctaaattatcttttcacgtgagcaatatatatggactacgcaattgcatgaatatgtataagttacctttgcagtattgcatgttctatatattaactattttgtttcctatttgtccacagcaacagtttttatcatcgcacttctagtcgtgttactaatgttcattctattggagcgtaagaaaagaaagctgagagcttatttcaaccgaaatggtggacaattgctgaaaagtatcaagatagatatttacacaaaggagaaacttgaccaaattactaaaaattacagtactattattggaaagggtgggtttggtaaggtgtacatgggaaccatcaatggaaatgtgcgagttgcggtcaaacgctgcataacagtcagtgaggcccggcagcgggactttgcaaatgaaatcacaatccagtctcagattagtcataaaatttagttaaacttttgggttgttgcttggagacagatgttcctatgttagtctatgaattcatacccagagggagtctctgtgacgtacttcatggtaaagagtataataagaaacatcctctctcactactagcacggttggatattgctattaactctgcagatgctcttgcttatatgcattcatatgctagtcaaaaaattcttcatggagatgtgaaatctggtaacattcttttggatgataactttgtgccaaaagtttctgactttgggacatctaggctcatgactattggaaaagaccacaccacttttgttgtcggagatatgagctatatagaccctgtatacatgaaaattggccttctcacagagaaaagtgatgtttatagctttggtattgtccttttggagctcatgacgggaaagaaggcaaggtacaatgggaataatagcctccccatgaactttatggaggcttacatgacagagagtagagcatacgagatgtatgataaggagattataactactgaagaggacataaaatgcactgcaaatgttggtaccatcgctgttaattgccttaaaaatagtgtggatgagaggatgaccgaggttgtgaaggatcttcaaattgtgccaagtgaatggttgcaaatccttgggcatagggagcatgactcaactgaacctatgggtatttaatta

SEQ ID NO: 36175 - DNA, 8903 bp, Oryza sativa
aggtggaaaggtggtgttaaggatctggatgcagtgtagtttataatactgaagttaagtaagcaagtgctgattttttttattggtcaatctgcatgtaggctatttgagccgtggcattatggatcccttaaggactcttgcagtaaggttccatttcaatctagaatttgttaacagaggtagaaagaagcagtactatgatgggagggaagcaatgcctcgtaaacagatagaggcaaacccaaataagtgcaaggaagggagcgcaagttgggaaaatgggcaacatgctttgcacatcaagtatctagacatacgttggataaatatcagtttttttttttagagtttgtgttgaatatatgtacggtattcgccttgacatgtaaagaagtggagaggatgactctatagcattgaaatacaagaaccaagcctactagaaggaggatgaatggtagggaaaaactaatctttttcgtggaattgaaaggaaccctcaaacctgatggattgcgccagtcagaccgcttagtagtcgtcggtcagatcgccactttgtaactggtcaaattgccttgaagccttcggtaagattgcctccttcctgcctacctgctgcctgcttgcctccacccgtttgaccacctacttgctatcggttggatagctcaccggttagaccatgcgcctaatgccggtctaaccatcagaatctaaaaaattgatgaaactcttgaaagtagattaactttgttcaatgtgtttacaaagtgcatccagagcactcctctatcaactcatgaaatcgaatcgaagtttcgaagcaaaccctaacttttctcccccagaaaatcgatgttctttgagtctatacccctcatctatttatacctaaaacatggatgcatacagtagcaaatccaactataactagaaatcctgatcacataggaagtaacccttatcacataggaaaccctcaaacaaggaaaacaacatccctttacaactccgaagtccaatcttcccacacttcattctaaatttgattccgcttcccatatgcacacaatcccattggatgatgtatggaaaccttcacctatacgtgcattgttctttagccttagaatcccgtatgatctccttgaccatctaaaccacaacttcacccaagcctagtcccgatccatcatcggcaattctcccgaggccgcgagcaacacctacacatgaacaatcaaagaaaccatatccgagtacaagttcgcagcaacttggctgacgtcagcacacaaaaagtatcatgcacatacttgtagaaaccatctagaagtcatacatatgaagcaataacaaacatccacggaaacaacccaaaatcgagtccctcctagaatctgtcggtttgatcatcgcgttacccaatcagaccacagttgcccgaccggtctgaccgcctaagcaccatcgttctaaccgaccttaccgtgctcctctgactgccagcaccccgacacttcaccacgaaaacacaatttgacatatatcaacacattcacttatttatcacctttgataatagttcatcactaagactaaatcaacaccttgattttatagattccagctcggagtcatgcctaggaatatgtacacgcggagaggacgagtggtaagccttgtcgaatatagaaggggagaagagaaggactcagggacgattcggactctagaccccaaatacaatcagcaagagggatttctatgggattgcaatcaaatcaaataatccaaagcaatgaagaaatcagccctgattttttgggtcacgacgatttggggcaacgaacttcgagtggcaggagcacactgcttagtgcggaaggagcgcaagtgcctgtggagttttgtgggacacctgaagcatctaggcccccattgttaattttagtaattaatgacaaatgctaattgtggactaactgttctattgagctatatattttaagttaggttcacattatgtgtgcgcatggacgattaccgatggattaaaattgacggcgcaaagcaaaaggaagagaagacggtaaactagtgcctttttttaaaattgatcgaggcattgggcgatcaaaattgtgctagtttatttatagctttgccgtactattaagaggggtaatgacctagcaaagagatgattttaattgccacttaggtcatttgcatattcacttgtgctcacatttgtattaatacttttcacacacacatgcattcattgtgttcggcctgaccagagcaggtctgaccgtgcgtctgccgccagtcagaccaccggtccctggccggtctggccggcctaacagtggcagtttggccggtgctaaaggttggtctgaccgacggcttcggggtggtctgaccggccggccatatggccgggatggagtgctcggggttggccgatgcagagccgacggagctgtattcggtcagaccgagctgagggcggtctgaccgagccgaggccggtctgaccggccactcaacgtcaatctgaccggccaggccgatggggccctctgacagggctacaacggctagttttctagccgttgcaaagtagcacggtctgaccggccacttacctccggtcggaccggcggcacatagagttgggggatttcgcccctaacggctagttttggttggtgggagtataaatactcccccaccagcagtaaggggactctcttggcacccacttcaattgcatacaccccttgcacctctctcacacacatttgagcttagtgttcatccattgtagtggttgagggttgatttagccaagagtcaagtgcattgcttccattgtagagctagtgtggcacttgatcatctccgagccgcgtcatcgcttgttactcttggagattgccgtctcctagacggcttgtggaggagttgcccggtgacctctccaagaagattgtggaggaggcccagcgccagttgtgagtggtttggagttcaccaccttcggagtgaaggaagaactaccccaagcgattgaggcttgggtagtcctctccgtgggccggctcacgccttgcccaccccttgacgaagggggcgtgcggtggcttcgtggttgagcggtggaagtggactcgcctcaacggggagtaggaaacctgcgagtttccgaacctcggtgaataatctcttttctccttatctcatttatttgtcgcatttacatttgtgcaatttacattcctagagatatacttgagatcatatcaccctaggattgctaaacattgacataggagtgtgatttactttcctagagatatatttgagccagtatcaccctaggtttgtaaaacataacttagttgttttgaaaattaacaatttacacagggaattgaagtgaagcattttaagaactatcaattaatggcagtgaagaaacaagcattagcattgtttagatgatttcatctagcatgcaacatgaaaaaggcacattcgacttagaaatgtcgagcgtaaatgcaggcacccattacatacaatgagttgccaccttcctgttaaacaaggctccagcctctgttcaaaggaccacagctcttgcaggttaatctttgtttgttagttgctgtattctcaatgaatccacatttctgtacaaagtaaagcactctgatagtatgatcaaatcaatttgttctgtaaacttttgtggatattatatgtagcagttggatttataggctggggcagcatgggcatagaacatggtgtgcaagagtggactatgctaacctatcttttctcttaacagagggatcgatactgatcatataatcattccagcaatcagcaacaccaactaactacaagaaacaatacttccaacactaatttctacaacagtatttccaaaagaatccagattcgtcgtatggtcaattttaagggtgcttacagaaggaagatacctcatacagaagctctagcatatactcatatctgagcaggcagccatagaggttcaactagaaagagaggaaaatttgaagggagcatatcttcatttgtacttacagatgctaaagccaaagaaatgccaggctttgctcaaacacagaaacatgatactgcacagttaatttacaattcttctatcactcaaaatatttagcttagctagtattttttttttttagagagaaggctcatgcccagcttttactaaaagcatacgagttcagtacagaaacaaaataaactgctggggaagccagcgaactagagaggcacaaagcaacttgcagacctactgctgctggcacagcactaacaagccagaacaaaaaagacagacagactagctcttgattgactcattttccggacagcaacagtagtcaatccagaaattcagaagtccccaccctggagacagccctctccacaacacacaggagccaaatgcaaagcaattacagtgaaaagaactctgctcggccagacgctcgatcctttggcgccagcttggaagtcatgcctttcctcccctcgcacctcttggattctggcatacagcaagagccttgtagcctccacatcttcctccatcttcgccggtactagagtcctccatgttagatggatctccctccccttgagtccaacggctcaagggggccttgacccgcgccctgatcgggggcgcccagcccaatcgctggtgggcccccgtcacactgtgccatataaagaggggtggaggacgggacgggacaatgacacaaggaacgaggttcgtcgccgccgccgccactccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgtgcattcatctattgttgttcatccattgcaaatagaaccacccgactagatctaaacctaggtgatccaatagactaccctaacaatggtatcagagcaaccctagtgtttagattggttcgggaaagaaatccaaagagaaaagcaaacgatccaacggatcaaaaagatcgaaaccctaaccctaatcttacctcgtcgccggccgtcgatgacgccggccacggagggggggaggggcaaagaggcaccgccgaggagccactcgacggccgcgcgcgcacccgcgagtgcacgcgcgcgccggcgagggggcccgcggcggcgccgccatctccttcggccgccaccctctttctctcacttcgcggtgggggctagagacggtggggggagaagagaagagaaaagaaaagaaggcgccgccgtgtttccccatccaccgccgtcgccggccatcgccggccgtcgccgaagccggggggagacgagagggcgcctaccacaccgttgcaaggccgctcgacggcggcgcgctctgcctagggtgagcacgcgcgccagcgaggggccccgcgacggcgccgccacctcctccagccgccgccgatggtgctccggccgccgccgatggcgccgccgctccggtgtagagagaggagggagagaggagaagtgaaatgtacggctagggttcggccggtcgggaggaagggtttttgtttccccgaactcggcggctgaccgtccgatcctaaccctagcaaatggatggccggatggtgacggtcggctggtggccgcgggccggacgggccaggccggccaaaagtccactttaggtctctcggccgaaagaaagaaggaaaagaagaaaaagaagtttaataaaagtccctcggccgaaggaagcattttcaatatgtttaattattgtgattatttctaagcaatttgaaccaacgtgaaaattgtttagagaatagataaatgtgagaaatgcttctgaacatgtattttgtatattttcatgcaaattacaatagaattttaaattgtttttacatgttttacctctgtttaaatttgaaccaacgggagaattttacagagagtaaataacagagttttgttattgtttatacgaattgtatatagatcttccgctgcaaatagatgaaattgatgaaaattagtgtttctaaaattaaatttcgaaccaacgggagattttaattttaggaacataatatgtgctatgatgttgtaatttttctgaccaacgttgataattgcaatgttatagttatggctttatgtgttatgtctattttcggcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaacaatattgggctcaatcccagagtatgacactgtctctaagtacctcgaaagtataaagagccagtttactggttcttcaaagttttatgcgacacagctgataaagcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaattacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaataacagtttacagttgagacaagatcagtgtctacactgcaagaagacaagacattccaagaaagatcatcctaacttcctgacagtgatcatggcaaagaaaggtgagaacattattacatttgtaaagaatctcattatgattggttattctagatccacatggtggatttattctggagcaactattcatgtgtgtaattgtttaaaggattccgttcaatgaggactacgcaaagaagtgaaagatccattagagttgccaatggagttgaagcaaaagttgaagctgttggagatcttcgcctagaactcacgaatggcttcacacttttacttccagatgtttttatgtccattctttgcaaagaaacttgataataagtgtatccaaattggattctgatagatatgaaatggcaaatgtgaactatggtataataatgaatgtattggtcttgtgttgcaagatcagctttatttgttatctctttctgagaatgtgaatgttgtgtcctcgttgacaaaagaaaagaaagcgaacttctgatgtctcatcgaaattatggcactgttgtttatgccatatttcgagggggagaattgagagactggttaagaatgtagttcttcctccattggagttctcaattttagaacgatgcatacaatgtatagaatgcatcggtgcccaaaacaccgtatgagctatggatcctccgtgtgtgggggagtcctgcaaaggataaagtatttaacccaaaacagtaagctgccattttattggctattctgaaagatcaaagggtcatcgtttctactgtccaaacagttatacaaagtttgtagaaacgagacacgtcgtcttcttggaagacgaaatgattagggggagcttggtagttcgagaaattgatcttgagaggcgggtgtctgtacccgctccgtcgactcaggaacctttcttctctctacctgctgatgttgtgcttgcaatgcatgacgttgcggtaccaacacatgttgttatctctcctgtggcaaaaatgaatgaaagtgaggaacctgttctacaggattcaacagaaattattgccacatcagaggaggagctgcaacagcctcaaacagataatgtgtcagaataggaggcccctagaaggcctgaaagagtagcatatggaggatgatcccacctcatatgcaaaggccatggaagccatgaaagatgaaatgaaatcaatgaaattaaatgatgtctgggatttagaagaaattcctaaaggagccaaaacagtaggctataaatgggtctacaaaaccaaatatgactccagagggaatatagaaaagtttaaagtgcgacttgtggcaaaagttttcacgcaaagagaaggcattgattacaatgagacttttctccagtctcttgtaaagattcctttatgattataatggcactagtggcacattatgatttggaattacatcagatggatgtaaaaacggaatttctaaatgatgatttgaagaaaaaagtatacatggcacaaccgaaaggtttcgtcatgaaaggaaacgaaaatatgggatgtcgtataaagagatccatttatggattaaagc

SEQ ID NO: 36176 - DNA, 812 bp, Oryza sativa
caacgacgatggccggccggacttccttttcctcacaacgactggtcacaaccctaaatcctctcactccctctttgttcattcatctattgttgttcatccattgcaaatagaaccacccgactagatgtaaacctaggtgatccaatagactaccctaacactccattgcttcaaaaatgaaacagctttataaggtaattgaagtacatctgacataagtttgttgttaaacacccaatcattcctaaacagccaaattgcccaggttcccgccgcaacaaggcacaacaacggggtgttgcgagcattgcctgggcaaagcagcttgtcaagcagctctgttctagtgttcggcactttagcccagcctaatgcatctctaacacaacaccaaaaaaatttagtagggggacattggaaaattagatgatcaaccccttctaactccccacaaagtttgcactccacctcaccaggccatttcattttttttaattgctcagctgtttgtatgcgcccttttatcattaaccagaggaaaatcttaactttcagcggcactgggatacttagaatttcttgggctcttctgtctcttacccctccaaaaatcatctctttataaagcgacttagtagtgtaccaccctgatttagtcagaccccagctcattttgtcatcttcttctgttaacgtcaccctctctagaatctcatgcaaattatcccactcttcaaggtcttgctcacttaatgatcttcttaattcgatattccactccccatttgtacaaatttgtttgatcgtag

SEQ ID NO: 36177 - DNA, 1687 bp, Oryza sativa
gagaatacacttgcaaccggtgatggacaagttgcaatcaaggttagtgggatggaaagggaagttaatccagcaatcagggcggaagacgctagtcacgtctgttctcagctccataccaacctacttccttactgccttaaagccgcctaaacagttcctcacagacatggacaagattaggaagaaattcctctgggccggcgatcaagagattagcggggggaagtgcaaagtgaattggaaaaaaagtatgctccccaataaagatgggaggactaggcttgttggaccttgataaatccgagagctttgagactccgttggctatggtttgagtgggagtgccctgacaaaccttgggctaggacgacacccccctgtgatgagttagatgagcaaattttcgcggccgcaacaaaggtaacaatctgtaatgggtggaaggcaaaattttggacatccaactggattggccaccagccgctgaaatacctagcgccagcgcttttcaaccactctaaaggaaagcaatgcttggttcaggatgcgttaaccaatgacaaatggattgatgatattaggcatgagttgtccatgccactgatctgagaattcttcgcagtattccgccttatctgggataatgagacaaacctggaggaaggagttgatggacaaataccggaacttggagacggcgcaacatttattcaaggattgtccattcaggcgagaaatttgggacaaagtaacggctaggatgaaccacaatcaacccttcccggtgcacaacccggacaagagactagtgggaatcaagaataaagcaacaaagcaaatgtcaaagtaaggggatgcaatcactgcacatgctcttgagttgggagatctggtgcgagaggaacaggcgagtttttaaagataaagaacttcaaatccctcaactaacggcaagaataatggacaaaatacacacatggtcggcatgtggggcaaaaaatcttatgagaatagcgccttaacctctcaccctttgttgtaattttccttttttctgctcttctcccccctgtctttccccttgtcaccattgatggcatttgtacagtgcttatctcctgaaatataaaactagctaagctggctaaggtttcaaaagaaagaattaacagtgcttgctagtttgtatttcagatgatactccactcgcatatgaagcgcccgcgtgccctcaagccgatcaaattcagtgtcgacgaggagatagattgccgagtgatagtcagctctccccgtgagctagagctacactacacatgtacttctcccaagtccagcctacaggctggtacgtagagcgatctattgaaagttctgcatattttttattagttcattgctggctattccttaacgcctgtctgtaaacccttaatcatatttgatttggttatgcactctaaatctatggtggttactgattgtacataaccgttatacaccttaatagaaaccattagttcttgaaaacacacaagaaagccatgctcatcattaatttactacatccgacataagcaagcagttcaataacacaggaagtgtatagtttatttttcagctggttagactgagttctggcagattcaggctgagaagatcattatcctcaatcagttgctct

SEQ ID NO: 36178 - DNA, 6915 bp, Oryza sativa
tatatgtggatgtatcaatttccaaaatctcaagcggaagatgaatagtctagcttttaagctgagaagtttcaactttcgacgcttctggcagttccagattgcatctacttaacaatcatgagaaacaaaaactgctgattggtcaatgtggtcaccaatataggctgcaacttgatgatgcacatgatccttgaaaaatgccacaacagttacacatttgcggctttacccataaaaatagcattgtccaacacagtacagcccatctattgactgtcaaaattaatagtagatttaatttcaataagcttgccacatgacaagttcatcagtgtatcaagtcaacaaaaaggaaaaatggcacccccatgcatattaacttacagtagtattcaaatggatattaacttacagcttcttttcaagctttttttgttatctcactggccgcaagctcctttttcttctcataatccttcttagacagaccctgccatgattatcaggactgaataagtatgttggtacagaaggccttggtctctcataattcaaagtaaaattagatggcagctagaacacatccatacctctcaatcttctatccctgcagttgtaaaaatatgaagtatacaatgttcttcaggatacttacaaatatgcttccacaaggcttctccaaattagctcagtcatcctgccaattgcactcagagtcttagagttaagttattttagactcaaagctgtactcaactttgccattttccaaaataatattggtcacattagccttgaatatttcactaatttccctgaagtggctatcgcactagacctgctgttttgcccataggatagcagaagtttaaataaacaaactaaaggcaaacaaatatggagcaacctaaccttcctattcgcccttcagttctccaatcaaaattttacatataaattgcataaaacaagaagaataatacacaactataatatccataaacaagaaaacttaacggaagaataatatacaactaaaattccacagacttcacggaagaatctcagccctcaaaaactcccttctattctatacaatgttcaagcaaaactctctcaactgaccatcctaaatgaaaggggcaagcttcccaatgaacagtagacaccagacagcttctctgatattttccttgcacaaatcaacagaagcattgttaaccttcggagcatagccacacacctttattttgcagttatctcatcaagcttcagaaggatcctttcatttccaaaattttttcacctccaactgcaaactgatgaacactgccattcagctccatccaactgcaacctttcttcttccacgtcccctggacttccattactccccttacctccttaacatcattccagtttccatattctgcatatatatttgataagagcacttgtgctccaccatgattagggtccaactccaaaattttctttgcagcaaacgtgccgagctcaagatcaccatgcatccggcatgctgctaacaaagatccccaaatgaccacatttggtcttaagtgcatggactgtatcaggtcagcagcttgtccaagaagttttgctcttcccaaaagatccaccatacaaccgtagtgctcatgcatgggctcaatcctgtattgctggaccataattttgaacaataaacggccttcttcaactaaaccagcatgacagcaagcatagagcaacccaagaaatgtcactccattgggttgaatcccttcacttttcatgttctcaaaaagggttaaggcggatcttccatcaccatgcatagcagatgcagtaattatgcttgtccaggtgacaacattcttttgaggcattgcattgaagacatccaaggcaagagtttaaactcccacatttggagaacatatcaataagagcatttccgatgggtaatatcttacacatgctatgattctccacgaaggaatggatacatctagctttttcaagggcaccaacattagcacatgcagatattacactcagcatggtaatttcatcaggtttgacaccactccgttgcatatcatggaacaaattcagcgcttccataggtttgctgctttcagcatatcctgctatcatagcactccaagataccacgtccttcgctggcattccattgaatatggagtgagcaatctcaacttttccattcttggcgtatccatacaccatggtggttgataatacaatttccttttctgacaccctattgtacagcttttcagccatttccatgtctgcacaactagcatacatgttcatgagagcacagctgacttgagcatcaataagagtatctgacaccaacatgtatgagtggatagcctttccaaatctcaagtttcttgtatgagcacaagttgaaaggacagtagcaataatcacttgatcaggaacaactcttgatctcttcatgctatgaaaaagcaacagggcttcttcatagtttcgggcctgacaataactgacagggtaatgttagagaggttatcataactatagtgaaagtccaattaacatattatacagaagtataaaaaataacagtagaaaaaatattagcacaaaacaaatgtatatatgtaaaatggtttgcaaaatacttagagttgagctggattagaaagaaatgtttctccacgtgccccttgaatttcagcacgtaacacagagatctagaggaacccacatataaatgtatgtcaaaaatctcaagtagaacatgaacagtgatgttttaaaaacgagaagttccaaccttctaggcttctactggttccccatgtctactcaaaatttacaagttgcattgctgcaagctgagtaatttcataggtcgaggtgatttcagtttatatatttttccccacaaaataaatcagtatatattttaagttccacattatttctgactatgccaagactgattctgttccaatcaggatttggaaatttcactcctgctcggtgatgataagattgagtatatggttccgatggccttaggacatactagttggactcactctgacatacagccatgcaaaacgttctccgatgtaccatgcattgaactctcaactaagcacaagcaactgaataaaccattttgcaggcagccaggcatacacagaacatgatacttacgagatagatcaaacaactaggattccataggattgcgtgaagaaatggagctgttcacagtgcgttaccagtcaagcatgacgccccaggcgacgaggtcccggtcaggcatcccatcgaacaccctgcgtgcgtcctccacacgcccgcacgccgcgtaggcccggaccagcgcggtcccgacgaagccatcgacctctgccccgaccctaaacgcgagaccgtgcgcggcccctgcggtgccaagggagcgcgcgaacgcgatggcacggagcagggatgggagcgcgcggcgtcctggcgcgggcaggcccacgcggcggaggcaagcgaaggccgcgagtgcgagacgcggcgcggcggccgcgcggattacggagatgtaggcgcggtcgaggtcagggtcggggtgagccgccggcgggaaggggtggccgcggcggaggaagtgggcgtggagctctccgagttggcgggaaaggcgctctcgaggctgcattggggcttggcctgcgtgggtagccaacgggttgagtggttgtatggtctagtcgagcggtctgagcagaggcagacccaggatttaaaagttgtgtattcaaaatgtgaagggtggaaaaaactttttatagcaaaagactaatattcgacatgtataataatcacatcgttgtaaaccactaattatatactccatccgtttcacaatgtaagtcattctagcattttccatattcatattgatgttaatgaatctagacatatatatctatctagatacattaacattaatatgaatgtgggaaatgctagaatgacttgcattgtgaaacggaggaagtattatatagcagatataacataaaattgagcatgatttcagatattcatagaattgatcataaatctgacattgttattgacaactgttcaacagtggtaacatatgaaatatatagaagatagaatatgacaaatgataagaaatcttacaatgtagaggacaactttccgatgcttgttcaacatatcattggaagaaggatccagattggcctgatcccgagtttcattttgagtctttttctttgcggcaactgtttcaaaataaacacttcaaatcaatagcaggaccttctttcttttcatatttcagacctgaaatttcaacaatatgggattgatgtatctggattcctgaccaattgaaagccgccctaaatttcaacaatgtgggataaatgtatctaaatctattgattctgactaaaaaatgtaaatcacagcacataaagaattggggacgtggaacaaacctgagacaaacagtgagagcctgaaccaacgagacaccgaaacagacagacagtgagggcgctaggcgcaagcctgtggcaccaccgacgcaccgccgctcgccgcccgcccacactggggctggtggttgctggcccagccacagccaggtgcccaggcctggccacgcgggtgacgctcgcccaggggcggcccaggattttcaggttgggtatgcgaaacgtgaaggagtaattatatagtactaaactacaaattgtataacatgaattgggtataatttcatatatttatataaatggattaactactattggccatggtcacaataaaatactcactattttgatatggcaccctaaaaggcatttgaaattataaagatgaaattgtcatgttgaggcagggacttcgaatgctgattaaaaatcatgaacaaattgttcaaagagcaaagaccatttcttttctcttcatatttagacctaaaaatccaacaatatgggaatgggattatgcctctggattcttatggaagaagaatcatgcaacgcaatggtagtgtgccgaacgcccttgccaatcagtgatacggtagctctgctgcataaattgatttactttctgtagacaggggaataatagccttaagtacacatgccaaaattatcattgctgagaggagttgcaactgtacttagatctgagtagcatcatacgcaagtaaatgcatgcagaacttgcagatcgagggaacagtgctaccggatgaatcgcaggatcaaccagcattcaacactacacagacagatagatagagattaaagcttactgttgtggctcgatgacggcggatgagtgctcgacccatcggcgctccaggggaaaccacttgagcaccctcccgtccgacacgcccgtgtacgggcggtcgccgtcgccgtcgccgtcgaacgccacgctctccggcccaaccgcgccgctggagtccacggtgatcagcacgtcgtcgctccgggaccgggagtccagggacaagaacaacgccgccgccaccgccacggcggccgcgagcaccacgaggctggcgtcggcgcgtcagcgcacagcgcactgccctgccgccgccgcctgctgcccgcctcgcccccgcgtcgcgaatcgccagccgccgtttggggagggggaaggggaagaatcgaagaaaggagctggaatgggctgagagagaggagagggggagccggggaggggaataggaaatttgggaccagaagggtgaagaaaggcccaaatgagaagtttgtttacctattgggctgtttaaggctttctttttatatttttaatactccctccgtttcaaaatatttgacaccgttgattttttagcacatgtttgactgttcgtcttattcaaaaacttttgtgaaatatgtaaaattatatgcctacatgaaaatatatttaacaatgaatcaaatgacaggaaaagaattaataattacttaatttttttaataagacgaacggtcaaacatgtgctaaaaagtcaacggcatcaaacatttcgaaatggagggagtacatactagcaaaatagccgtgatttactacggtgtactaaaactaaaaatatttctttttaaccaaagttattttcacactgctttggtacttttagcttgctagaaaaagtctcaaatgacagagagaaatatagtagctcatattaaattatttttcacaaataatttcgaagaaagggagataaaaaaaaagacaaagccggcttgatttccacctttacacggtgcaagtcaatatggactctgaagatatgggtagatctactgggtggaattaattttattaaattctccataattaaatacaatctttgaaattttattggaatttgcataagctaattttgaacatcatttcaatcttcctttctctctaggccattttcagtacattttattctttagcccatagctgagccgacccactttcctcccttcttctctcctccacctcaacccgcacatttgtctgcgccagcaagaagtctagcctccccctacttctcctctcactgccattaagcgtgcggcccgacgtgaccgatctgagccgttcgttttgatgtacggctcagatcggctcttaatccatcaaaaccccgaaccaaacaaaccctaaccctaatttccttttccccttcattccctcaccgcaggccgcctctctcggtctctccccaccgccgcctctccacgcctctccctcatcggcgtcgtcttcccgcgcccctcccccaccggcgcctctcccccaccggcgccacctacgcgcccc

SEQ ID NO: 36179 - DNA, 3357 bp, Oryza sativa
gccccccccccgaacgcgcccttcccccgccggcggcgccactcctcctcatcggggtgccgccgccgccccggcagctctctccacatggatccgacggcggggaaggtggtggaggcgtccgccggcggtagcgaccctctcccgcaaggatcgggtggcggggagggtggttgtaacgccccgattttcgttcgggattaaaaatcattaaataatgcattttctagaaattaaataaaagttaaatcaatttaatcaagtgaaataacgggagaattaaaattttcccttataaatcattggccgggaatattttgtaatattctttgtgacctaaaatactctccagatttttccgcgaattttcggaactcaagaaataattttagaagtcacaaagttcatttaatcaattaaataaattgaaaaccaaagttaaatctccccttcctccttgggccattttcggcccaagatattttccccctccttggcccgctcgcccctctctccttccctcctccctctcgggccgacccctcccttctcggcccgatcgactttccctcgcgcaaagttgtcacgcccggaatttctatccaaaattccaaacgcttacatgtgtgttaaaccctcgtccaggaatcagccaaggcacacaataacaaattgataatagagtacaaataaataactatttaatattcgcaaataataaattattacagaggtggatagttcctctcaaagaatacattctacgcagcggaaaataaaataaactaaagcaaactacggaacagctatggcaactccactccacaggcatctcaacccggaacaagcctaatcctccagatcatcaccttcactgaagtactcctcctctgatgaatgaatattgcaagaatgagcatatgacatactcaacaagccacacagcaaatatgcaagtgcacaggataacaaaggatggcataaaatagctcatttgcataaacagcatttaataaatatttaagagaatagtaaaacagttgaataattaatcagtattaaataaacaccatataacacacccgtgttgcataggcccaacctcatctgaacaaccaaccccggttgtacaaatcaaacctccataccaggaatataccattccaaaccaggagccacattaattaacacaattaccattaatgaatagtgtgagactaatcacgaaaaatattgttcaactcacccataaccgcgggcacggctattcgaatagttttactctgatcagaggtgtaccactgtacccacaagacacaatcccacaacatgtcaccatgcgcctcagtaccaccacggtaccttagaaaggaactgtgacaatacccctcgcacaacacaactcaccacagtgcaccgttcctgatcataatctccccctcaaaaccagaggcaatggactccccagcgacccccacggacttctcgccgcttcacagtctggcacactataatgaatcatgctatacaaaagataaagccgttgcccatgctggcttatggttggcacggtaaatgtttcacaacagtagctcgcgaactagtccttaattgtcatgagcacaaccatcaaaaccacatgctcacaacccacctttaaccaggttttaattatcaattaattaacatcacacgattaaccatcgtgagctaccattaattataaccataattaataataataatataatataatatatctttaatcccctttagttagctaatatttctaagcatggttaagcaaatcgtacatatagcatttggctgaaccaatccaatatataaggttcatgctaatcaaattatagcccttaggaaaattaagtcatcttcggccattaataattcgggaaaaggttcaccacccaatgacatttgaaaataatgcataagttgaaataaaacaatagctttaaacgagttcaacatgctcaaagggttgtttgggatctgtgtgacttgccttgggcttccacaaaaacctctgaaccttcctcaactgaaacgctctcctccggaacatcagaaactaaagcaaacaaacaaaaatcaacaaaacagtacaaaaacaagcataaacagtacatgtggatatttttaacatgtagatctcgattttagaaaaatttagcaacttgaaccacttgaatcggagctatggttaattagttatgattttccgaagttttaatatatttaatctattaaaaaaaactgaaaaagaggggattatgacgtcatgatgacgtcatcgacggcagccacggcacgggcaacgacctcgccggcgctagggtggtcggccggggttttggaggacacctacacgtacaggacgacgacgcgaacccaatggtgcttaccgaagcgacaaacggcgaccgacgacggccggcgacaagaggcgcggcggcggcggctcggacttacggcggcggcgggctacggcgcacggcgacgacggggaagtggcggccgggcttcctcactcccgtgcgcacctaatggcggcgacggagggcgacggcgacggcggatgcggcggcgcggcgcggctggcggttggccggcggcggcggcgaggctacggagcacgagagaactcggggaagggggcaaacgaaagaggacgactagggggtcctatttatagccttggattgaagagatcggactcctaccgcgtggaattggcccgagaaaatctaaattcggtttttggggataaatttgaaacgaactcgattcggttgaaatacccaacggtttgctccgattgttgaggggatagatagaggaggatgaggggattaaaacccctcaatcaatcggactcggggtggccggatttgaggcggaaacggcggaggaaggcggcggctcgggcgactcggcatggcagccggccggctggaggaggaagatgggtccgacatgtgggccccacatgtcggtgacccgaggaggaggggcgggcggcgtcggcttgggccgactgggccggctcggccgcgcgggaaaaggggaaagttgggccgaaatcggcccaacaacttagggaaggatttttggaactttttcaattaaaataattcgtgaaatgttgtttcatttattaaaaatacttcccttgctcaaataattcccagaaaaatctaaaaaatagaggaacaagcaaagtatttgatgaaattttatatagctcaattttatgttgaaaatttccctagattattagagtttaacttgaaggcttttaaaataatttctaacaatgatttaaaatatgcattt

SEQ ID NO: 36180 - DNA, 8118 bp, Oryza sativa
  unsure (1)..(8118): unsure at all n locations
acactctcccccacttttccccaaaaatcggcgccggtttgaccctccacgagcaccacgtcggctccggccattgcgccgattccaccttccggccacgatctccctccccgcgcccatataaaccctccccgggctcccttcccccgtttccccctctccccgaagcgccccatgcccggaaccccctcctccccgtgaaacctatgcgccgccgctcgccggcgatctccagccacacgccacggccgctcccgccaccgccgcactgcgtcgccaccaccgcccaccttgccgcacgatgccgcgccccggcctccccttcgagccctcaatccattgccggaaccccctccccccaacatcaccctaccggccgccccgttcatcgccttcagccggccaccacctccgccctagcggccgctgcgctgcgccgccgccgccgtcggcatcgccatgccgagctccaccccggcaaccgctcctcttccttcaaccaccaccgaaaaactagccccaccgcacacccgaggccgccgtcgcttttgctgcctccggccgcctactgccgccatccctgtccaccgcaagctacgccactgcctccaccacgttcgccacgtcccaatgcacctcggctgccactccaagccgccgaaatcccgccgaagctcggtatctctcggtcgccggtgagctccaccattcctctcctctccggcgtggtattctcaccgctccggtcgcctatgttcctccctaacccttctatcttcttccccagggaatcccggctgccgtccgccgcttcgtgctcgcgggtcgccatcggacctccgccaccgcccttcccgagggagcgcctccactgcccgttgcccctcgccgccccggcgcatggtgagcactcccctccatctcccctttctcctcttcggcggccacctcccatgctcgccgccgtgccgtgtcatgtcgccggtggccgcgcccggccgtgagccgtcgccgcccctctgccaccgtgtgtagccgcctgtggaccaccgtggtccgggtccacggtgccgtcccggtgcgcgcgtggacttggtccaccgtgcgcctgcctcccatgagtcaccgatgggtggggccctcttgtcggcgccacccttcctctcggctgacgccataaatggttaataattgcgtcataaatcgataattaattctagaaattcattaaaatggctcaaaacttataaaattcatatataattcatccgaactccaaattgagccattcaacttgcaaaattcatctaaaattgagctctacatgtttgtttactttttatgtactgtttccttggtttttattagagtttttcctcattttgcgtgccagcgtgtagattccgctgtttcggaagtccgcggtcacgaggaaaagagttcagaagattgttttgaagaagcaaggcaagtcacacattcccccttgagcatgttgatcctaatttataaatgttttaccgtttgcaaataaatatgcatgttttgctaattacatgggatcagggtttacctatctgctcgcttgtgccatgtttacttgatatcggtcctttgtcaaccttgggtgataaatcgactagctcgtgctacttatgtgacctagctagaactatatgcttagccatgcttaattaccactagctcagttgataggataattacagttttagacatctagtatcttgacgagctgcgtgctcgagacatctggccatggttcatggttgtaattatcaaactaaaatgcgactgaatggtgggctgtgggtgcatggttttgcgagtcgcacccatggcaattaaggaccggttcacgggaaaccctggaagactaacagtgcttaccataagcgggagtgggtaactgcttgatctgaagtatagctcgaccctttcctaggcaccggtggcgagggtggacgtgatggagttgggtcggctggggtgtccggttgtccagctgccggattcaccgcgccgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccatgcctgcggttatgggcgatcaaccagattcaccgtgattagtctcacacttaataaatcgacccaatgcactgtagttcaggtgggttggttgggcctgttcaacgtggtgtagcgttgatcagtggagatttaatattaccttaattactcaactgttttactgttttgcttaataagatgttttacaactgcctttatgcaaatagccacaaaccgtccttgtatccccttgcacgtctgcatcatcggtgtggcttgctgagtacggtggttgtactcagccttgctattattccccttttcagaagtgtagtgcttctgagctgaagacgaagttagaggaccaaggctcagaccccagttgagttttgcctgtggagtggagctgaagccccgctaggatcgcctttttccgctgctgtcgttctctttcggtgtgaggactaagtgcctcttatataagtattttacgctttatttacgtttggaactgtatattacttgtcgttttgtgtaccctggctggtcctggacagggatttaatacacaaaatagtctgaaaatttagggctaaatttctgggcgtgacaatggtggagttgcgcggcgacgacagcagcggcgaccggcgcggatcttgggtttcgggattgggagttgcagcggcgggtcggcggctccctggtggagcagcggtggcttagcggatcccgatgcaatggcgtgtcagcggaggaggagctctgtcgaggagaagcgatggcctcctactcgcccctctatctcctctaatcatctcttgattccgatttgtatttgtatttgtatttgtattttatttggattgagatttttgttttttgtttggacttggatttgtgatgagatgatgtgggattgtgaagatgttgcggacgaacgaaaatcgttgtacgggtggaaaattggtgtgacaaaaggaaaaatacaaatatttatattagttaatatatgaaatacatagtttatatacttaccttttgtccaaaaatcttggtatacatctcaataccttgaatcactagtgggcctgcccctgccgctcgccgcatgcttgctacctcctcgacctcgagtcctcgtagcttacggagctggtggtcgggcgacattggggacttgggtcctggccggaggcgcgtgcggcggaaagccgtcgacgtcgacgcggcgtgcggtgcggctgcgttgggggcggctgtgcgggtgttgctgcggcgttgggggcccgggtggcatgaggagttgggagagaatgggagggagtcaatatgtgacttttgggttgaagttggccacatgggccagatttagacaagggaatcagggttttttttcctaggacgattggcttttttttttctgttcgtggtttaaatacgagaaagctaattggcggcgtgcattctaagcccataaggcgcatgcaactggtgcgtggctgattcgtccgtacttttttttccaagaaaaagctaatgtccacgcgttttttcatttctttttgccattttttcttggtttttttattttagaagttgaatctttcatcagttgaaagtttttaagatttgagttgaaagtttttaagatttgaagttgaattttttagatgaaagtttttaaatctggattgaaagttttgaattttgagatgaaagttttcaaatccgagttaaaagttttcaaatctttagttgaaagtttttaatcttgagatgaaagttttcaaatccgagttgaaagttttcagtcttgagttgaaagttttcaaatcttgacttgaatttttttcaaatctggatttgaaagttttaaaatctgagttgaatttttttaaaaattcaaattgaaagtattcaaatcttgacttgaaaattttcaagtatgagttaaatttttttaaaaaaatcttaacttgatagtattcaaatttgaacttgaaaatttttaaatatggacttaaagttttcaaatcctaaataaatgtgatttgaaagtttgtttcagtgaactgaaagaaaaagaaaaaacacgcacataaggaacttttattaaaaaataaagcgaaacaaagagaggtggatctaagcgctaagcgctattagcgtggaaaaatgcgcgccgtctccattcctggcgtgcacgcgcggattaggatcccgcgtataaatattaccgttttgttttcattttttcatgttcactagttagtgaagtcgcgcgttctcgcgaccatgagctgccacctctttttttactataacggccattggtgttaagtttactgataacatctaattaattaaatgaaccggatttttttttctctaatctgatcaacaccctcaaaattatgttgtaattgaaatgaaataattgtaggttgtctaatatctaaaaatactactccgtacgtatttaatgttgcaagatagcggtgcagatcctccccgccataagcaaactcgctgatgtagaagcagaggatagcaagaacagctcgcttagctcctctgtctgcattggttagtgttgatcagaattcaagatcgacgcagcaagtatctgaaactatcccctctctttactggatttcagaatggaggttgtaaatccatgcaaagtgtaaatgttattcaggaaaggtaaacagcagcaagcatgcatttgttaaaatataactgataatttcaacactaacaaatttagcgtaccaccaatttccagattagctgtactgtagaagtaatatgagagaataaatattacaaactttttacttgttttagtgcacctatcaacctctgatatctttaaacaattactatgtgagaggataaaaaaacattatgtcagaagtttcaaaagtttatctttgtcatattttactataggtaaagctagcagatctgtcttctactaaaactgcacgtagtatcagcatgtaaattattatttgaaggagatggattgggtgctcgacgggagggcgaggctgctgcagcctcgctgccccggagcctaggtgaggccgagcagagaagaggggagactagagataggtttaacttctttcttgattaattccaaatgactgtggtgcctctccttatatagagccggctcttaacaaacatcctaacaatcttatctaataaagcataacaaacctcctaacaaccttatctaataatgaggggctgcataacatcttcatccctccttcgagacagctcgtcctcgagctgcggtagaagccatgcctggaggttgaagggtgtcggttaaccacgtcatcctagtcccctttccctcctccttcgaaagcagctcgccctcgagctacaagctagtctgcacacgatgattgttttggcatctagactcatcccatattattaagccttttacatctgggctccgaacattatttggaaagaaaaataaatctaaaattatgttggtggtccctgccattcttccgcagccaagctcaggtgggccccacccggaagcacatagaggaaggacaccagaaccatgcagagaggaaggcgccaccagaagccacatcgcacgcgccgcacatgccgcgatcgccgcccgaaagtgcggcttgcgtggcccgcctagatcccacgccggtggcgccgcactcgattctccccgccgttgagcagcgcgtagcgtaatcgctgtcgatgctcgaggaagctgcttgaagatgcctcgctgccgtcgtggtcgtagaagggaacggtcatgacgcgacaagatagtctcccttggctgcgacggggttgatggtgccccaggaagtgccggcccaactgttgttaggcagggcagcactgccgcagccttggatgcaaacgacatctgagaagatggtgcagcaacaaggggctgcagcacctccgccgggtggggcaatggcagtggagaggacgccgtcatcaccgtttcctctactgtagccgcgaacagggacgatggcagagaaggtggcgccgtagcgagtggctgctgcacctccgccttcggcagcgtcggcattggagagggtgttgtcggcgtagtttccaccgccgccctcttggcctcaaaacccgcgcggagcgctagcaccaactctgtcaccttgtcgtgcccagccgcaatttctgtgatggaggtctgcatggccatggaggttcggcgcagtgtgtggagggcatggatggcagccatggtagatggtaaatgatgtggcttagtgggtggcaggatcgtggtcgtctgataccagatgttatgtgggtagatggattgggtgctcgatgggagggcgaggctgctgctgtcttgccgccccggagcccaaattcttcatatatgttcttgtcagtcaggatgttagatttgatatttttgagaaggccagatggatcaagtagagctcattttttttcttgtactaaatagattgaggtgacatggatattagctttaatcttagagctttttgaatgcttaggacatccataattaattatagtattatatttctaaaagttaaagtttgggtctacacacaaatttagcacctatagacgaaataggggaaaattgccaaagtttggaaagttacgggtttccttcacagggccggtcagaccacaggtgtgtgggcggtctgaccggcttgtagggccggtctgaccgcaggtatgtgggcggtcagaccggcagggtccgagtccgagtctgttttcgtcaggtctcgggtttccttgctcgggaaggtatgtttcgtgttttctttagtttctattccgagttggacgtggagaagggtttgtagagggcaagaccaacccctatttaagggacaaggccgattcattgaaaaacccccgaatacactctacttgaatcgttcttttactatgttttctattttagcctagttttagtccatctttgtcggtttgcaccgtaaaccgtccgccgccgctgcgagagtgcgacacctctttgtaggtttatcctgaaaaccttccgttttgcccacgagacgggtagttatcctcatatcgatctaaatcggcctagaggctgattttgatctctaaatcggctttgctagccggtttagcttttctttttgcaaaacccatcttgatttggccctttggctagatcgaggtggttggcgactccacatcaccgcaaggcgtttaggtgttgtgatcgtgcttgtcgacttgtcaaaaaagttgccaacacgatttttggcgactccgctggggaacgatctaatcggccatatcacggccgaatttcgtttaatctagtagttaccgtttcatcaaatccaagtttcggctaaacggccgaaattaatctagtatcgccggattaatctaatcggcggcgaggttatttggtcgtcactgaatccatctgaacacttgccgtgtgtattgaagatcatcatcagggagcagcagccgactcagcaacctcctttccttttgtttcacacggcaacagaggaaaagatcaggctactagagccgatctgctgagagacaagcagcaggagcattgtttccttttattactgtatacgtgcatagatcaaaaagatcaggctataagccgatctactactgttcacattaaaaaaaaaaagaaagacaaaaaccgattcaatttgtatcggttacactgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36181 - DNA, 566 bp, Oryza sativa
tcctgcagccctcgttgaatcgggtcaattgctaggatgaagaggtagggcgagaggggatcaccctgccaaaggcctcacctgtgtgtagttggttctcccactatcccattgagtaagattctagatgatgcagtcgataggagaagcacaatccaatttctccagcgctgactaaagcctctccactgcagcatttcgacaaggtattcccaagatatcgaatcaaatgcctttgttatatccaacttgaagaagagggatggtttccgttgcatgtgcaaggaccggatcatgttgcgcacatagaggaagtaaatcttgtatgcatctcttcttgatgaaagcactttgggcatgcgagaccaaatcaccaagccatgctgccagtctcattgccaaagttttggatataagcttcgccacagagtggatcagactaatgggtctgaaatcattcaccgagcgtggcgagtctttcttcggcaacagtgttatcatggccctgtttatgcttccaaagttcccccctgtgaggttgtgaaagcttgcaaaaacatccacaa

SEQ ID NO: 36182 - DNA, 14124 bp, Oryza sativa
aaacggatccttggagtttctttactatccttaggagttaggaggcattcaaaggtaatgtgtattttagtgttaatcatgaggtataaaaaattaactctagggtgaatctctacctcttgataactcccaaggaccattgaagaaatcattatgcgaacgttaaggttagttcaggaaatgaacctaactgttgtgaaactagagagccctactgctttatgaacaactttttgaatccttgcataatgataaagctacctttgttcatacatgtgatcttcatagcgttaagcaattatcatggatgatgaagcaaaaatatgtactacatgaaactacattttggactcgcaaacattgtattatagcattattagttaaaaagcaccggtgctcactgctgattttgattttgagacatgttgttgccagtactcgcacaaagaagctggttaattatgcaaggcaagcagtactccatgtccatggcatgttaagtacgattggcactagataattgagaaaatctaaggaaagataccagcataggcactagctcttgctgataatctcttgtcaccaagttaatcagctaagcaccaacaaaaaccaaaagaaaatgtctcatctataattactgcagtatgaactctctaaacatggaattcttaagatacagtgtgtgaactgagaagcacagatatctccaagcaacaaagcaacatgttcaaatccaagctcatgttctggcactatagtagaatggaaagtacttgcaaattactgaggtcaaagagcccattttgggtgcaactttgaattgaccacctccaactataataactctatgtgaataatgtgactagttttttttccgtcctcatctccaccggaacagctaaaatccgttttaaaggtacagaaaacatagaacgtgatacctaaaaaatactgtagatgacgagcggcatcaccatgactacccctgcaacgaaatgcagccatctaagaaggggaagagggaggatttaccgtcggtgacgcctgcgccccgggaggtagataagatgccgaagccctagcggctgcagacgcggatcgtacggcagcggaggtcggtgccttcgcccatggagtgcaggagacggggggttagggttcggaggggatttgagttgaaggagaagttcgtctggagccattggaggaaggatccgagctcgccggcgccggagatgacggcggcagccacggtgttcgacgaaatgcgcggctgatgttgagggagcttgagatttttgcaataagacccctgatcgtcgatcaggaccgctaccaatggtaataacggtcgttgcttttcagatcgacgttttaagaactatttttttccaaaaaaactttagggattagggttagtaaaaactgttgaattttgagtttctgacagaagacgaaatgggattggatctataaactagaataatcatcgtaatattctttgtgcaatttataaaattcggttcaaaataaaaatgacgataattatatatggcattaagtgaaaagatgagtctagctctagtttaatatgaaactttgataaatacagacggtccaaagtgaagtttctcatgattttattacttgtagcattagaggaagtttaatagtatagccaactactagctccaaatcatctatagccaatgtaattatacaatagttgcttactatactattaatacctgatcccatctgtcatacacacattacggtttggagtccgtactgcaactggctacatatatatagaccgctgcttctctctctattcatatgtttaaaatatgttcatagctggcttatattgtacatgctcttacttgctcccttgtagctggatatgtggatacttctgtcatgaaactgcatcacctgacactatatgagctgatctacataaactcctgtatcatgatggcgtgcagaatgatctggctgtcttcatacttgttggattgcacataatatgaatagctaaaacattttcaatgtgaatgatctatcaggctctacattttgtgagccaacaggtgactgaaatgctacaattcattaccatgattgccaataaatgcttgatttttttttaatttgatagcctttactctccttatgatcaattttttacatttcgggttactctaactgttaacccataccttaatttgcctaataaattaagtattgtacatggcttcgttttccttctcaagttgttgttttgctacaatttggattgtaaattaagctgaaattatgagaacctaatctacaaagtttgcaagtacccaggtaattaaacgaacagttcaccaagctgtagttcagataatatgcagttcgaataatatgcattgaaataaagtatcagtttcttgttaaaggtataaaatgttgagaatataggcatataatgatttaatatattccataaataaatcatgacattacagatgtatactagcattaacgcatcattatatctacacatgtaaactaagcagtaaaacatgaacatatcaaatatgcgcaacatgtcgaacacgtaccgaggtggcggaaagaccggttgctcggcaggaactactcgcggttgcgagcgtcaacgaatgcgcccagcatgcgagcggagaggaaggcgagccgtcgcggacgaacagggagcagtcgcgcgaagcgcttcccaaaaaccttattgccgccttctctcggtgcaggatgtcgaaggcagaggttccggagacctgctctcccgatcgctggtgcacgctggcgagcgggatggagtagtctacgagcgacggcgcaacacagaggaggaggcaaaccctagattgatttcgcgtgtgttgcgtgaaggcggcggcacggtttaaatagagataggtcgcttgatcagggcgcccgcatgatctccactctgcgtaaccgagccggataagtcgcgcgtaacttatccggactccacgggcgcccgcacgatctccactctgcgtaaccgagccggataagtcgcgcgtaacttatccggactccacgggcgcccgcacgatctccactctgcgtaacggagccagataagtcgcgcgtaacttatccggactccacgccgttttcacgcaccggatttttcgaaatgtttccaacaacaaaacaaatccgaattttcctgcagcaaaacaaaactgcaaaaggagactgcatatgcgcaagggtgaggagccaattttgcgggcggaccattcaacgcgtacgtcgtgcacgcgcgccgcttgccctgccagaccaggccagtgagcgcgcgcgtgtggtccccctcttctctccaccacacatgcttcaagtggctaggagggcatccttccttttaaggaggtcccctctcctagaataagcaaggtgctactaaactccatatgcatgccatctcatgaggtgggcttttgtgattttcaaagaattaatcttcgaatgggccttagcccatctattaattccaacataaaatatacggaagaatctcctctgacataaagttagatggacatgtaaagttaaaaagatttgggtccggggcccaaacatttgttaagaaaaaattgtgagtgttagggattgaatattggaccatcaagtgcactttgaaaccatacaccatttgccactgcactatcaagtgcatctccacatatcattatattacaaagcaaaccatttatcttttgtagttccattttttttgtgaagtatattattgtcgatggaattttaggtgcataactcatgtttccctgtgtgcatgcataggtgatttacagtttttgcttacattcttacgtaactatttacatggaattgcctgttcgggcccatggtagaaaaaacacagtaatgcatgtaatgcatatgctaagcttaggattgcgaaatgcatgagcaacacaagaatttggccttggattggatgaaaacccagaaatgttttaaatgttatatttgtatgacacagaaagattgacattaccctgaatcctggatctttggaacgaaatttcctacaaaaatatataaattcatagcaatttttcaaaggaatgggtaaggtgaatccaacagtccagttcctctgcaattccccggttcttcttttggttcattagaaaaatgttggaatttcacatgagtaataaaatcctccaatacagtacagataggaacttttttttaaaaaaagaaggaaattccaaggtaagaacaggcctgacttgagtactcagttttccacgctagtaaacagtaaactgtaaactatagttttccacccagatagtagctactaagagaaggaaaaccaaaaccaaccaccgcatgcactataatatgatgttgacccactgatggtgatgctcgtttacctgctaatttgtttcttttaagttagtgattgtcattctataacactcatctctattatactatctgctaatctgctatatccaaagtctccgttgtcctcaagtccacctcggcgggcttcatgcaagctgcaagcattggcatctaaatttcacccaaaaaaagaaaaaaaaggaaaaaaagcagagaagttagcctggcaagtgacaagctggaaaaagagcaatcaatttcagttgaattccgttaccgaagtgtttaaacttgctgaaagtttagcttgcatggtcagtagttggtcgctggactggagcaactagaccaaaataagctaagccatggcggagctgggccgcaggtcgtcggcgccgtgagccgcagcatcgccggccgcctgctcgccgacatcgacctcgccagcagcgtcggcacgaacgtcgaggacgtcaccgacgcgctcacacggctgacgtcgatacgggccgacctcgaggcctccatggggaggctgccgcagcggcggcggccggaggaggtcacggactggctgtcgcgggtggacggcgccgagaagcgggtggccaagctccggcgagagtaccagcgccggtgttgctcctgcggcggcggcggcgccttctcgctcaacctgttcgcgagctacgccattagccggcgcgcgtgccacgagcgccaccgtctcgccgcgctgctcggggagtgcgacagggtgaggagcctcgccgccggggcgccccggccgtcgtccggcgccatggtcgtgccgtccacggtggtcggcatggagggctacctcgaggaggccctggcgtgcctcgacgaccgcgacgccggtgtcgtggccatctgcggcatggccggcgtcggcaagagcacgctgctgcgacgcatcaacaacgtgttcgtccaggaccccgacaggaggcacgagttcgactacgtcatatggctcgacgcgccgggcgactgcgccgccgtgggcaagatgcaggacgccatggctcaccggctcggcctgtgcgcgctcccggacggcggcgcgccggaccaccgtgcgcgtccgatctttgaagtcctcagggactcgagcttcttgctgctgctcgacggcgtaaccaagcctgtcgacttggtggacatcggcgtcccgcacctcgtgcacgacgatcgccggaggcagaaggtcgccatgaccacccgaacaaggggagtctgcggcaggatgagctcgtcgcgaaggattgacatgcaatgcttggacagtgaccattcatggcgtctgttcagagagatcgcccgcgacgagacgatcaacgctgacccgaggataccggacttggcgaaggaggtcgccgggaggtgcggcggcttgccgcttgtgctcaccgccatcggcggcgccatgaggtgcaggaggcagccagaggagtgggtgagcacggtgaccgcgctcaggaacttggagctcgccaagatccccgggatggacgccggcgagaagccaggcgccatgctgcgatcgctgcaagagagctacggcgacctgcgccatcccgtgctccagaagtgcttcctcgccacgtccctgtggcccgagggccacgccattgacaagggcgagctcgtcgagtgctggatcggcctcgggctggtgggcgagtcgctgccgatggacgaggccgtgcgcacggggctcgccgtcctcaacgagctcgaggaggccaacctgctgctgcccggcgacgccacgggcgaagtgaagctgcacggcgtcgtgaggggcgcggcgctgtggatcgcccgtgacctcggcaaggcgccgaacaggtgggtggtgtgcaccggcggcgtctccctccggtcgaggcagaagctagtggagttcttcgagcgcgcgcgcgacgcggagcgggtgtccgccatgcgcagctcggtcgagcggctgcgggcaatgccgccgccgtcgtccccgtgccggagcctctccgtcctcatgctgcagcacaacgcggcgctgcgtgacatccccggcggcttcctgctcggcgtgccggcgctcgcgtacctggacgcctccttcaccggcgtccgcgaggtcgccccggagatcggcacgctcgcgtcgctgcgttacctgaacctgtcgtcgacgccgctggagtccgtgccgccggagctggggaggctgcggcagctcaggcacctgctgctgcggcacacggcgcgcctctcggcgttccccgccggcgtgctgcgtgggctgccgagcctggacgtcctcgacgtgtgcccgagcaggtacaccgagtggtgcggcgcgggaggaggaggaggaggagcgagcctggacgagctgaggtcgagctcggcgttcgtccggtccctcgggatctccgtcgcgacgctcgccggcctacgcgcgctgcgcggcctcgacaacgtgcgcacacggcggctgaccgtgacgcgggtggcggcgaccgcgccgtctgtcgcgctgcgcccctccatgctgggcctgctcgaggccctgcacgagctcaccgtcgccaagtgctccggcctgcaggagctggaggttgtcgccggcgaggaggacaacgcatggtggcgccttccggagctcaggaagctcgagatcgatgagctgcacgagctggcggccgtgcggtggacgcggacggacgtcggggcgttcttgccggcgctccggtgggtgaagatctcacactgcaacaggctaaggaacgtgagctgggcggtgcagctgccatgcctggagcagctggagcttcgccattgctcggagatggttcacgtcgtagacattgacggcgacgacgaggagcagcgacgagagcacccggagacgcgcacgttccgctgcctcaggaggctgctgctggtggagcttccgtcgatgggcagcattggtggtggtgcagcgttgagcttcccttggttggagaccctggagatcgccggctgcgacagcctcggagagctacctgttgagctgcaaaaaaagttgaaggagatttgagattatgttagccaagctgtgaatctgaacattgttcctagcatcttaaagcttaagaaagaaagattcactcaagaagattagtctttcatataacacgcgaacagtgcagaagtttcaaacatcgcaatacatttagctaccccttatagctcctttaattaatagcctaacaaacgtaatgccagaggcatcaaaattctaattctagagccggatagcccgggctagcttctgattgtgtggcaattgttctagcatcttacacatttcacttcagaacctattctcatggaaccagctatgaatgaggggttcagaagatatatttcacaaaggaaattccaccactcttccaactttccaaagcgggccctacacggtgttgcatatgtcaacaggccatggtgaggatcaagatcttgaggtgcatcatgcaggcagcacactgcatttccgatgacatcctgatgcagcacacttctgtacagtcaatgcgataagctgctccagtctgatcattcttcatgcctcagatgcctgttcaacaccagttatatgagctatgcaggcaaaaatggtagaacctcgcaagctgctgtggtgaggcttctatggaaatcatgagcccatcaaaaggtcaccaaattttcttgaatacacacatgactgcaaggtagagtaaaccgtaaggtataatagcaaatgaaaaactgtagaaggctgtaacagaaaactgagaaaatcggctagtcgagagactccaggattgttagtgccaataaaaagttacaacggtgtgtacactaaaaaaacaaaatgttagacctaacatgccagtataggacagttgcaccaaccggcgaatgcatgagcaacagaaaaatataaaaagaaaacaatatggcagcattgtatcataatttattcaggcaacattttggatgagtgcaataagactatcacaacattaaatatatttagtaaaccatgctttaaatattgaataataaaccaatccatagtacctcagtggttcagtaactagaacaagatgtcaattgacaggctaactggtcattcaaagaccacaactgacaatactaggctttgttttctgtttgctcgtccaatgaaaatgaaataacaaacatgtaacaattaacaaacttacatattaagagggcagcaactgctaacacaattaattgaacaggacgcccataccgaattcgatatcgcgacctctgcagtcgtctatgcagggctccaagacaaccataaagtttcttattgtatgtactctcatcacaagtacttacacaactcttgcttctttcaaagcatctatccgatccctacagaaggaaaggccctacagcattagagaactagaatgtattcaaatgaaagcattgttggacaatgaatatttgcactcctcaaggatgccatctgtacctgacccatctgagaactgagagggattgtctcttccacatcttgttgatcaacagcggcccatttcacagatccaccttttttcttcgttctaggcttagattgcaaggcactcgtcagtgcacatgttttcactatcttcagcaaaggttcttggtgcttgtcatcatatggtaggtcagcagaactctcgctctcatttggacataacatagtccatgacccgatatcagcatgggcactagcagcccttctgtgcccacgatgcgtttcttcctttactcttgctgaactcaactcagcggagccagaatccttggagctgtcagcatacatatcctttttaaccattgctgcattgttgcccacatcaatatcaccaacagatggaattgtaactactttgtctcgctgttgaaaagagcttgcagataggaaggtagcaagatcattccgttcatcctcatccaaatcaatccagcttagggcaccccttccctctgcaacattggattctttcaaattgttctcaacctcaagtatgcgacaaccgattgccgcaacaaagtcatcatgccgtgcttttgtgtcctttccagctgagaaaaccttgtcgtttgatctaattgcccgctccaattcatctagctagaaacaaaacacaactattagactcttttgccatcaattttcaatataaaatccctgaaattgaaattaacacatatgggacaaattggcttctcatattcacatagatcagataggaggggaactacattccacttagggctcaaagcaccttaaatgacatgatctacataaatgcaggttttgtataataaaaaaaaaagttctcatttaccacaattcgtaattggtaaaaaccatgattttcaagaagcaaacatcagtggctcataacaacaaacaaatcataccacgttacgtgtcttcctgctctaagcaatgaactatgtttctaggtatcctaataatttagaaaattaggggcaaaaggcattcgtcaaccacagatcaccacgacacagaagagcaattaccgccgatcgtgccatggctagacgctagtatacagcagagaaatggatgtcgagagagcaaccaattcacctgccacttggcggtgccgagcgcagtgtgcagctcgcggcggagctcgccggcagggagccctcctccacccacggcagcagcagccgccgccgccgccgcctccgaatcgcccccactcctgtcctgcacccatatcctgtacaccgactccatgctacagagacacaccgagaatcaccatcagatccatacgaacgcgacgaacccccaaccgaaaaaaaaaacaaaacgggggaggagacggcaacgcaccggtcggcggatccctgcacctcctcggcggcggggaagaaggggtccttctcccagcggtcgaacgacgtcgccatttgccgaaggcgaagaaagggggagacgagggcaacggaaagtcggaaatggccgagacgagacgagacgagactccctcgcgttttttctcgtggtggccagggcgcgggacgctgcctattattaactggcgaactggcaaagaagaggggatttcactgccggtttctctgaaaacggcaaaacgcttacgctttttcctctgaaaaacggcgaagcagcaaatcccaccaggaattgatctgcgcgttactacacgggaaagctcctcgtttcgttgaattttattggcaacatttaggcaaaggtgcgtggttggagactgctgttgccttgttggcttattgcttagtgctcgccgtgtcgttttatctcgtgctgtagcatttatccgttatttattaagcaagggctgtgttttttttttgcttagcttgtcatacagcaggtcagcaattgctgatccatggatatcttccaagttcgacatttgcatcacgatgagcatatgctgtctctgtattgtgtagatttgtagctgatgacagcttagggctatctatggttttccctggtaaaccaacagattgaagataatttgattgttacaatgcagtgccttctatatcaaacgaattgctggttcggatgagtgaaggcattagatggaagacagattccctgactaggatttgacaggcggacgacaacaaggaacacccaagtttgcatgttattatcagataccggacgaaacaaaaagacaaagttgaactgtaatcactaaaaaaaggtgagtcgaatagctgcactgactaattcttgacacgcatatgaaaacagttctgcaatcacgacatcaaagaacatcagcagcttgtctgagaacccaactggtcaactcacatgatcacatcttcagttctgtcgtccatgttccctgaacactggggcgctttgttacgtgtctggttctcagcttcaccactttcctgcccagagaattccttagcctggtagcttgcaatagtatgtcctcgggcgctaaatttcggacacaaacaactcgctcattatgattttctgcacaagaagaatgttgattagaaaactgaatgtcataagcttcgtttttctcaaaaacgaatttgttgtagccatgtaaacacaaccatgaagaaacattaataatggaacaagaaaaacagtatggctgtttggttcaaagaataccctcattcctagagtcttatcagatcctacatgatcctgtttggttattagaacgggaacatgtgaccaataaaaatttgtttggttattgcaatgggattaacctcattctttggattgaaacaatccaaaggtggatgagattatgaaaactcatggaatgcagttatccacaagggcacccattcatccaagatgggtgtactaattgtggtcaaaatgcattcctcaaattacaggcctcttaacaaggttccttcggagaaaaatcacatagtacaaccataatgatgtgtttaaaccaatgacccaatgtccggtcatcaattcacagataagacagcggcctactgatgttttgcatcttgtcaaacaggcgagactttgggtagacaactactcctatagtatggcattttactcagaatggactcaaagatgtaattcagtaccagaaagtgatatccttatcagtaacagcaataaggctcctatagagttcctggtaattttacaatggttggaaaacaagggagaagatcttactgtaaatgcccttcaggttaggatgctgtccacggactaactctgtcaccacctctaagtgggggttcttttccttaaaagctggaagatgcgcctccataaaagccctgcaattccaaaaatcattttcatgaaggagcaaccaaattaaaatatctaattgttcagacatcaacttccaacaacacaagtattggcaaaatgacaacttccaaatgtgtaagctgggaaatcatacaagtaatacttgaattatagcatattgatatacacaaagagaggatataatgtgaaaattactgtccagaaaaaaacaagttctcgaatgtcggccatgatcctaacgtggcaacgagcagcttataattggctctaattgtgaccaaactgcctaatgtctagctctgatttctctcatgtctcggtatgataaatgcacatcaatttaacttgcaacaattgaacattttcccaccagggcaatatgtatgtatagcccttcgttatgctttatccacaaagaattgaacgaaagtgcaaacctatctccgacgcacagcaaagactactcggggtaatcgaagacaaaaagaacagttcccggatctaaatcaattcccggcaacaaaggaaatccggaccagatcatctaggaggcccgtagtatcatcacggatgagagctatacctgatccccctgctgctccctccccaatcgcagtagttcaccacgagcttctgcagctgccaaacgcccctcagcgccatccctgccgccgccgccggggtcgatccaaaccgggagctacacggggactccgcttcgctgcacgcggaaattcggagaccccggatgaggaagacgaggatgcaagcggacgaagccaatcgatcagtccttaccttgctcgccgccggcgcgcgagttgggggaggagacggcgaacggaggaggagacgacggtaggaggggatacgcttcgttgctagggtttagcccagcgggagatgcaaagagtggagctgggcctcggtaggccgggctaagaccaggcccattttatccactagcctagggctttgggcttgggccatgggctgtacagatataatgtatcctaacgattctgtacaattatttagagaaaatccaaaaaaatcattgacaagcacttgttccaaggaattgttaccaacgagtacgagttctatgaaatagtagtagcatcattttagaagtgactttgtccaaaaaaaaatatcatcatcaatagggttccgttagtagttctcccttaggtgctatagattatagaataaatagtgtatttaacgatgcgggatggtaagaaccctaacggtgatatcatttctaagacaaaattgcttatacgatggcatattatgaaacttgcatttgtcaatgaaatttcttagattttggtgtttattatcaatagtatttcttggattttctctgtttttaagtggacgattccgtgctgtcgcttgaagttttcccgaaatgaactggctggtactgtgcataccagtcatgagcgcatggaatgatgcaaataaacattatctctgaatcttttttgaaaagagattatctctgataatctgattatagactcggcactttatgatgtgtttcaaaatttaaggatgttaggcaccgctcagcagcaacgggacctaaggcgcaacatgctacaacttttgcgttgcctcagtagaatagaataaaacaaaggagcaaatctgcaacagatttccagtgcaatccaacagcagcagatggcgttccgttcatgttacgttctcattctgcagtcttctgctgccctcacttgttcaaagta

SEQ ID NO: 36183 - DNA, 3284 bp, Oryza sativa
atcataggacgagaaggaaatgcatataacctctggagagacaagatgcctattttctggatttataaacttagaccaaggtttcctggtatgcctgtgtgtagagcaacaacaaatgtatcaagtaattttttttttactaatccaaaatgtgatatgaagtgaaagcatcagaacaaatattctacgaggtaatacctcccaatcagagcctcaagctggggatcaagtgcaatcctgtatttattcaggtaagcattaagctggtctgtacctagaacctgctcaggtatagttcatcaatatgctaatgcctgcaatattttcaggcagaaagcagagcagacatatacagatacaagtgcaaatgctcagcataaacacatgcgcatgcgtctatgtgaactgtagcaaaccttggctattttgacaagctggtcatggttatcgtggccatagaagaatggttccttgcgaaatatctgcatcaaaaacagtaaataaagcataacagttgctatctttctatacgcaagtaatttacagaagtaaggccatggcaattttgataggttattttataatcataggagggcaaacacaccattccagcaaacatacagccaaggctccacatgtctaaagagtagtcataactttggaagtcaaccagcaattcaggccctttgaagtatctggataaagaaaataagtttgcagataaaactatccacattttcaaatataagaaaacttatatagtcttctaaaaccaataaatttgctataacactggtaacagaggatggattctgcttatccataaaattagcaaattcaaaataattattttgctaacaaatattatgcagaataaaggtaacaagcgatggcataaggctatgtcacttcagatattttttattgaaataacaaacgataatccataaatatgaatatgaaactaataggaagctaaactagtcccaagcactctataaataatgttctataatggaaatttagatatcttcttggggttaataggatggggtaaacatttaaataaacaggacaccatcaattgacggagctacagaatcatgaaggcatattttatgaacttgccttgaggcaacccgaacattgtactctttctctggaaaataaaactcagcaagtccccaatcaattaagcgaagcttgcggagttcatggtcaatcataacattgtgaggcttgacatcgcggtgcataattcctgagaatgacagtaatccaatgcctggaaggtaagcaggacggaatttaaaaaaaagataacaggagattagaaataagtcctggctactaaatcgacgaacaccgaacaagcccaactgaataacggaagccatagaagggagattattgaaactagtaactaaataagaatataatagaatgttctgtaattaccacatatcctttttgttatcagtacattcacataaacaattaggtagactttctatgttaccgtctgacatgaaagaaacaaactttataagtggaccatatatgcaagactaatcaagcagaacataaagttgcaacatttgtttcagcctctaattcaaactactgtaggccatagcattaatactaagtatgctagagagtcaagttaatcaatttatagattaatgcatacagttctataagacattcaacattgcaataaacaacaattgcatcatagtcactatctaccaggcatagcctttccataatgccatcgtgaaatatgttaagctaatgccacttggaacaaccacaacccacaactccacaagcacaattcaagagcttgttattaagtccatacatagccaatggtcaccatctgaaggggtatgtacatacagatatttcaaactatcattgttagactaaagcacaaaaactgatttgtaagcgtgaacttattgtagcacaatggatttgggcaaagtttagcttaatatggtgtgataggaacaatcagacccaagtattgacaactatattcatcacaagagctgaaattttcaacacttctactaatgactaaattaaaacagaagcgctaccttaagaagttcataaatgtagaatcgaatatcatagtctgtcaatgttggatacagaactttgaaatctgtgctgtttacatattcaaatatcaaacttggagtttttgattgttgatctctgacaatattgtgaagtttgacaatatttggaccaccacagaggttctgaagaatttttatttccctctttatctgcaaaagaattaaactgctcatatataatagcacagagaattctaataagcacatgagcaaacagagaacagttcggaagaaaagatatgaggttaaatatccaacaaatgagcaaaagtgagatcgctcattgtagtggaaaggagcacaaaaactaaataataaaaactgtagttaataataatctaacttcttaagtaccaccatccatacaatctagtaactggattcaatgaagtaactgaattcaaaagtaccaacagccataaaatctgaaaatggcacaaatggacttgaacagaattaggatgttaaaatttagctgatttaaccaaggaacaagtcagcgtttagagaagtaggcaatgcaggtttgatccatcaaactgttccaagtattgagtgtgtcgcgaggaataatttaagcagaacatccatatatgttaattttcaaagaaaacaaggataccttctttttcttaacaggcttgagaattttaatgatgcagcgctcatcatttgtcacattaattccttcgaagacttcactgtatttccctctgcctacctttcgcacaacctcgtaatcatcctgctcactgaatggagaagaacaatccattggtaacagagcataactaaaagaaaataaatagtttgatttttttttacttcacattcccccaagttgtcaattaaaacagtcaaatagatattagcaaggtagaagaacattttttaatcatgataacaatatatggtcatgtaaatgctgtctattatccagttaggcatattggttggtgcaaatctagtttatttcaccaaaacctcctctggccatacattgagataaaatggtttccctcaatgaatatatttgtgagtgattttagtagtgtagaatgtagttccctcaatgcacacacaagctcacatgattaatttaggcagatgacccaccaaaaaaaaagg

SEQ ID NO: 36184 - DNA, 2823 bp, Oryza sativa
  unsure (1)..(2823): unsure at all n locations
cagttgatggatttggacggtggtgttcccgtttcacgttggtccgtgggccgcccgcgggcctcgtttgtgcatgccgtgttgcgtcgaaaacgtgcggtgcggtttggcggcgattccggccccgatagaaagtttcggtgcggcccggtttcgacacttcggcacaaaacttcaaaactacgatatatttcatctaattttgttagatgaaatatatcctactacgaatctgatatgctaaaatatatctcatacaatcaaaacttcttgtattttggaacaaaaggtattttggaacaaagggagtattgtagagcagaaatattatttgctaaaatgtggtctggtagatattagctgacatagtttctcctctttccaacttttactccctaattttttgcgtacacgttttcggatctatactacctccgtttcaaaatatagctacgtctaccgtgcatagtctcaagatgaagttatttcttcacctatcatctcctctcaatcaatcataaccattctccaattgattttttttcacttttctcttctcaatcaatcacaacctttctcatttacacatatttcaatacccatagacaactcagaatcttacattttagtatggatgaaatatttttttgcaaaaaaaatctatatgaaaattactttaataaaatcatatgaatctaattttcaagttttcttagctaatacttaattaatcatgctttaacgagtcaccctattttttgcacgggaaaaataagttctcaacctcggctaacaaacacagcctaattccacataaccgtcatttttgctcattaagtgctcgtagggtcaaaagtacagccctggtactacacttccctgcgatcagctggacaagaacctcttcgttggggcaacgacaataattctgggggacgggaaaacaaccagcttctaggactcgcactggctcgagaataagagacccgaggatatcgctccagctatcttggcggcctccaaacaaataaccaggactgtgcacgaggctcttgcccttaacacctggattcgggatattgacctactgcgtactatagatgcagaccatctatgctagtacgtttgtctatgaaccatgatacaatgcgttggccctctaaccgacctaaaggacctcgtcgtatggaagctgacggcaatggaatctactcttccagcacggcgtagaggctacaactccttggagcggcgggacgatttacaaccagaccatttggaagtgttgagctccacctaaatgtaagttcttcttctggctcattatttaaaacagagtctaaacggcggataggctaaaagaggtggtggccctgccanaacaaaataagatgcaatctaaatattgcgaataggggattaaacacaaaggaatagatacgattgaggtggtagatctaatcgacccggcaaatcaacacaccaattattaggggctctaaatttatagtcgccgactaatcaagcgaggacaagagacaagtgaatgacacttggcaaaattcaattaaacaaaactcaattgttctagagggtgtacatagacatttatagaagaaaatagatcaaaggtttagtgctaattcgtggaggtgggcctagtgtattacaaggtccaagtaccaagttcggtttcagcaacaacattgtcttgttttgacaatttccgtttactcggaatgaatttgtatatgaaaccggatgcgtttgaaaggtgacgagataagctttccatcaagtctaacatcacccgaatcggagttggcatgaagacactaggtccatttgaagtcaatgctgtctccggaggtcgaactggattccaaaactcattggagatgtatattgtagatcctccattcatccgatgtattcttgggcaatgttttatatttctcatgtttggttgtatacatatacttgatctcaacctattggcaaaatcctttaggtatgtttggataatgggaaatgaatggtgggattgggattgagaaattgatgaagggttttgattaaatagaagaaggagaatgaatggttaggatttaaagatgtatttttgtgggtaggaaattactttattatcccattagccaaacactgccttatactttagaccggaggtagtattcaaaagttgtttatggtaattggctgcaactcttttatatactctttataaaacaaaaacatctttgaatttgccgttaccaaaatcttcatcattttttttgaacggaaaaatcttcatcattgaatcctcaatgtactgctactgaacaatgtaacgcattttcattttgccaacaaaatggaaagataatgagtctgtgtaccgtcacgtcatcactttgttaattgtgggcctccatcagtttttgggcttaaggccttaacacctggaccactcgacgcaacctagctggaggcccagtacagtgccagcgccgaaaaggaaaaagtatacttcgattccctcgactatcacccgagtacgattcatatccactaactataaaaccagctatatcgactccttcaactattaaaaccggtacaaacaatatctctcaatgattttggagattgttttggctgacgtggcgcctacgtggtagtcttgaccaagtctttgtcgtacgtgacgcttacgtggcattagaataaaataaaaataaaaataaaacaaatatatgggacccatatgtcattcgcaaggaaaaaaaggcattgtgggacccacatgtcatcctccctctc

SEQ ID NO: 36185 - DNA, 7960 bp, Oryza sativa
accccacgtcagccaaaaccaccgagaaatattgtttgcatggttttaatagttggaggagtcgatatactcggttttatggttggaggatatgaatcatacttgggcgatagttgggagagtcgaagtatactttttcccgtcgaaaaacaccttacgtgagtttggatttcctttctcggctgggccaaattctcttgggcctgaggattggaccagactctagagggcctaccagaaatggccgtacactaatagtctaattccaacactggtcaaaactctctaatggtcaaaaccgatccagcaactgtcctctccctctcaaagaaacagcaattatagcatatatataatcgcgtaagagcaaggataatagtagagctcactatctactattagcttattttatagccaacacatataataaattagttataaagttggctacaattttcttctcctatctctatctctcacttatacatttattatttttgttttggagcttgtgttaagctagcttttgcatgagagtcaatacctttgactttttttttgttacatctctcctccacataagtttatagtaatcttatagctcactattataattgctgtaataaaggtttgtttccaaaaatcgttcataccgcggcatccctctttttgctcgttttcacaacatgcgcacactgcaaactgcgaaagcaaaggaaaacgcgtgatcgtaagcaaatcgttctcccgttccgtgctactcgtactagagtctagtctagatacgttggtcaaccaggtccagatatgcccttcccgatatcaaccccagctgatcccgtacaagtcgcacgttcactcggatctgcttccgccggttcagagttcgccctctccccttcgcgctcccgcggaagaaaacggcggtatcatcttttcgaaaatggatcggtcataaacagatcatagttacttcctccgtttcatattataagactttttagtattgtacatattcatatatatattaatgaatctagatatatatgtgtgcctaggttcgttaacattcatatgaatgtggacaatgatagaaagtcttataagctgaaacggagatagtacatattataagtcattttaattttttagagcaattctacggttgaggagataccataagatataaatatttagtataaaatttggtacctcatagtataaaagaaaaagtggtacctcgtgtagctccttaaggatcgtaaaattatttttaaggttgtaataagtttacagaaatatatagcaatatttttaatacaaaacaaagaaactatcaacatatattcaatatgttagatttaatggaatcaatttagtgttataaatattactatatttttctataaatttggttaaactttttgaagtttaactctaaaaaattcaaaacgatttataatgtaaacaaatgaaataatgtatttttttcaatatcaatagcaatatagttgcgaagtgaacgtaactcaactggttagtttcctcgtggtggaaccaagatatactggcggctcagtttttcgaaggtgcttataggggtcccaggtaggatatgtgtatgtgtttatatgggtgagtctgtgtttgtattgtatttctcaataaaaaattagcaatatactccctctgtttcaaaatatttgacactgttgactttttaatatatgtttgactgttcgtcttatattaaaaaaaattatgaaatatgtaaaactatatgtgtacatgaaagtatatttaacaatgaattaaatgatatgaaaagaataaataattgcttaaattttttaaataagatgaatggtcaaacacgtattaaaaaattaacggtgtgcaatattttaaaacggagggagtagtaatgttgaaaggacttcaatttatgcaggtccagaattatataaacggcagaaaaatgatttcaacctatattccatttccacctatacggcgctcctagctttgggtagctaacaaacgcgtctcccctaccgttagtcccgcgtctcctcccccgcgcccccgcgtcgtgccgtgctcccgcggctaacctttaggctttagcctagcccgaccgaccggtaaacacgcgccccaccacatcgcccctctccccgcctatacacacgccaccaccaccacgcgcgacggacacgctccccctcactttcactccacacacacacttcacggttcgcgcgacgaacaaacgggcagaaaaaccctgccacgacgacccacgactgagccgagcgtacgcacgcacccacgcacgccatgggggcgctgcggcggtggctgccgtgctgctgctgctgctgtcgcggcggcggaggaggtggtggtggtgggagcgtgggggatgggctggtgtgggacgtggccctgaaggcgcacgcgtcgggggactactccgtggccgtggcgcaggcgaacgaggcgctggaggaccaggcgcaggtgttcgtctccccggcggcgacgctcgtcggcgtgtacgacggccacggcggccccgaggcggcgcggttcgtcaacaagcgcctcttctccctcatccaaggtctcgatcactgattcacttcctcatccatcctgatcaaacgcgcagtacgagtaaattagcaataaagagagatgtatcgatcgatttcgtcgtgcagagttcgcggcgcagagcggcggcatctcggcggaggtgctcgagaaggcgttcggcgagacggaggaggagttcgtggcgtcggtgcagaggtcgtggccgtcgcagccgaggatcctgtccgtcggctcgtgctgcctcgtcggcgccatcgaggacggcacgctctacgtcgccaacctcggcgactcccgcgccgtgctcggccgccgctctgccgccggcgccgcccacggccgcaagggcaagaacagggtggttcccgagcgcctctccagggaccacaacgtcgccgacgaggacgtccgccgcgagctcaaagagctacaccccgacgactcccacatcgtcctcaacacccatggcgtctggcgcatcaaaggaatcatccaggtaatataatcaaccaaacatcttttttttttaacgattccggtgcgaaattctattgatatagcagaagaaaaattacgagattataacctagaaagatcataaccactaatcaaccaaacatcgaatcatcgattctttctttctttctcgcaagatcaagctgctgatcgatgcatatgcaggtgtcgaggtcgatcggcgacgtgtacctgaagaagccggagatatgcaagagcaacccgatgctgcagcagacgatctgcccgttcccgctgcggcgaccggtgatgagcgcggtgccgacgatcaagacgaggaagctgaggccaggggaccagttcgtgatcttcgcgtcggacgggctgtgggagcagctcaccgacgaggcggcggtggcgatcgtggccgggagcccgagacggggcgtggcgatgaggctggtcagggcggcgcagctggaggcggcgaggaagaaggacgtgaagtacgagaggatcaggacgatcgagaaggggcagaggaggcacttccacgacgacatcaccgtcgtcgtgctcttcctcgacaagtgccgcggcaaggccggccgcggcgacgagatcgacggcaccgacggccccgtcgacgtcttctccctcagccccgacgaccgggaggacccgaccaggccagtgctccgttgatcgacggcggccggagcttcaattccagccgccgccggtggtgtgtgtacgtacatacgactgttcttggttctttaatttgctccccaaatcgaggtttgcatttggcgcgaaattggccgtttcagccagaaaggtttggttttttaagttgccagttgccacgcaggtctggtgttcatcaccctcaaatcgttttctggttcaaagcttcaaaattcaatttgttttggttggttttctagaaataatgctgcaaccacttcatcggagagaactacgtgtaatttagttgtgaagagtagacagtagtagtactgtagtagtgtcgtgtcttgtaaattctaaacataacaagttgctcaagcttctccattggagagaggcatccaaatttgttactccatctgttctgttagtgttcttgaatgcagccaagccaaccaaagcagacattgggtctcacaattcacaaaattcagatcgagaagctcaacgaagtccactgtgcatgcatgcaacaccgtcatcactcatcagcggcaaaacatgagtcatatagtcttgctgaaattttgcatgaaattttgaggataagagggcagccacaatcttggatcggttcaaccaacacttgtgagctgtgacttcaccggtcaacatgggtgctgtcctctcttccaaactgcatttatttgtagagatgaaaaagatatctgcgaagaaatggtagatgaaaaagatatttgtcaagcaagtgctttgaagatttcttggtagtgggttggatagtttccaagttagctgagccgtgaaagcgaaagcaaatttccagttctgcaattgcggttgctgatccattcaacgaagaaccatagtctaccgggttcaaacgcaagtcaaaagtacactagtgctataacgcgtaggactgtccaaatggcattttttttctttttaatctgaataggaatggaatccttattatacaaaaaacagtgaacacgaatgattcgggaattcctactgcttttcaatcctgaagtttctgaagaatctgatacagaggtgatggcgtagtttttagctgtagcttgaccaaatgaccatgtgttttgagtcctgagtccaggtctctcattctggtttttggcttttgacttctgaatcacttcattgcaggtcatcgcaggtggttagaaactttactactagcataattgcatttgcttatgatcaacttgactttgactccagctacaaggcgacctgacaaaaccaatggggcgtgtcagtttgttgtttccatgtgacttgttcttgcaagtcattttatttccctctcgacaacagttaccgggagacaatcatgcattaaattgctagttgttggtaccggtttacgccaaaatcacaccatcacgagtttagcctgaaaatatcagaataactagccggtacccccgcgcttcgctgcggtgagctaggaagattgctcatgttccagtaataagactataattaaaatcttgatataatcaggtcttgttgaatggcatgtattaaagaatgataaaaatatatagtgaacggttaatatttacacggataaatgagctagtgtgtcggttggacatcacatagcactattgcttatattggcagcactgcaataaacatactacatgaggtagatatggataaaacaatggttattgtttggatggttgtgtagcatttccttccccaagttacatgatgtaaacaactacctgcttgaagagctttcttctttcaggacaaatggaaggcataaatttttccaagctttatccctatctagagcgaactgctttcatcctgtcgcaaagctgaacgtctattaattgaaattgtagaagtcattgcggttgcctttcttcgaagagtttcaacctgaatatatgttgatcgctttgctacatgggtgctatatgcactaatgcatcataaaaataaactgataaccaccaatttaatactttgattccccatgaatcaatggaaacaaatgctatctgtccatgtgaccagcactaagaaaaaacacaaactctatagttacctgctggtgccatttaatttccgtggtacattgggaaataatttgttcaataagtttgacatcatttgatttaacataaacactaaaagcctagcacaagaacactatcatccatcatcagcactaagataaaatcaaaacatttactgatgctgaagacctctaaaatcatgcacttaatttggaactgaaatgctgcttaaacaggtattttacaattgtttttatgagcaggtataattaaagaaataaaaaatggcataccatgcattactctctattaatgctctgatcagggtgcacaaagccacaaaaagctggggtttccaccaactatatttggcaagtgcaataccaggatatgaagataataacgtttagcctgaaaaagatattagaacatatcccttgtttaagaacatatactaattatcaatctgataagaaagcaatgagaagaacatttagttttacctgtcctctatttacgaattactcaattattctatgcttgtctttggtaatgattattgatggattataaaccaacctgccaaaagtggaaataggaaaggaaacaaaccatcttgagtgagtatacaaaaagcaagagcagcagaatgaggctatagaaactgttaagatataaaggctacagttttgctatccaagattctaattaggacatgcttccaaaaggtttccctaaaaaaagtgctcccaaaagcttcaccgtttaacttgaaattggtcagaacacctgcgctcaaagtttctacttttaatgcagatgaagcccatagcagggaagagatccccattttaaaaaaggatatgaaagagaaagaggagcagacaacaaattgtaactgaaagaagctcatcacagcaactgaattacctccaaagacctccaataagtaaggagtaggagttcggcattcaaattagcataccaagatggcatctttaatacaaattggcatggaaatccgctcgtctaactgcaagaacaatggatgaacatataggaaacacgccaagctgagatcctgccagattacagtaccacattgtttaaccaagctaccattgcaaacccttctcagcagcaaacaaatagacagagagaactgcagcaaaagaagtacatgcagaacatcattttaatagtataagctgtgaatttgctgatttgcaataactacaaagaatcaacctgctcctggcaatgcacctcaacagctacccaccgtcgaacagagcaccacttttgctccctctgagcttcagtgaaaaaacaaatttgtagatcataaaattgtgtggtattggcctattgagggcttcctatcgttcccaacatcattgagtggctccatcttacgtactctcaccaacaaaacagaaccaccaccaccagtaatgcatgaaagcatgagacagtgggccatggccagggagacaacgtgggcacatcaagatcagctggtcatggttagcattgaacaaaattagagaacataatctcccaaccatggtaggacacagggaatgcggtggaaacaaatgttgtataacaacacaatgaacgaataattactttactgaaggaaaagtaaaagcatacctagcctggtggagaaggaaatcaaagcggctagccagaccatagtgtggcagcggtttgagaaatgtcacactgttaacaaccaaatttggtaaattctatcactatgggcatcgaaggtgaagatcagatcgaagtggaatccaaaatgaagatcgttgcggaaacagagtaagaatcggctgcagtccaaatcggctaaggtcaggtcggcagagttcgagtcggacggggctagccgatacagccgattccgataatatgactcggcgtatgtcgtcgggttcaagttgatgtgcttcaaagatgattgccacgcatggatagagtcttgggaaggcaatcgtatctattaattaggatattctgtataatttccttagagatatgtttgggcaaaagtctgccgtaaagacttatgg

SEQ ID NO: 36186 - DNA, 2272 bp, Oryza sativa
tatcttagagtttgttagagataatagtcgtgtccgttatggacgtattttgtaattctcgggtataagtagacccgacgccctatgtaaaaaaaaaggacacacatccaatacaatctcggcgcatcgccaccctttttgctttacttttcgacgagttcgtgctctcgggttgagctgcatcggtttcgatcttcaacaagaggtaaaacttgtcatgacgatttatattctcaggattagtgcttccatctttatgatactctaatcttgtctatataattcgtcgagttatcatatatctcacataatcttcgataatatctctatctaacctataaccggctaacatctgttaatggaaggcaaccgattaggttagacaatgatgttaacttagattatgtgatatatctaccactctatgaaacttccagcggcttgattgtctagacattgttcttcttttcatacttaatgttgcatcagttgagtttgatctattaagtcgtgcttagatttgcaatctctagcctgctttctggttgccgattagggtagtatcggagtttcagccgatcttatctgatttaactacttttattccatatgcttaatctatatgttaaatctgccctttatgttaggatcttgtcgcatctaggtatattaggcttctgtttggtatattctacttgctttaacatcttaatatagagtggtatcggagtattagccgatacatgctagatccatttgatcggctatgctataaatgtatataatcccactattaatatatatttcgatctaagtgatttatactgtctcggcaaggcgaccgatctatcccaatcacttgatttaagtatatatcgatataaggattatatatcattaatatctacagccgatcgagtagatttagttctgatttgcttattgatatttgctgatcgatgtacgcatgacatcggcttgaaataaatgatatgtcatcggcacctagccgatcggctatcatttataggattaattgcggtttctttgttctatttcttgttgattgcaggatcaaatcaattggcacgctcatacacccgaaggcgagttttgaacctgcactggagttaagcaaatctcccaggcctcgtgttttctgtcaacacacacatctcatcctgccatttcgtcaagcataacaaaattatacttaaatttaacatccctgaaatacataaaagcttaggtccttagagcaatgcaaggaacagggaatcgaaccaaaagctaagcacaaaaggcacagaagaggaaagagggaaaataagaggtgcagacgtcgtcgtacctgcggaagaggaggcaacgattggggatccactgagccgataggaggcgaggtcaccgctggcgctgaaaatggaagggttcgcgagagggcgagagagggtaccgccgggaagcaacccatcgacggggaggccactcgccgtcggctcgaaaaagaggagcgggaagaaagaaaggaagaccacaatgacggcggaggcggcgacgacgacagatgcgcgtgcccgtgtacgggacgaaggaatcactccgcaagaaggcggcagcggcggcgacggccggcctcactccgcaagatttggggattttaggaagggaggagccgtggatgtcgagatggtgccagccacgtcaattggttcgcctagcgtgtgtttggttctgggactaggtgggatgggatgaaaccatccccgatttgaggattgggatgattccattcggatgtttggtttgtagaataggacgatcccagttttttgtttggttcaaggaacgagggagggatgggatgagcgccatttgcaaccaccaacaacgccgtttgcaacaaccatggccgacgccgcctctgcccgcacctccggacgtggtcgccaccggcctccttgatggcgtcgatgagcggctgcggggggctcggcgacggcggcggtagacggctcgggcgacagcggcggcggcgggctcgggggacgtcggcggcggtgggctcggcgacgacgacggaggggatgacccaaccgagcactggcggcgatggtgtcggccttcgcgcagagcagccgcggctcggcgatgacgacggcggcgaggtcccgcgggagagggagagggagaggccggtggagaggagggcgagctcgaccaccatcgcggtcgggcgggcggagaagcgcgacaacgcacggtcggcctt

SEQ ID NO: 36187 - DNA, 2099 bp, Oryza sativa
agccccccaccgccgccgttgccgagcccaccgccgccgtcgccgagcccgccgccgtctcccgaggaagagcgcgcgagcaaagcggcggtttcacgccgtcgctcgtcccaggtgggacgagttcgtccgccagttttggccggaccgattggtcccggatctgagaggaatattcctctgtagggaccaacccatcccactcacccctgaaccaaacacccctaaaaatgggttcatcccatcccatcccatcccatcccagcaaccaaacactaccctagggaagcgaggatggaggggatcggggaagccatgtgggacggagcgatgcgcgtgcgaggtgtggatggttggatcaaaccaacgcgcggacatcggacggtgcatgcatggcaagggactgtagtactgtagcacattttcctagactgtggttcatcgaatcactgctggtagtggggtcaaaaaaactaaggatttaatatgatagggggaaacatttttaaactcttaaatgagatatcctcttgttcgctcaaataccatctaaatagttatatcaataattttgacaacattcttacttcaaactactctaaacttaactcacacatcaagaaataaaaaagacaaacccaatgtacgagaaacacccaaggatcttctggctagctccaaagttgatggactagacgacttagattcgaagcctcaccatttctaattatttggtattagattattccctaatattcacgtctatttttttcaaagtcaatgtataaatagatattgcattactatttgtatctgattttttttcttctcaaagtgtagatcgagagggattagaatccattcctaataatatgtataaatcgtgacatccattttaagagatattttgcagacagagaactccaaactctggaaaactagaacttccgaacatcagaacctcaaattacaacttcaaactgcaagaacttttgagtgagttttttaaatctaacagagagctaaatatttttgaaaaatcggacattccgatgctcttagaacttccgatctaagttggttagtttatggtagatttgaaagtgaattttgagtgaattgtaaataccggttaatatttagcagagtgaattgcagtttgagccaccttttctactctataattcaccaactcactgttacacctacattacccattcatcaaatccaacgctctgtatttatcgaatccaacggctccgatcgccccacgcacactcacgcagacgccggcgatgccccagtggccccaccctgcgcagatcgttgccgcgccgccctccgccgtcatcgcctccctcacgcaccgcaccttcgtcgtcgtcgcatcgctcccgcgccgcccctctgtgattcctcccctccgcgcggccctctcccgctctccgcgtcacccctctccgctcgagcccatcccgccgccagttcatcgtcgcacgccgcatcactcggatcaatgtcgccgtcgcacgccttcatctgcacatcgcccagatcggcactcgccctcaccgcatacgctcgtcctcggacagatgggcaccaccgccgtcgccgtcgcgctcattcctccccgtccaacccgcgggcctcgccacagccaaccctgcccacgaggtaaaacagcaatgcttacccttggtactttctttgatcagttttgcattccatcaatattcctgtatcatatagtctttattgtacctagaatcagcaatgcttacccttgccactttctttgtccaatgtaatctcctttggcaagtttttgatgtaaggtattgtcctgcattttgtttcattttttcagttctctgacaggctatgttgggtttggttttgaaactctatacagtcactcgctttaactaaatagagaaattactgatgcctaaatcaattgagagtttctggagttgttaaggagtacatccaggagaagaaattggagatcagtgattcttaattatgcaattcaattccattgattaatgaaaagactaaagtgaaacactccatctaagcacaggttgatgggt

SEQ ID NO: 36188 - DNA, 5175 bp, Oryza sativa
aaacagggccctatatcttggtgttaaacttgttaatatcatctgggactttgaaatgtgtgggatatgctagagcatcatactttgtttctaagggaacaataatgagtgaactgaaacaatgagtgaaggatgcctcaagcattcaaagtcccagacggtgcaaagaaagtgctggtatactctctaatcttctcttgtaaatttcactcttgctttctctgtgcactgagcatccctcttgaatttcatttttttctgaggttcccaataattttgttgatttgcctgtttcattatcagattgaaaactaacaaaccgatactagattgtgatgattgttggacggtagactgttatgagcactacaaactgatatgattgttgcaactgccgttgagaggggctgattcaagagataatttgagctctgatgaaacagcttggaagctggaatatgcacatgaatattggatcatgttaaccaggaggtatatagtgacgttataattttcatcattgtaggtgacatatctatgtttagctataagatttcttagttaaaggtcatcaaaataaatggtgcagatcctgccactaaacaatggttagaggttgctggtgaacttgcatgccattcttcagtgatgcggttgaagttacttggtgagttaaattctgaaccattcttatggttgacaaccatgcacatttaagaattcactaggtgcatgtgataatcctttgtgtcatctaggggggggggggggtactatttccctgtattaaatatgtaacataaggacttaatattcatctctttgtttgccttgtgccttaatccgattcatcataattgtattttgttttgataggggaaagtatttcttccactgttttgcacatatataccacatattgcaggtccttctgttttggaatcagggaagtaggagggtggagcaaatcttttttgaagcaatgttgtatcaacacctcgttattttgtttgctttatgctcatatgagatttcttaagccaatcggcatgctccttccgaacatactttgaatatgacattgttcaactgtttcacaaattgatggaaatgaactaaattgttttctaattcttaaattttacagtaagctgttacctattgacaatattcccctatgcttttaggaatatgagcaattggttagcggttaagaactacttattcatagtcagaagataatgtcctacataagatgatcagaagatgtgccttttttgaagtgtaagagaatgttctgctctgcattccctttcactctttatagcttctgttttgttaaatactaacattcaattttactttaaatttgagtccctggtttagctacaaccatatattgtaagaccatactgccaaggttagcaattgcttgtatttttcttctgcaaataacttgaaatatcagcaagtaattgacccattacatacccaaacctgatgatagttccagatgaagtagtaatagctataccaaataaattattattgtttattctatttatgtcatggcttctgtattctgtccatgtacttttgtattttgtaaaacatgcagccaatcactcatgataatttgatgtaggcaataatttcatcttgccattcatataattctgcccgacgagagtgtctgtagctccccccctccctttctttttgcttcttttgcagaggctattgtggtagtaattatgttaattgcttgattgagtaaagatgacacttttcatggtttcttattcagcacagttagtcgtacactcttattggcttaagagggaatggcaatggacagaaatttcaggaaggagtccagctagagtataggaaagatgtggaggaagcaacaaaacaaattgtctagctgaaagaatcaacattaagtatgcctgtgtagattacaagcctgtggtccttattgaccattgcatacagttgaattaacggactgcattatatgctgcgtctggtaactatattgatgacagacaattattgcgattatatcgacatatataattctgtctttatctgtcattccttttttacgtgaattttaaatctaccttattctatatttgattgccaaaacgtacattatattttgcattggttgtttaatttgcattgcaaaaatattgccataacattagcacatgtatatttgccattgaaagaagatgtccgcatgcatcgagagtatggagagtatgagtaatggataggatttgaagcaaaactgactggtgcttggatctcccaaatctgaaaacttaattatccacttttgcttgtaaatatatatcctatcttatattgattggattgtccagatatctagcccaatctgctaggttgatacctatccacaatattagattatgaaaaatatatgtcacaatgttgttttaaagttgtatttgaatttattataagtaaattattggagtctttggaacgaaggtcaacaaattgggtgtaaggccaacatataaatatccctgataaatctgtgcctgaataaagttgagtgagttatgaataaggtcttcgagttgtttgactccaaactttatacaatttaataaatttatgagtatatgaaattatttttaagccaaatatacacaaatcatttatcgtgctcacaaatacatgcatatctttgtttggatattcggtttttaaaatattttaaatttatattgtaaaaatatatatcttgttttggttgtttgatttgcattaataacgaaatttagccgttgcgttagcacggacatattactagtattgataaagttttacttgaactattatttgcccaacctttacacttttcattagctaattttgtctttattataatttggatcaccccataccacttcttcagcacatcaattatctcgagcacaacaactccggtgcgcccgcgaactccacctatgtgtaggcagcatgctatacctttgcctgaagagagactagacatggttagaggagaaagttaggttggtttaaagtgtaataaacgtgaagttaactagtccaaagtaaaatatatatatatatatatatatatatatatatatatatatatatatatatatatatatatatatatatatataattatataaagtgtaatctaaaatgaaactttaacaataaaagatgatgagaaactgcaattcactctgtcaggcgctcttattacgccctatcttaactgcaaaccatgcatgcatgtgcgaattgcaatcgatttgccggcttaatttgagatccccaagatcatccttcttctcggcaggtggtgtataagctgtgtgtttgtcacggccacatgggaactcacaatatagtatccatggcggctcttgccattggcctcctaagcagtttgttctgctcgagtaacttgcccacaggatagtttaatcagcttgccatgtactatctgaattcctgctagtacagtagcttgggcctaaagttcatcttttttggggcctctttttcgaatttctttccccttttttttcctccgtagggcagccggcaacatggatgcaggatgcagaattaaaacatttaaactgtactcctcacttgaaggaccacaaattgcttttgctaattgcaatgtatcactcttcactttgtgagtgggaatggcactttcagaaagacagagaaaaagattggtttgcagaaacataaatcagagtttcagacttcagcaggttaattcagaaaataaaaaggattagtcttgactgctggataattttcagtttaacattttagcatcagaagtcgaaaattcgtgtgagctacttactataatgcagggacttcgttgaaagctgaagctagcaatggtagctagcttctaagctagttaattagccaaaactagtttaattagcagagtgaaatctgacgggtaggtttgtttagtgttttgccgggtagaaaggcttcaggttgggttaaattaggctgtttgttgggggattaacacttaacagccgcaactttagaccttagacacgccacccggcgaattatcagcgctaatgacatgccattagcgtttgcagagcgtggttaagtgcatgcatggacacaattatccagcgaaagcaactgatgccaaatctttgtcgacgcacgcctagccctagttcatgccactgataatcaaccttctgtcaattaagttacacaatattgtataagaaccagacaagcagaggaagcaggcagtactgattactgaatcctgaactgatgacagagtgacttgtctgattcagagagattctgctgttaattaggatctctgacactgttgccatctgctgaaacattcccaaaaattttagctacctcgtactgaatgaactggagtatgtgtttctgtaattctgtctttacatgcagggtataagtacagtttcaggttaacttcgagcatcagtaacgggaagagaagagagaagcaaatttgttcaggctgctgaacatatataaaaggacactctagctctgcactttcatgaaaagaagttaagaacatcatatatataatcctttgcctaattgactaattatatatcagcataacacctgtcccactacttgtacaaaaccctactcttctcttctacctcttgcacaagcacaagaacacaagaactcggaaatggagctgaacaccagaagcttgcagcaatctggtagcagcaagagcaagggcaagatcatggcgaagatcgtcgaggaggatgaagagggggaggaggaggaggaagaagaagaagatagccttagctcaggttgtcactgcttcttgtgcgccatcaaggagcctgatgctcgcctccgccgcgccagcctcgccgcgttcttccgggagttgccgtactgtgaggatgacgatgccggcgccggcgccggcgccggcgttgatggcggacggtcatgtggtgaggtggtcggcgcggtgtggagggcggccatggcggcgcccgacgacccggagctcccgtcgctcggcgcgatccggtgcatgtcgctgctcctcgctcgcgcgctcgccga

SEQ ID NO: 36189 - DNA, 3431 bp, Oryza sativa
  unsure (1)..(3431): unsure at all n locations
ccacctgcgtcggcaacgtctacgcgagcttcgtcgcgctggcgccgagcaagcggccgaagtaccagcgcgatctcttgacgcgcgggctcgacggcggcggcggcggcgtggtcgccgacggcgaggaacggaaggcggaggagtgggcgagccagctccagtgctggtcactctacttcctgagctgcctcgcctccagggacgtgtcatctcatgccacgatatgccatgaccccgtcttcttgcgcgagctctgccagatgtggggtggcctcgccaacggcgactcgccggccggcgtcgggctgctccgccttctctgcaggagcacagccggacgcgccgccatcgccgcatgccgcgacgcgctctccggcctctgcgacctcgcgcggtcgtccgacgactggcagtacatggccatcgactgcttgctcctcctcctcgacgaccgtgagacatggcacgcagtcgccgacgccacggcggcgcgcctcgtcgacctggccgagctccggcacctcggcccaaggcgacggctcggcaatgcaataacagctgcactgcttcttgacgacggcgacgacgacggcgacattgtccatggccgtgagctcggcatggaagcaaaggaggcgatcgccagattgagagaagtgcaggtagagaggaaagggagagaagacgccatgtctagggatgagctgctcaagagaaggatcatggcgaaggagaagaagaggcaaggcaacgacatgttctggcacggcgaggtggagaaggcgatcgagctgtacaccgaggcgctggagctgtgcccgctgagcaggcggcgtgagcggctggtgctgcacagcaaccgcgcccagtgccggctcgcgcggcgcgacgccgacgcggcggtgggcgacgcgacgcgcgcgctgtcgctcgcgcggcccgcggcgaacgcgcacgccaggagcctgtggcgccgcgcgcaggcgtacgacatgaagggcatggccagggagagcctcctggactgcctggccttcgccggcgcgtggctcaaccggaaggacgggacggcggcggccgcggcggcggcgtcgcgcggcgggaacccgaagctgccgtactgcgtcgcgcggatgatcagtaagcagatgggcttgacaggtctcttctccgccgtggcgacgaacagtagcaccaccaaggtagatagagatgatcgcatgccgcattacagcgacggcgacggcgacggcggcgacagcgacgacgaggaagacgacgacgacgacgatcgtgatgaaagcgaggaggaggaatttgctgagaaaggaatgaagctttgtaggccaggtagtagtaattaattaacctctcgagcttaatttacctatgcaactactgcatatacatgtgttatgcatggttaatcttgattctgatccaaattggttaattatcaccgatgatcaaagtggctaatcttgtttgaccaggtaagggtttaccaatcatcacggacgaggcttggaggagattagctcggaggaagaaggcaacgagccgagtgttgtctcatgatcatcgattctagcttgatccattgaagaaagacaagtagacagagacagatagctacagttcattgatcattggtcgggatgaatgatcatgattcagcaattcgatcagggcttaatcgcagacttgttgtcattagctagagctgatgtgatgggggtagtggtttaatttgatgttgacgctggcttagctatactttctagctagccttgcatttgtagtttcactcacgtgatcaaatgatgttcccattgataatacttccgtatctgtgctagatctctgttatttcttgcaagttagaagttgtcaatgtgagaatggccgatcgccctatcgaattggtgaaagcagctaagctacttgattcatagaaatatcctattattaggtttttcataacttgaggaaatgtttcagttgagaatttctgaagaaattattagcttcctgccaaattaattaatctgatccatgtcagcattaataaaacaataattaattataggaaaaacatcggtagcgtggttatatgatttcactcatcaaatttaagcatagtgttaatgaatattacgcacacgttaatgcgctagctctcaatagaacttttgtgagcctaaggatttaccaatgatcttttttttagtgtgtgttagtggctaaggatttgccaattatctttgcatttttagcgtgtttggagggtgtactcgtagacagcattgtatgtacgcatccgtcttttatgtaatcggaaaaaaaaacaacaactcattgaaatactagggtatcatttttgtcctcttcacccgtttgaacttttacttaaacacctaaaagagaccaaacacacctaaaagagaccaaaccttaattccaataaattatatcttctagcaagacattcaccgaggattaatcttaaccagagaacctgcttaaaattggcaaatgaaacaaccactaacacattgaactgttgaactctaacaaagttcaacagtttgttaaaagcacatctacatatgtgtaatatttatgagtaagatttaaatcttagtggctggagccatattccatccttagatgcctcctccatcatactacctccgtcccaaaataattgtatttctaggattcaaaattcgtcccaaaataattgtaattctagagtactaattgccccatcaatcatctctcatttaaatttctccctattttaccctcaaccatcttcctactctcacataaacaccatttaatgaggggcacaatagtctttcttctcaaatcttaatatatgctaaacaacatagaattacaattattttgggacggaggtagtaaaacatttcttttgcgatcacatggcagatgtgcacgtatacgtactactatacatgcaacaccacactcacacacccacgaatatgcaccctaacaaatactcaaagagacgaaaatcaacggacattcctaatctcaataaattcctgttgaaagcacaattacacatgcgcaatatttgtgggcacttcattagtaaagtacttcactcatgagtcatggctccccccccacatcactggtgctactccattataataataatagtggccctataataacttaaaatatatatctgcactagtaattactccttccctcccggtattcaaaatttatccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36190 - DNA, 848 bp, Oryza sativa
  unsure (1)..(848): unsure at all n locations
catgccaactccgattcgggtgatgttagacttgatggaaagcttatctcgtcacctttcaaacgcatccggtttcatatacaaattcattccgagtaaacggaaattgtcaaaacannnnnnnnnnnnnnnnnnnnnnnaacttggtacttggaccttgtaatacactaggcccacctccacgaattagcactaaacctttgatctattttcttctataaatgtctatgtacaccctctagaacaattgagttttgtttaattgaattttgccaagtgtcattcacttgtctcttgtcctcgcttgattagtcggcgactataaatttagagcccctaataattggtgtgttgatttgccgggtcgattagatctaccacttcaatcgtaactattcctttgtgtttaatcccctattcgcaatatttagattgcatcttattttgttcttgcagtgttttctcgtttgcattgtagggatcatcaaccgcatgttacggttgttacgacatcatttatggtgtagcgatttcacagcgttctggacttgttctggttggtagccacgtcgcaaacgttgcactcgattaaagcgagagttatcccctattcgcaatatttagattgcattttattttgttcttgcagtgttctctcgtttgcattgtagggatcatcaaccgcacgttacggttggtacgacatcatttgtggtctagcgattgcacggcgttctggacttgttctggttggtagccacctcgcaaacgttgcacttgatcaaagcgagagttatcccatttctagaaaatcgggccacgagagagaagcatcataagtgctggat

SEQ ID NO: 36191 - DNA, 1586 bp, Oryza sativa
aaaaaccaaaccaatccaatccatttccacatgtggaccaatccgctccaacccattagcctcctcagcccatttctatccaaccaaagacaacccaaacttaaaaacaatccattttactcactttatcccaacccattagcaggcttaaacgcatggctgcacccatgcatgcatccgaaatatctgttcatcaccgtcaacctcgacctgcctctgccgggccctgtcacgtagtatgcactgggcgccgtcacgaggccggcagctgctgcctcctgactggtactgaaatgaaatgcctcgctgatgttgaggccccaacagcaagtcacagccaccgtctctctcgtccattggcgcgttgcctgggcgtacggcttatgcatacgcacgcctgtgcctgcgctgctgtgcagccgtgcaggtgccactgctgctgggtatcggtgtctcgcggttcgcggtctcgcgcgcgtcggcgattcgacggatccgccgttggttggttggatggtggacggacggggccgcggcgtcgctttcggttttgcgcccctggttccggtcacgtaatggccgtcggacgggctatttttttgagggttttttttttctggtcctgcgtgaacgttaccgtcgggcctaattaattgtcaatattgtacccattcgtcatgcgtggcgtgttacagagaacatctcagaccatgtcccgctcgatcgatgcatcgtgctcctcacttagtcgtgaaaaagacatggaccgacggctatgggctgtacttttttctgaatgaagggcaaaagtttcgccactttggtcctgtttagtttgcgaaaaaaaaaattaagtgtcacatcgaatgtttgaccggatgtcggaaggggttctcggacatgaatgaaaaaactaatttcataactcgcctgtaaaccacgagacgaatcttttgagcctaattaagctatcattagcacatgtgggttactatagcattttatggctaatcatggattagttaggtttaaaagattcgtctcgcgattcccatgcaaactgtgcaattagtttttatttttatctatatttaatgctcaatgcatgtgtccaaatatttgatgtgacatttttgggaactaaaccaggcctttatagtgatagagcaggaataaaatggtaaagtatttacagagagtgggacaaaaacaaacgggcacgcaaaattaaacaataaggcgctactctcctgtagggattagctctgtgatttttatcgctcccactgtgatccaagtatgcgcctcctctttgattttggcaatgatggtggtgggagtggaggcaacatgcctaaaaatcttggcatttcgttcgcaccataattaccagcagctcatcgtgcgtgagattttgtactaccgttattcaactgtcgcacatccgtccgactcttgcaatcggagatctgctcctgtccaccgttatatttcagcctagattcttctggacagtatgcaattggaactttacacatgcaatctagggagggtgggccaatcaacatttcaatccaaattctttt

SEQ ID NO: 36192 - DNA, 2825 bp, Oryza sativa
caaggtaatccctccgtttttttttttttgccttcattgcgttatctctccgttgctgtattgtggcggagggggtttctgaacttgtgttgttgtgggggtgaaatgcgcggcagaaggattcgaaggcggcgcccctgaccaaggaggaggtcggcagggccacgtggatgctgctccacaccatcgcagcgcaggtgctcgatcttttgcctctgtgagtagcacaacagagcatatgaaagctttttatgtacttacctcgcactagtaagttctgtagcatcaggggtgaatttagagcacatcaacgaaccgtgactcatttgttagattgattgacatacttgtgaataggctgcaagttgttgaaagtacgcagtctggtattgactacggttaactcgtgtttgtatttgtgaattgtctttcagtttcctgacgaaccaaccaggcaacaaagacgcgatgcgagagagctggtaagcattaagcaggataaacagttagtgatatctctctagagtttgggtggaagtatggtaaagtcccttgttttgattttgggggaaacatgaggaccttgctgtcgctacccactcgtaatttgtcacggctaactacaggattgttgaatcttagaaaaggcactttcttgatgtttatcttgggggccttgtattctcctgcaatggatcctgtttaagatatagcttgtatttaatttattctttatgtgccttgaaatattcaagattactttaagactgcacagtaaagttccagcatggtaatctcgtgattttgttgctacaggatgcaggctttgttctaggtgttctcctggttcattccccgctaactttgagcttagacatttttagaaagtgttttgtgcttttggtctagcacagttatgaattaccactacattgcttgacaaataaatgttatactttgcatcgttgaaaatgggtggcagtatgttacgactactgctaaggtttcgtttggaatcgactatctcatttgattgaacctcatttagatatatgggtgtttggctagctgttatttttttttctcaatcatggtgcatacagatgcattatcatcatataaaacatctgagttgaaatttgatggatgagtctaccaaattggataactgagttttacaaattgttccatgaaaacttaaaaaataagcataggccagcacaacaactgcaaattgagcctcaatccatgatgaataatgggaagttcgttcactggttttttactcgctttaacgaagaggaattattttattatttcctgaagaattacatttttctgcatctcattattccttttgcttggttacttggttcatgcaaggtcacatttctgctgctttttatgttcagatggctataatatctagactctatccttgcaaagaatgtgcggaacacttcaaagaagttttaaagtaagaaatgctctccaaccactagcataaattatagtatccattttgatagtttgattcctcgagatgtgtttctgtgtgacaggactatgttttgttgaaatgttggtatgtaatacattatcaacctttatccattcattgttttagggcgagatataacatcatgtaggaactataaattctttgtacttttgcattatgaaactgtgcttctggatcttttatattctaaagctatgcatccacaaactcgtttaaaaactttttagttattttacaccatctgtaccttttgggaatatgatttacagaagctatggtgataatgggatgtgggaattggatgtaacaatccatttataagctcatttctcttatagctatttttcatttacttttatggttataatgtcgtttttgctgtcatagtttattatgttccagttatatccagctgccaatttctgttgttctgtttttttcttgtgctgcccttaaattttcatgtttgtgctcaatgtagcaacaataaactgtctcggcacaatattgaactgacttctttatgttctttttgcttagagcaaatcctgtgcaggcaggatctcaggctgaattctctcagtggttatgctacgtgcacaatgtggtcaatcgaaggtaagtccatattgtcaagtttgaactgttgacttgccattccgaaaggaactttcttaaggtattgcattgttaatttgttcgtatagagttgctgcaaaaataaggtctcaaagccaaaaagaggaaaattaaggcacccttttaccataaagggggtattgttttgaagtatagatgttttcattcacaacatcatgattttgctgaatctcatggcctcctgccctcccatgatgagattattcacaatatctgagcgttttgtggttgtcttttgcagccttggaaaacctatatttccttgccagagagtaaatgcacggtggggtaagctggattgtcctgaacgctcttgtgatctagaaggctccaacgacatcatcccgaatagatgacattagatagggatcgtttagaaattctggaacagtgacaaagtttaaaccatcactggatgggcagcatgaagagcatatgggaaaagaattataacgccgtgccggcattcttcctatacccttgtaatactagtgtatcaaatgtgatttcattttgttatttacaagcttcagctctgaagatttttgctgaggttgtcatttttgtggatttatatattcgttctgatgctttgattcaactccctgtactgtcaatcttgcagtcacatttctgtgtcccc

SEQ ID NO: 36193 - DNA, 2865 bp, Oryza sativa
  unsure (1)..(2865): unsure at all n locations
taacaagccctgagcatcgaaaaacctggacatagatactcctgcgctactgtacatgttgcacggttggcaattaatgcgaggtgctggcaacagaggaatgcatggtggccattttttctgctgctgctcctcggtgttggcgagaccataaattctgccgtcttatcacatcaatttttttaatcatgtactgacaccttacgatcaatgcaaatgaaatcacatcacgcatggacctttcgttatcttttgaaagaggaagcagcgagaggaggaaggtgcagaagcatctgaagttacggtgttgcaggggagatgaagatgaagcgtcttcctctgttggttttgctactctttgcatttcttggaggaggaaacatgttgctagggatcgctttggatgcaagaagaagcactacgacatcctcaggtacacaaagaaaacgatggctctctctgctctgtctcttgccctctttgtgtttttctcctgtcactcacttggttcgtgtggttcctgtcctcttttactttgtcttgattggttgagtgaaaagtgatagctactgtacctttagctttagcggttatatctgccattggttcttggttcatgtttgatgctggatctctgaaaagattgtgaatgagatgtgatgctattgacatccaacgttcttaggtaccgtaggcgtaggtaagattcattctgcacttcgaatgaatgtttggatttccatcagttgtacttgggtttttgctgtacccacttctgttcgttggctgcctctggttctggtttcttcagtcctttgtatgtaggctcatcgttttagcatttgtttgtttagattatgtgcgtggcaataaacaatgtactgacaatggatgacatttttgctacattcatagcagatcatcaaacctatggaagcattgagctaaacggcaggagattacaggtgtgcactttcagtttctggcagaaaatggaaaacatactagctgtatatatttcccttgatgttgattttattttcttattataagaaatactaaagttagttggaaagttttctccagttccataatggcaatccagtacttgtacttctacataactcgtgttccttcatctatctttctcaggaaagaagactttcttctactaaccgaaagacaagggccttggaaaatgtcaggatcgatgactaccgacctgttgatccaagtccaagctccaaggcgactatcggggcaggtccaattgagcatggcactcctctccttccttacgtgccgcgaccgaagccgcctcctgatatcctgcccaatctcctgccacctangtgaaaactgaaattctcacaatgcactggatagtatctctagaaccactatatatatggccagaatctgctgttttgttctgctattttgttcagatttgctaaagtgccatatgccttaaactttgtttccatgagcatttgagtactgcatgctttgtgctgtgtatcaatntcatgataagaagcaatgtttcactcttctattttactttgctagtgatggattaggtaactgctcatttgctcaaaccttgaggatatatgtttagtgaacttttaggtgtaactgacatcgtcatgttgttgtcactactcacaactgggactgaacttttgtgtcctagtgagcgcagatgtccatttttctgaactttgaacttgtgtttgtacgcctcaatttctgatgtgcgtcatcaccagaaagtagagaggtccttccttaggcgacgactattgtaggtggttgtgcaaacatgtgcatcattctgctctcctatccagtcactgaacagataatactgaaattttattggttaatggagaagttcctggatatttcaatacgtagcataatattaagttatttttcatggtaagattaggactttaggagagttaaaatttcggtcagtatgattagaagtatgactactgtagatttgtctgaacaaaagccactttacccttcagcttataagccgcatttaaatttaaattttattaattttagagttaattttaggaattgtttttcatcgtaatttttttcactgttttcttttaaattgttaacaacatgtatatataagtttcatgcacaaatcatatttttgttgctaataaaccgttattttttagataatggaagctttatttagactcagttagttatatcaagatgatacaaacaaactgagtcatccccggcctctgcataaaatgcacacagccagaaaagaagaaagaaacaactagaacatctcccaagcataaaagtttgacagaaacatatatcttagtggctatcaatccgtaggctaggtcgccacccatgctcctgggtaaaaaaactcctgtgccacctggtccaactgtcgagataccaccgtatatcttagtggctatcaatccgtagactagaccgctacccatgcttctgggtaaaaatctcctgtgccacctggtccaaacatcgagataccactataatagtatcccgcggtcccagttggtggaggatagcccaggtacgtagccaccgggtaactaaggtgataacctgcaaaggagaagacaccattttgttatcaaaaattactccattcctgcttagccaaatggaccaacacagagctgttgcacccatcaaaagcagattcctcatttctttggggacacatgatagccaactcccaaacatatgacgacatcgcgaggaggtttcagattagaagccaaatgaattacagaccacaccaagcgagataagcggcattgaaagaataaatgt

SEQ ID NO: 36194 - DNA, 953 bp, Oryza sativa
tcctgcagccccgacgtaaacaaaccgttatggcttataatcaacataagtgaaacgatgtctgtctttgttccgctatacagacatgtgctgattaaattttgcacgacaacctaccaatctaccatacccttatacgtattttatgacatcgtatttagcacatgttggattcttatattctttgtttggcttagacactacgaatgatgatttaatcagaaaacaaagtgtacacctttctaccgtcttcaggtcttttcattgagaactacttggaaaattgttgcatgtgacaatacaatacctccaagctgcatttcaatatttgatgtaactgcaacaaaacttagtttgtcaagtcaagttttgatttgactccatatattctaattccattgacgaacttgagtagtattctgacgacattgaataaaggaagaaataaagcacggttagcttctttcttaaataatcgtgtcgaaataaagcaagtggttggtaaaaagggggaacaacaagacaggccgtggacaacagttccaatagatcagtcgaaagacttgcaagacctctacctcgcaggaacgagacaagtgttgggtgatgggaagaacaccaaattttggttggcggactggttgccggtggggagcataaagtcgagattccccttgaacttcagccatgtcgagcgctcgggcttgacggtggcacgagggcttctgaaccacaggtgggtacgagacatcaagggggcatcctccaatcgcgcaattggggaatactttcagatttgggacgcggtccagggggtgcaacttcaagatggggaggaagatgagacaatctggaagtgggcaccaaatggataatacactccctgctcggcctacagcatattcttcatgacaaacacggtggcgcgatgtggtactctgatttggcaaaca

SEQ ID NO: 36195 - DNA, 3077 bp, Oryza sativa
tgttttgcccttatcttttggggaaaaaaaactgctgctcatatatgatttatcacctgctacccttcgacagaattcttgaataatctgcttatcagatctgaaaaagaccctcctttcattttttaaaattaattagaggaaggttttcttggttattgacttgctgtaaacatcagggtagcaccctctgaacattctgatacgggcttttgattaacccgttctgtaactgaagtcaaaatcggcttctgtcaaagcagcccgttatgttttcactttctcatttctgtatcatattagtactgtagatttggatgacatccacacttccaatgtcgcgttcaaattaatttagtgaaaatttatggggctgttcagattgatgtcattttcataatatcattttttggcaaagttgcaaaaaaaatgtttacgtttagtttgttgtcaaatttgataaatacataagaagtcttgccaaaattttagcaatattgccatcttgttaaaattttggtaatgccaaaatttggtaaggtttattttggctacaatctgaacatgcccgtacgataagtgtacgataaaaaatactactgcgtattagtctttttgtgctcaaccaacaagaactgcatcttcaaggctgctaaagtttcataattccgttgtttcaggatagctttataaaggaaagtagtgttccactttgacaaattcctaagtttcaaatgagaatagattatgatacaagtgaaacgctatatggtctactttccttcggccatttgccaagcaactgaaattgatcaatgctttgagtgtttcattccctcgtataagcaaagttgttctgaaaactggaaaactagagatttccttgccgaatgccaataagaaaaatgggcactgaatcaaatggccaaataaattgaagttcaagctttcgaaacgttagtgcgatgttatcttcatatgaagaatcctttgaattaagcatggaatatgaactaacaccatgaagcaagcaatgagactcttttattcacatacaaaaatattctttccagggaatgcacacacaaaaaagaatttcagaacaatccattagtcacgattgcaatccaaatgttggctaagcataatcatgaatctttatgactgatggacgtcctctagtgataacagccaggaccgctccgtttatcttatttttcgtaattatttctgactcataaaaactggcacgtgaaagactactttgaaaaaaacttctaatgtatatccacagctcttcatgtatatacaaaatctcgaacataccctcataccttacatcagttacgattcattgtattttctatagtactactataaaagacgatagtggtgatggtaactttgccaccgactcactgccactacctttacacgttttataaatcaatccctaatttgttctgatattatgcaacagtctaatatttatttgattcaagtgaataacatatattgaaataagcacatgcattttaccttagtaaaatacaggtattttgttagttttcagaaaatcattgccaattgcatatcctcccagcaatgcactcagtttgattcaaagcagtgtcaagttcagctggatgctgcatggaagtgtgagcaaacaagtccagttctgggcacaagcttagctgttccatacttccattccaaattgagttgcgccttccttatccgaaagtcacgagcaatcgtcctagtcacgccagtgttgatgcaaaggcatcataaacaattatgccagccatgcccaggttagcaagggttttgagtatgattacgcatacatgcatcccagtatcccacagatcttttcagcagtagtcagtgttaagtcatgtaaagataagtagcagctcttgatgcttcttttcctagatgcttcttctgattgagtgttaaaacttatgagctataatgtcaagccacttctaattgttgggtgatacgcaagacatcaaacttaaatgcttctctctacgtacatgtatttaaatacagctgaatactgcagtgtaccagttgccgtagtaagcagcatctaagtacagtacagtacttggtactaatacatgagttgagtaaaagcctcaaagcagttgccgtaagggtccatgaactattcatctttcttcagtgttcttcaatgttagatattcagagtaaccaaagtcataggcagtaataacatttcagtacttcccagagactaatcactgcagcaagaaccctgcaataatctgcaaatcttgatgagctagtcagtgatcagtacttacaaaggtccagctcttctaaaaaagatgctgccactttactgtgtggatgagcagaagtcagataccagtcacaccttgtacactagtgcacatgcacaagcacatggccaaatggtaatgtgataagagttttttcttcagtggctaatactgagaaaattatgttcatgagaaagtagatacactgttccaacctgtaaattaaagaagagaccgtgtgaccccaggattgaataaaagagaataaaaagggagcaagaacctccttagaagcaaaggaggagaggacagggaaaggtatttagagagggaagggaactgtatgagggggctcacttagcttaatctgcaaataatagctgcttttaagggcactaaagctgcttcttgctgggttttggaggctcttttcttaagagatcaattgagcagctggtctgggaggctgcagtttcagtcacctgctaagcttctcccaacctgatcatctgtgggaactctgcaatctgcattgccaactcaggtactactgctaaaaccttctcaacatttcaaagttcagatttgcttttatatcgcagcttttgtgtttgattcgttctcttcggaatcttgagatgccctctgggctctgatcttcttttttcaatgacatttggcattgcctgttggtgttcctacttctttaatgcattgcatttaaaccgcatcctgtctgcgtgacaaaattgt

SEQ ID NO: 36196 - DNA, 4985 bp, Oryza sativa
  unsure (1)..(4985): unsure at all n locations
ccgatcgatcggcgtgtcagcagcaggaacaccgtgatgtgtcgctcgcaatctcacatgcaaaaatacggcgagaagcaaacggctacgtgcaagaggctaaataagagagaacgcgcgaagcgtccagcgacgctcactcacgctccaaaatcgttgccgcatccctgtcgccgaggagcgtacatacgtagttttcatgtcgtcatgtatgtattgtatgctgctaatcgccatctgaatagggaccttttgttttcttttctgaaaccggtattagcttctccaagtactgaaaaaaaaagtgttgcgatatctgggggttttttgcgttgaagttgcacctcctgatcagcagaaattctcttgcagatagtcatctgtaacttaaaatattcttttaagataatggctctaacttaaaatgtagagtgatttgttagttcttaaggaggtatatcaagagatatcatattttctattaaaattttatatctcttggtacctccgacactaggaaatacggaaatttcttttttttttactttttagtacctctcgaagattataaattttttttaaaatataacattaccaatttgctcctatggctgaagatacaaaccattttcattatccacaattggaaaatttaattatttgtcgttctttagagcatgaccgactgttcctttaaatccaatctcctaaatctcttttctttaaaaaaaatctataatgagaatttaaggcatgaaaatatccttctcttcaagagatatcctcatttaagtccctgaaatgaaataaaaaaggtgagctcccccaattcccgcactgcgatatctcttgcagctggtgcttagattccacttctctttgcacggtgggaagaagctacgagcgaggaatcgggagcgagcacggccccaaacttgtggggaccgaatttgaagggaaaggaaactccaattcttaagcagatggttagagcatcaccaaaagtattccaataattaattccaaaaactatgtgttttggattttctaaactgaatgtacaaagcgagaaaacctatctctcccggagaaagactaaaattgaattcctataatgaaaaggggaccctccctttaactaccaatagagaaaattagtttttctatgcacgagccgcgttatttttcctctgtgcgcggttatttttgctccttgaagtggggaacaaggtatcaccgcaccgcctctacgcgcgaactgcgttattttttctccgtgcgaagttatctttgctccttgaagtcggaaactctaatgggcgatcgatcaccctgcccatggggtagcgatcgatcccctcccccctccctcccttcacccctccacctggttttcttttttggcaccgcattactttcctattttagtaaatttatacacctcaagtttacacatctaaagtttagagaccaaaggtttataacttaaaagtttatatatccgattcaaatttgaatttgaattcaaatattttttatatatagtatttctatacatttaaagtttatacacctaaagtttatagacctaaagtttataagtcaaaattttatatacccgtttcaaatttgaattgaattatatccgattcaaatttgaatttgaattcaaatattttctatcatagtatttctatacatctaatttttatacacttttgtttttttaaaaaaaattgtggtgtactgtagtaggaagagaataaggggagaaggaagggaagaagtgggaggaggggggcggatctgatcgttgggcgatcgccggaagtgggtaacgagatatccggagttaggaacctgtattattggaagacaagttgggaatctattatattattaatggaatagaaaacgaagcctccacgttcgctgtcatggcctagaaattctcacattaatcagagaaaaagaaaatgcagagtccatatagaaatacaatttagaaatagctgaaattcggaattaaaaaataaggaatattagaagaggagactagagtccatgtagaaatacaatttagaaatagttgaaattcagaattaaaaaataaggaatattagaagaggagactagagtccatatagaagtacaattaggaaataattgaaattcggaattaaaaataaggaatattagaagtagagtatagagtccatatagaaatttaaaactaactaaaattcggaataaaaaggagcctccacgttcgcttttatgacctagaaattctcacattaatcggagagaaaaaaagcagagtccatatagaaatacaatttagaaatagctgaaattcagaattaaaaaataatgaatattagaagaggagactagagtccatataaaaatacaatttagaaatagttgaaattcgaaattaaaaaataaggaatattagaagagtagactagagtccatatggaaatataattaggaaataactgaaattcagaattaaaaataaggaatattagaagtagagtatagagttcatatagaaatacaattaggaaataatagaaattcggaattaaaaataaggaatattagaagtagagcatagagtccatatagaaatacaattgagaaaaaaaaagaaattcggaatttaaaaataaggaatattagaagtagagtatagactccatgtaggaatttaaaactaactaaaaatcagaataaacataataaaatgaaaagtagtgtttagagtcccgtataaaatacaatttacaaataacttaaattcgaaataagaaaaaaataggaagaagagtttanagtcaatataggaatacaatttagaagtaattgaaatttgaagttaaaaattaaagaatattgaaagatgagtttagagtccacatagaaatacaattagaaataataaaaatttagaattaaaaaaagaaatattcaagacgagtctagtgtccatataggaatatatatataatttacaaataactaaaatttgatattaaaaataattaataactaatacatatataaaatacaatataaatattatacattagtagtttcgtaaagttattacaaaatttaaaattatgttgtcatttaatatattttaataatataatgagaaaacatatatgctattatatgagagaaaatgtaatgatactagcggcgcaatctgcgcgggccatcatgctagttattagattaaggagggtgttggtcatgctactaaggatcaattggaacaattttttttcacctaaaaccctctacttttaggtttgggaggaatttaggagaaatattggccatgtacttaggtcggggatttgatgatttgccatgctaaaccactcgttactgattcagagtcctgcgtgccattggcaaggacgcaaggtaatctgttgaggggcaaatttggctctaaaatttgacacaagctctactaatttccatgcagagcacaaacaaaagccacagtggatcgagtatcttttgtacactagcgacattatcttacgctgcatgtagatgtaggagtactttacaaataggagtaattttagcaattccacatgttacacatgtgcatgacgggattggaaccctgagtagtagacagaaacatgtacaatcatcatgggcgtctgattactgatgcttcccttgtctgatctcgtgcctcttattgacatcatcacacaccatctctagtcaaattgaactcaaagataaccaaacagtgctgatgattggggtggatttgtaaatccgttctagtccaaaatctgggggaatatgtaaatgtttatgactccgtacattgcatggctccatccatgcatgggaggatggaatctttcttggagtatcttgcttctaattaagtaccccccatttgtcagtggactattggttcactgtacttggccaaaaactgggctctgcctacatggatccataattagtgaaacaaagatgacaaatcatgttcattgttattgtgttctgcttctgcactgctgccccgacagagactcagcaggccaataggttaacgggtcagtgttttcgcactgttcatacagaaaccaaatgttcagttttctgaagaaaaaaaatcaaccgacttttcgctcgtgtgttaggaggggatcaaatgttcaattttctgaaaagatccatcgtttttttttctttgctcgtgtgttaggaggggctacgatttttttagtgtccaataaggtcgagccatgttgatccttcatgtggtttcaaaatgctcatgaacgttactgcgtgcggggttttcttttctagatttgttgtactgtaagatatctatctaaggttaatttttgttagaaacacaccataaatatagacactcacccatataaacgcacaccctacccctatgaagacctccgaaagactaggccgacatatcttgagatcgacgaagtcatcacaggtgcatggactggcatattttgagatcgacgaagtcaccacagacgtctcgctgtcgatggatatgtcaccaaccactgaaaaaataattaactataaatacgagtatatgtgtcaagtctttggacttgaatatggatggattggttttaaaaaaaaataaccaattaagttacgcttacttcgtaaggtggtttattttgagatggaggtactagatgaagcatccagcagaagccatgccgaggcacctgcgacagaaaggagggccagatatagcaagcaccgatggtggcggatacgacagagagtacgtacaggagaaaacggcaaggaagcaggcaatatcatatcccggcaagtgtgaggtgtggaggatggaggccggcccgtgccgtgcgtggtccaagccgtgctagcgcctagcgcccggcccgatcgatcgatcgaaaccacgcgcg

SEQ ID NO: 36197 - DNA, 2556 bp, Oryza sativa
ggatggtgctagcgtggctggcattggcatgggccaatcaatcccgttcatttcaggctgtgcctgaagcctgcagatggatactgatcatccattccaatcctggcagtgtgtgcctcgaaagaagatgattcttaatgccaccttaccctttacaggggcaggctgcaggcagcaccacttcacaccagctttctttatttctttctttctttctttttttctttcttatccacagcgagagaccgaggccgagggaccagaccagagggtgtacaactactacagcgttcgcatcagcggatcgctgtgcaaagtgcgttgcgagaggggaggagggtgagaatgtgagatggtgtgctccggaccccggtggcttggttggccgctgtcgctttacagcctcgcccacgggagcctgtgggtttcacggtcagtaggcaggcaggcagcactaggagtagtagtctaatagatttcggctggacgaacacaacaaccagagtctataggaattttaacataacagctgtttgcacctgaaagtcatgcccgatagatcaagcatcatttccatataagtgatacaattctagccatatataaacttggatttccttttctaattccccttagtaatgtattgtcattggcgttaaactgataaatatgatcattcgtaaaaataaaaaagtaaatatgtaatttttgattgaccgagattcgctttcgaaaaagacgttaccgttcccattcctacctaaaaccctcgtaggcaaaaggtgaacatgtgacgaaatgcgatcagtatgggatttgttaaaacggaaacactgtgaaatgagattctttagaaaaataaacaaaaaaaaatagagaatggagtggtttggtacttatggttggaccggtggtggcacatacatgtatgaccagttgaacttccctctcaggttgtttggcacattcacccggtcgatccatatattcaacaaattcattaattccgatctggctcgactgagtactcagacgtaaattctctgtatctatcaacatttaattggtgatttaggcgacgtagcagctagccatgagcaatatactaacatttttatcgacgtgacatgtagcttcatgcgtaggtggtgcgtgcaagtagggaccgattaaatttgcgtactaacgcaattagctttgctttccggtgatcatgcatggtttatttatgacttgacaaatgcacagcatcactgattacacgtacagcaactctacaaagtgtacagtgcagtgtacttaattttacagtcgctgcagactaagctaagcaactttagtggttcaagcaaccccatattatatacagacgaattaaaaagattgttatcgtcatggacacatggttagctagcttatgtacaaagcaaaaaaatacttacctgctcagttcttaatctgtgaaatactactaacacttttcatttgtcatatattgactttgacatacaatacaactaaccgtgattaacgaggaaaagacaatcaactaattatatggtcatgtcagacgtataaggtttttacgcaattacaatgtaccactttgaacactactttattttataatatattatcagcaaccacaaaattagtgtcatacaaaaaatacttccaaatacagattttttttagataatgactttttcttgaaacaagaacacattatatatccgtttacgtttgtatactctactgtcccggatgacaccgatactaaggacgggtgcttaattagtattggcgccatttagttggggcggttgcttgaacatgactgatgagatagctctgctacttagcacagctgagctaccgatcatgtatattttctccatggtattgccaagtttggtgaactatgcttgtctaactacccatctgattaacttggagcatgagtactgcttctatgcatgtgacgtatttatagtgtttgctaattataagcacgtactgttctgaccatggcacacacagagatgtacaggatgtatgtacgtacggtgaccactgttcaaatgatcaatcaaatccaattaggggcttgttttttttgccaattaattagcccgtgttacttaacaagtcacacactaattaattaaaagttgcctcacgcacttgtccagtggccatgtgatgagctccaatatattatggggcgaccaatttcaagatcatatagactcgatagtttggcaaagaaattgacatgtgattggcaattaggttcccatagcatattgttttcgtttacgagacggccttgtgatgttgtggttcccaaaatgacgagtgtgcttgcttgttctcctctctgaaccttaaaataacatctgtcagagaactagtgtgcccacattgatgcaataatataccggacacaactaattaaacaaccgacagttatacatctctcttcatcgagaaaatatatatgctttagatactcaggtcataaatgtttggtgcttaatacaagattagatcgaa

SEQ ID NO: 36198 - DNA, 739 bp, Oryza sativa
agctaaaacctggttccaattactgcaatcagaaataacctacaatcctacaatccttttacgtgttcgggaaaaaaaaacagacaactcgttgctgcaggagctgtgcacgcatctcttgttcagaaaccggcgtgctgcgcgatggcgcacaccccctttttcagcgggaaaccgccaaaacaacccgctcccctcgccgtgacctgatatgatatagcgaccccgtcgcgttccgacccgaccagagcacccgaccccacccagaagaaggaaaaaaaaaatccgatcgggcctcgccgcgcgcgccggccaccgccaccgccaccgttaccacgagcgccatactcccctccctcctcgccaccgtcggctccctcgccacaggcgccgtcgcggcgctcgcggcggcgggggcgcacgcggggtccctcccccgcgcccgctcggtggcgtcggtagcggcggcggcggccatgtcgacggcccgcgtttacgccgacgtgaacgtgcaccgccccagggagtactgggactacgaggccctcgccgtcgaatgggggtaagaactgattccttcccacctacgcctcgccgtgctaccgtgtgattgtcccccccccccccccccccactcgtgcgtcgtcgcctagaataacgtagcgatgcgagatgattgcatctgtgactgtgtgtgtgttgctggagggttggggatagatcgtacgatttaactgcg

SEQ ID NO: 36199 - DNA, 1002 bp, Oryza sativa
cggagagcgagcggcggttcgacgacggcgcggacgacgacgacgtcgacgacgacgacgaggtggaggaggtcggcgacgcggccgccgacaggtagcgagacgagaccggcttgctggagcgcgcggggcggcgcgcggcgggggcggagttgggcttgtcgagggccggcgtgagcggcgggcgcgcggggtgcgccggatctggcgcggtagccgctgccgcagcagccaccatgccgctgccgcggccgtccaaggaaggaggcacaggggggaggagatctagctacccgctgccctcccgcggcaatgcaggtcccctcggctccagattcgccgcccccgctcccactccggctgctgctgcggcggcggcgtcggcggcgagcggcctccggatcgacgcgcgcggccgcctgcgaggaggaagaggaggaagacgagcagcagcagcagcaaaactgggtgagtggttgatggatgcggagaagcaagcagagtactagagtgaagtgggggatttttctgcgtctttttttctcttccaatgtttttttttaattttttttggggccttttgctgttgtttttacttctactcgttttgtaatctgcctttggctttgtgttgtgttgtgcagctctgccgctgattcttccagccaggttgtgtgtgggtgtggcctccttctggttagtgtggctgtcaagctgtcccagaggagagaagagtgcctttttctttctctttgatctttctaaagtgatgttaattagaacattttacagtatcaaccatggggagataatccttctgttttacaattcgataaatttagttaagcgcaggaattagacaggagtaggttacatgtttgtcttaaaaaaaagtcagcagaagctactctatctataattatgtacgtcttttttttttaaaattacatggcacaacgtagaaactcacaacgcacgcacactcacctctataaacacacg

SEQ ID NO: 36200 - DNA, 20261 bp, Oryza sativa
acatcacatctaaaacttttttacacatataaacttttaacttttattttaaacttttaactttttttttcaggaactaaacacagccgtagtaaacgttacaccttcagagagctaatagtgaacacataccttgctgccgacacagacgagcatactcacatatacgcgacattggatacccaacacacacgcagagacttttgacaacgtatctggccgttgtcacgtctctgtcaaccacggcaggccgcaactcatagatgccaatggtatcaccgaatttgcacctctaatgttttggaatgttcgaattgtttgcgcgcgtcaaagaacaattaacaaaccatgaatctcagctgcttatggccccgaacacacacacacacacgaggagaggacggtcttaacgcatccgggaattcagaatcgacatggcctctctttcaagctggtcagctaataccaaccgtccgaattaacaaactcccacgcaattggtaatcaaaggggcttggttaagctaactggcttttgtaaacacttacgcttactttactgtattctccagacaaaagcttggcagactttgctttactgtttttttttctcatacgagatggctgcagcaggagcagccatccacagtactctagtatagtggtctcctatcaattattatagccttcaaaaacaaataaagcagatctaatcatgacgccgttttattggaaaaaggaacgtctgacaaatgtgcctaattaggccgcttaaacgatcatatggatgagctattgacaaatagaagatgaaaccatgcgtgttgctacggaaaataaataaacaaagcaaaatcaatactaattgggtaaatacctacagtttgataggcaagaataaacataaactgtataaattagattgattggttgagttttcttataacgtggcctaacattatactccctctgtatcaaaatataagggattttggagggatgagatactttttagtactgtctagatttgtggtactagaaagtattacgtcactcaaaaaccaaacctcttgtattataggacggatggagtaagagtaaatgttatcaatgtgttgtatttatatagaaagaaagaacgcctaaagtacaacatgccgcctttcatcacaaattaactgtagtttaacttgccacattttcagaattgaatttttaaccctgatttgttttcccaaaatttagcgtgattacgaaagtgctgttcaataatacataatagagtatcagtttgacagcaactcttgtggctgacaattttgagcccgggcagggacaacagtatcctaggctctaatagcagaatcacagagccatcggaacctgtcgttgccaatggccggataggtttagtttttagcattaaaaaccactggagtagctaggagtgacatcgacttttatcaagaggagctaaaggcgaaaagccagtccaacgaccgaaagctcagaggatttctttttcttttttaaaagatgaatacttacggcttaagttactgattttagacgttaacaagatatcagcagtgatcagtgcaattagttgaagtgtgattcaatcattcaagggagatatatacttgtaggagaaaaaggaggcaattattgatgtgtatctgacagtatgaagcatcgcgattggagtgtcctcagcaagcaccgaaaactacagaacaaaacactgtacttacatttacaataaggcgatgttttttcttaaaaaaaaaagaggcgtcaaaaccattgtaaatcattgtgtgagtggtactcagagaacataatttgattttctaggacagtattaagtggctagctttggtcggcagtcagtcaatagcctaatagtataacttggcataatcaattttaaagtagcaactagcaagtgtccatacgagatcttttaatccccaactcacttgttccaatcttgataatctttttctgaactgttgagtggcgcctctgcagactggagtctgaacaagcacgtttcaggattgaggtttaactgagtttcgatcaaatcttcttcttctctttcttttagcaaaaggaactaaattttaatcctaacccaaacgtttccggatcagagcaccatcaaaaactaaaactagataggaaattcaagatgaaattgcaaacaagaaagtagtaataatctgaaacagctctgttcattcacataccccaagtatcatctaggcggatcgatacaagaggaggaatcgattactacatctcagagcccagtagtgagacggagaaaagaaaaaaaaaggaagaaaaaaaaaatcaaagagaagtcgcgaagagaagaggacgagctaagccacagccacaagcccacaagggagaccttctagaagcccgcgcagaggcagatgctctcggtccacggccgcggctgccggaaccggctgtgcctcctcgccggcggcgccgcccgccccgcccccgcccccgccgtgctggtgcggctcagcatctcccacatcacgcgcacgtcctcgtactcgcacgtgctcacctcctgcctcagcctccacagccctgcgaccaaacaaacccaaaaaaacatcgccggagttagcccccacgtacgccgcctccgcctccgccgcccaaccaaaaaccaccccgtctcgccgccttacctgtctgccgaaccccgaatcgggcggcgacgccgagccacgccctcctcaccggaagcacgacgcggtcccaccagtaccccatcgccggcgatcgatatcctcctcctcctcgtcgtcgtcggcgaccaccgcacagcctcgcctcccctcgattggggcctggtcgtctcggcgtcccgaatttgtacacgcgggttggggggagaaaaaaaaccaacccactgtaaccacaccctcactcacacactgacgacgcgggcccaccctcggaaagcttctgcgggcccggggtgtcagtggcagaggtaggtacggtggttgtggggagtttgttacgggggtgggcggcgtgcacgtgcctgaatgcggtaggcgatggcgcacacgtaggcgcggggatgggggttgcttgctgataaagtggggcccaggtggattcatgcgcagtcgtaactgcttggtatgtggcagttgagtggtggttacggcggcgtggcagtagacagtagtagtagtgtggaagtggacggagttaggtcacccgcgctgggttggggtgacgctgcgaagctactgcaccctgccatcatgatctatccaggtttagtatccgtgcggttatcacagatatcgtatgcggtaatctttttagtttttaaaatcatactatatcttacgataatcatcaaaagagtgatgataacttcactcaaaacggtttggtaaatttagatccatctctactggttctaaagtacaaaacacggtaatcttctcagtttttaaaattatagtatatcttgcgataatcattaaaccatgagagtgacggtaacttcaccaaaaacggtttggatccatctccatcggttcaaaagtacaaagcattttttaaaattttaagtacttataatagcagtgagccgtgattttttaatgatgattctgagtttctgactactcatattattgttgccgggtcagaaatatttcatctcttgtaaaatacaagcatttatgaaaactttagtacaaataaatattaagataagtattggttaaaatgaaaagtaagtagacaaattaaatgggaaagatgaccatcggttgaaatgagaaaactgatgcttgtattatagtataaattctaaattctaaaaatatttatattctgtaacaaagtgggtagcaatcagccaatcactacggcactagtcacctctcttgccgtcttctatttcgctttgagattcgtgcacaaagttcacgtcgcatttttaattatctggtgttaactcgtaatcaactggtgatacgcaaacatcaagctgatcgttgagctgagcagaggcagggaaacatttggttaaggcccggaaattcttgacgtgcgacgagatgaacggggcggcgcttgttgcaggtgagcagtcgcatgcacggccatacctttattgctaaaatgacaacttgtgcaaattgcgactcccggatcagtgtatataattctgaagaaaaagcctacaaatcgtcacgctgcttaggcaaaaagaaaataagaaaaggaacagatatctcgttaagccatatatataaatcgatgggacattttatacaggttgatctagacatgataacaattactcctaacaaacaagaacgtgaacgtgttaacgtgagagttgagaatcgcgtgcggaacagttttggtcgtcgagctgaaaggaagatcgatatatcaatcacgcattggaagaaaactccaaactcaatggagggaacttggaaaggaacaataagattgaccgtatagaaatgcaagggctagttggtctaattctgtctactgtctactggctcccgttccatccacatgtttattttttttctagaactccatccacatgctggaaacgaagttttctacgtactcctacttcaaaaagggaaaacacatatcccatatgagtggctaaagcagtagtcagatctaccaacaagtctcggaacgtgagattagactgactttacccgttgagttcgttaattagatggttttatgggtactggttagttggtgcagttcaccaagcctatatctgcatgtgtttagttgcagagtactagtaataccagaacatcaccccatatacatgtgtggttcctggagcctcagcgaaagcaagccgaagatgcaagttggacctttcagatttcgtgctggtctctccagaccgggcacatttcttactgtcaagttggctctacaaacaaaacagtgccatatggccaattgtaaccggacacccctgccctcttgtattctatttttatacctctaaggtcctgttcttttctccaacaaacgttggattaagattaagatttttataacacgctttttaaactgctaaacgatgtgtttcatgcgaaaactttctatatgaaagttgctctaaaatatcatattaatctattttttaagtttgtgataattaaaactcaatcaatcataagttaataccatctcattttacgtaaaaaacttcatcttcagcagattcaaacagcacctaagtctgataccacatacaaacagtatgtattgtatgaccataatagtatgagtcttaaaaaacacagactggttggactcactgtaggcctgtagcctgaccatcggtcacgcgcgctcgtgaccaccgcgaggccaaccgccgccccctggctggaccactccaccgcacccactcgcgattcatcagggtatatttaaatattcaacacttttaaatatacttcttccgtttcagcttacaagacattttaactatggtcagagtcaaaatactttaaatttaactaattatataaaaaatagtaatatttacaacactggtatattttcattaaatctataattgaataaatttttataatatatttgtcttaggttaaaaatattactattttttctataaaatcagtcagtagcttgattttaaccaaagtcaaaacgtcttataaccttaaacgaacagagtaacatttaataaaatatgtctatgttacgtgagttttggcaaattgttaaacaacgcatctaaaaaattcaccactccattactcctcatttatatgctatgaacggtaaacagtgcattaacaagggcaaacctgcgcgggtacgtttttgcagtagcggtacgacgaggggaaaatcccactgacaggtgggtccaggcgaatcagaaagcgctgcccggtcggtgaggcgagctgggcccacgccgcagtggcggcgtggctcccccgaaactaccgctccgctttttgcccggccaaaaggagagcaataaaataaaataaaaaaggaaaagaaaaagaaaaaaaaacacgctctctctccctcgagggccgcggcctcgatcgcacgcacgcactagccgcacgcgtttggctgcttgctgcggttgctcgcactcctccacctccaaaggctccaacaagaacaagaacaaatccaagtgaggccctcgcccacccaccgactccgcggccaaattccggcgagatgttcgcgagcaggccggcggtgcacccggtggaggcgccgccgccgccggatccggcggagcagccgaggggggtgctgatgaaggacctgcccgggatgcccgggacggcgggggggctggggctccgcctcgcgcagttcgccttcgccgccgtcgccctcgccgtcatggcgtccaccaacgacttcccttccgtcacatcgttctggtgcgtgccgcgcgtgccccccctctcccctcccccgtctctgtttctctttccgctttatccgctccacgtcagtattgaggtttcctcttttaggatttgaggttttgaattgttgctttagaaaggggggatatagttgtatgtggtggtgtgtgaagaccacacgttttttgccttattgatgatatctgaatgaacagagacaaatatttctgaaactggatattgtagattattagctcagcgatgagatactaaatggcttggctgactgtggtgccctgtgcaaacctgtgctatataatcgtccaattttctttctgttgtatggagtagttcactagtttatgcttgtttgcttaactccaatgtaaagatggtcattatctttagagtgcaaacttttgaacttgaatatatatgcatcatttgccgatgatgaagcatatacgtgatgctaaaaaaatgtgctatattatcaccaagtcagccgccatcaattgtttgaaggtttgttaatacataagcacgggctcttatcatcacaaatttgtttttagctaattagatgtgcaaccatactatcccatttcaaatactcccttcctttgtataccacatttatattttgtactttctgaaatttggataggggtacaatagctcataccattatcagaaagaatgacacatatatcccaagaacaatatcgttttcatccatagttctgagctcttctttagcaagttgcaacacaaaaattcaatttggcaaacacttggggacaagcagcctcacttagcatcttcctcggtagaataaaaatagtattgttgtgctgcattacctcatatattcagagatatcccgcttcaaatttggtggccatctttattatgtgctagtattgtgtgtgtctactattagtactggttttgagcctacatgtaaacctgtcatcaattcaagagacacacgcatatgctaataaacaacaaggacagagacaagatgctgattcgaagagactgttgatgagtaggaacagtgtattctgtgcaactatagtaattaaaagagccatatatattgtgttcagtatgactattaattaaagcctattaatggctgcgtagggtatacttactttctgatattccctaatttaatacctaaaccttcttcttgttatgtaggtttatccactcatattactcctatgttaattatatgaccatgtttgcccttgtttctttgggtggtgggggcatatgctctttacaaatgtttggtctttcttttagtcaacctcagttctattatactcagtttaattgcatgaataacagactaatgaattaccgttttggccagctttcttgttgcggcagccattttgcaatgtctctggagcttttcactagcaattgtggacatatatgcactgcttgttaagcgttgcttacgaaatcgccgggctgtttgtctatttgcaattggtgatggggtgagtgcaagctgtctgttatcctctttctactgcttgtgaaatccattcagtcagtataccttcatttattttctgtaagtaatggatatgtgttgttgataaattcattacaagtccttctagcagtcaacttgttcatgataacactagcatactatactccctttggtcactagaaaagagtgccctttgcggctgattccaaaagttcaagaatacaagtcgttttggttaaacgagtctcctacctgctataccttcaattaaagtcctacatgcatgcacatgcacttttactacaaaccaagagaagttgagaggcaacaacggaaaaaaacatggagagagaatgatgcataaacgggttgatggaccttaataggggtacaggcacctgaaatttctctccttggttttgtgcatagtgctgaaaactacttttattcttgactggagagagtactttactgtgactattcattcttctgcaactatagggtgcattgtcattgactttggtttttttgcagatcacagcagcactgaccttcagtgccgcatgtgcgtcatctggcatcaccgtgttgattgataatgatctagacctatgctcggaaaatcactgcgcaagttttgaaagtgcgacagcaatggcgtttcttagctggtttgctctttcgccatcctttctattgaatttctggtcaatggcttctggatgaatgaaaaccaaagaggaggttagagcttgatttttgaatgtatcatgtgcccaattcaccaattgtggttagtgagaattggatagcgtgacgcagctaattgtattagagttgaaagctgatgtgcggtcttgggatcatatgtttctagtataactctgtaaaaaaagaataggggatggcctgttttgcaagtgttcaatgtggaactcagtaaaagtctcttaagcaaggtgctttccgtataagacttccagctggttgagtttttgtgtgccatcatttatgcatacaacgtgttgattgtgctgatgaatcatacagccacagcaccactacataacaagggttgtgcctaatttccatggtacatttcagttgaaagtcgttctgaaagaaccactgaaattggtggagaaccttctatcgtcggctgacattcttgtgtgcaatacccatccatggctactggccaagagttctgcactcaccagggccaactgtggtgccgtaatctaccacactgacccatccgtagatggcactcttcttttttcccattgaatgttctttcgtagtagtacctttcaattgttccctcggtttcttagttgtttttttccttaatatgtttgtactatatgcaatggacaaaagccatgtcagataatgttctagatgtcagttatcacttgttaggagctggagatgagatgcactcctagccatgaaaacatcatcgttatcgtccggggagagacaggataataccgagatttcattcgcgtcgttacttggacttggctggcacatctcatcttcttagaatgtaaaaataaaacttttttttttggaatttgtaatactgtttgagattcactttggtccatcaaaagtacctcgagataccggtacctcacagtatcaaattgtttttatcattggatctagctgggcaggaaagacattattagatctaatgatcgaaaacgatttgatatctcgaggtaccggtacatcgagatagattggagcaaatctcactgtttatacttcagtgacatatactttacactgagaacgacttcgatcaaatcaattactcatctgtagactacaccagctttgtactaggactataccaaaaccttacattgaaatgagttcaaaatttgtgttgtaagttgtaacacaaatgatacatttacaaggttacatactaaaatactacacacctgaaatagtactacctccatactatcatgcttatttatgttcattgctacatagcgatcatgaaaaatcaaaagcaccatgaagacaccagtcatgcatgatcactttgatcaaggtctggttggtcaagaaatggagtgcctccgatccttgggcggcttcgtccgcaccctgccgccgccgagcacgtccgatcgcaagaacgggttgagcctcccgagcttcttggacatgctgttcatgaatccgccgctgcttccgccgccgccgccgcccggcttcttcggcagcggcggcctaccggacggcgggactcctcctgcggagaacgccacggatgggtctctcaggcgcatcttcatccggagcagctccatcctgagctcgtcgttctcgcgctgcagccgggacacctcgtcgggaacgcccggccggtgccggccgttgaagctcggcgtcggcctgtacgacagcgccggcgactcgccgccggcgtacgacggcgcggcgctcggcggctgcgatggcgcgcggaggcgccgctgctcgtggtacagcacctgcaccaccgtctgcaccggcaggcggtcgttctgcgccgcgtgcgcgcacgcctcgcgcgacagcttctggcagtccatcgccctgcacaccttcttcctctcgccctcggccagactcggatgcgcctatcgaatcaatccacataagcatttagtggagcgattaacgaaggattcaaccatttcttttagtgatcgatgttaatggtagcttctaaccttcaagtagatgtcaatggcgcggtacatgccgtcctcgttgaacctggcgcgctccgggatgagctcggcgagggcggtgaacttgtcaacggacaggttctcgtcggaggcgatctcggcgaggtagctatccatgagcctgccgacctgggcgacgtcgctgtgcggcggcgacgccgccgagctgaagtcgtcgtcggtggtgtagtccagccgtggcggcggatccgtggtgtagtccaggtcgaggtagccggccaggatcctctgcacggcgtcgatgtcgtaggccgttgtggcggcggcggcgtcgggcgaggaggacgggatgaggaggtcgtcgagcacggcctggccgagctgcgccgccattcgcttctcgaggtcgagccggcacgccagcgtcgtgtcgaggtggatcgcggcgcggagcagcatcgacaggaagctcaccgacagagtgttcctctccctcggcagcaggctcacgatcgtctcgagcaccacccgcttctcgtgctcctgcctcgcgcccatcttcttcctgtccctcccgtgcatgtcctgcaccacgaaccacgcgccatggtcagatgatgatccaagaaacgaaacgaccgatcgcgaccattgccggcgacgcgcagagctcagaaactaaccagccgtcgaagagatttctgggcgtagagcatgatgagtgtccccatggcgatgcccttgaagcccctcgccttcatcgcgatcatgacgcgctggaacgtgtcgatccgcagcgccgtcagctcgtcggcgcaccagtcgtcgacctccctcgacgccgcggcgcccacgccattgtagccgccgccgccgccgccgccgggggtgcccagcgacatgctgaactggccgtcgccgccgcagacgatggacgcgacggcgtcgatgcacctggcgacgagccgcgccttctcctccgacgccgggaggagctcctcggccttgcggagcacggcgaccgcgccctcgaggctcgccagcgccacctcctccaggtaggcctccgtcctgccgaccaggttgcccggcctgcactcctcggtcatctcgaggtgctcgccggcgcaacgcagcatggcgacgttgtccacggtgatctcgaagttgacgccgtagcagaacttgacgacgagctcgaacgacttggagccgccgggcatgccggcgatctccaggtgcgtcgccttgttgccgccgactcctgacacctgcttcttgatgtagccgcacctggatgccaatggaagctgcagtaacaattaaacacctgtcaaaaactcagtttttctttgctagaacacgcagtgaaaactgaaaaaaaaaacaaatttgggttgatgaaaatcaccttgtgcaggttgaaggcggcatcgtcgactttgatggtaatatcgcttgggagttcttgcgaaagtatcctgtagcaatgaagtgaaatttttgttcagacttgtgttcttgcatagttcggttacagtgttgtgatttgtgactccgaactaaaagcaggatgctaccaagctgtactgtgtgttgatttagggaagtttttgtgctgctcactttgaagcagcactatcacttctaattgaaaaacaaaacagtctccaactaaatgaagagcaattgaaacttttttttgacaaaattacagttcatatcagatagaaacaccatgcaaattaaacatgcaacaaccacaagaggaacagatgaactcgtagcaggaaggtgaggaggaggacgaagggcggcaaacgtaccagtcgctggttcgcttcatcgcaggcgagacgaaccgagcctcagcctgcatccctgaccttctctctctctctctctctctctctctctctctcctcctctcgcacgcagaagtcacaattttcacacaaaatattctctttatcttggcccaaacgcgcgtcgccgtcggaggaaatcacgggtgcagtgagtgacgcaggtgcggcaccctccggattgagccgcggttgccattggacccgcgtggtggctggacgccacacaatggcaattcgtacggcggcttgtggatggaatcggtcccgaatggcttgtgcttgctgctgccccacttgccctttttccgctgttcttttctctgtcagactcaaaattgtcttcggggagagggagacgggcgggcgggcgcgcgctgcgccttggagccatgggcctggacgaggtgggccgcgtcttaggagataaggggcgcggcccactgggagatcggtttcctgatggaataagttcacttttagccccttaactagtgaccgaatctgattcttatcctcgaaccgcaataccggatatctcgatcccctcgatgcaatctgattcgtatctcgccgcatcaactgaggtggaagcggagatatccagtattacggttcgaggaaacaaatcagattcggtcctaagagagtcaaaatgaatttattcctttcctaccgggtgaaatttccggtgacctactgacctccggtccggtccggtcacggttgctgagttgccggttacggcgccgttgggttgaagtaaaccttcccggtttgtttgatttgttccgtggagaagctggctgattgtcgtggtttgtaataattgaattaagattgttgaatcgtaatattttcctgataactaaagagtcatctttttacaaggagcaaggagccaaggaaacacacacaaaaaaaagtaataaataaaacatatattttgatcatgtactctaattcttattttgaaaatagttctcttaagacctgttcactttgatgctattttcaaccatatcttttttttttggcaaagttgctaaaaaaatatctatgtttagtttgttgccaaaattgataaatacataaaaaatcctactaaaattttggcaatattgctatcttgccatgctaaaattttggcattgccaaaacttggtaaggtttattttgactacaatctgaataggtccttaaaaatgctaataatggcatgtccacatgtgtacaaagataaaagaaaataataggagaaaaatattgtgtttgttcatttctttcttatattcaggagcatacgacaggattgtgttttctactcaggccttaattaatctgcgtgtcctaaataaccagagtatatgaatggataatgtccctaatattttttttactagcacttgcaatatgtgctgataaaaaaaatagaacgtgtcaatcatagtattagcatactgtacatggctgcctgtcattttgacgtaggtccaatacaggagcataaaatagcaagaaaacaattaaattaagcgtgaaaaaggaagggacgaagaaaaaggggaggaagaagagcaaagcggagacgaccaaccaaatccttgtcccgtccgttcggtcgccgcgtcgaggaggcagggagctcgcggcctcgcaccaccgccgccaccccgccatgacgagcgcctccgagctcttcaccgcccgccgcgcccgcgccgcccgcctctccgaccccgatccggacccggatccgcctgcggacgcgctccatgacccgcacggcctcgccgatcgccgcggccggcgccggggctgccgcccgcgccgccagctcgacgccgccggggacgtccgccagcacctgcacaccggggccccgccctcccgccgccgcgcttcgtacaccgtgagaagcacatccccccgcctcatcctctctagattttttttgttcatttttttattatttttgtgtggatgtgattagatcgaaatgatttagctcatactgataaaaatttgggaggattagggctcctaatttggcttgcgcaatcccgattggggtttggatgctttagattaggttatcctcgcctagtttatggtgaaatggggacaattgttagtgtggctagcctattctcttccatttttttttctgttactgcatcaattgtcacgttgagtactaatcaatatcgtcctggcaagtactagtacttgcacaaaagactgaaaccaaacccgatcatgctgtttggtctgttcaactgaggtgttcttctgctatgcacttgtagatcattacggtccccaaaggggcagtgataatatcgtgcagtgtatctcgagaattcgttgcatcctgtaaaggcttgattttcgttataaacattaagttgaaggagacccttatcttcatttccatagaaaatataacatatcaaaatggtgtgatggtgcctcatctttcttcactcactcctgaaaattgaaatggctaggatgtatgtttagaatattggctacgcttattagaatgtcaatactcagacctgtgcatttagtattccattgccttttcttcttcttctttttgttccagttccacttgaaattcttattatgaattgttatggatgaacattaaattatgacctaggatgcatagtggaatttataactgtacagcattctgatctatttatttcaactaagaaaacgtaaatttagattgatgtttgttgtttctggtgaatcaaatgaggatattcggtctcttttgttgtctacaggatcgtgtcttatcatacatagacaatagcaacattggggactctgcaactaggaggaaccgactggataggctgatgttcagaacaaatgagcggcttcctggtgctgtactgcaagcacaagcacgtgttctagagagactgagaggcatttctattggttcatctgtgtcaaggccatctatcacattggatgaattttcagctactgatgtgtttagaatcattgacttcgggaacagggatgctccatatgaagcaaataggtccagctcatcattggcccatccaagtagcgagtcagatgaagaaaggtcacccattgacaccagttccttaaaaagatcacgtgggctgagcaaggcggccttccttcggctacagatagagatttttgaggcaagcaaagatgacaacagggaggcatcaccagaatgctcgatttgccttgatggattctatgacggagatgagctcataaagctacgttgtgggcacaggtttcactcgaattgcctggagccatgggtacggaaatgtgctgattgcccatattgtcgaacaaacatacagtcacgatcctgactaccttagttctgcattggcagtttggcactctcattagaactgtaattaacagtaagatgtattgttgtaattcagtgttatgtgcatgcctgttacccggagttggtatgacatcactctattgaatttcattgttgccactggagttgtgctgcaaaaggattgagaattgtgtgcaatgactgatagtatatggtagtacattttttttcctttttgtaaatccgatgagaaactgacatacataaccaatgttgtttcggttgatatgagtatggcgtaggtatgaactgctgagatgctttgaaatccttgaatagtctggtgtggattgtgtcgtcaaggcagtatcatgatctttatatttgggaaattttcatctataccatcatcaggattgcaggtaacagcaaaacatgcatcagtgtagcgagttctcaatggtctttgggagttgggaggtagaggtatttatgttatttgaaggtattatacttttacacaccttctgattaacactacaagttatatatacatcctcatattttcctttttctttgatattttcctttttctttgtgaagaacaataatctagttattcttcttgtagttttcttttcttttcttttcttagaatattagtctagattttgtgtgaattcttttgtgaagcgtaacgttcttaggtatttttcttcttgtagttttctttcctttccttggagtattggtgttcaattttgtgtgtatgcttgcagctgttctgctatggcaccattctttcccattggatttctgctacctaattctttttttgtgctgctattccccaggataccgacttgtttaatgtttatgaatcgagaatactcctacgtcttttagagttttgacatccattgcgatccattgtgtaatttgtatatcatctgtaaatatactgtactccagtcaataccatgttctttggatggcaatatttcttttgtcaggaatggttcttgaagtaagggaagagtgcatccttgatgccatcctcctcccactccagctgctgccaccactcgtcgctgccctggatctcccgtagcttcagcggccgcacgccgtcgagccgccggagagcgtaacattggccgacctcgaggatctccagggccgggaagctgatcgccgggacgccccggcacaagcacgcaaggctccgcatcccgtgcaccgccagagtcttcaggcaagggaacgtcgtcggcgtcctccggtcctccgccgcggtgtcgccgccaccgtcgacgatcgcctccatgtcgtggcagtagtgtagctccagatgctccagcgccgggaggtgcaacacccagttggcgttcttgagctggaagcagttgaggatgttgatccgccggagcgccgggaggacatgggcggctgccgtcgtgtgccggaatcggatcgtctcgaggtgacggacgctcaggagacggagcctgtccagcttcggtaggcggaaagatcgacgcagctcgtcgtcggagtcgctgccgctgccgctgccggcgtcgatgacaatgtccttgacgccggtgcagctccggatggcgaggtgctgcagtctttccagcatgtcaaggcctcctagcgtgtccgatagcgtggaagggagcagggtgagcgacgccggcccggccatgtccttcaggcacagccgcctcgtcgagacgttggtgaagccggagagcttccggagtgcggcgacgctgctgacattgatgccgaggaacttgatggacgcgttcctcgcttcaagctcatcgaggctcgcctcggatgcggtggcggcatcgtcgtcgtcggcgttcagcctccatcgggtgtacctgctggcgaagacgtcgaggatcttcagcttctggaggcccaggatgacgttccttggtatgctgtcgagcatgttcgtgtcgctcaggagcaggtgttcgagctgcgtgaggtgcagcagctcaggcggcagagcgccgatgaaggtgccggacacgttgaggtatctgaggccgacgagcgagccgatctcgccgggcagcgccatgacgatggtgtcggagagatccaggtacgtgagcgccggcacgcaccggaggaagctcccggggatggcgcgcagcgacgtgttcatctgcagcatcagcgccctgacgccgcggcgggcggggagccgcgccgggagctcctcgatgaggtttctcatcagcgagacgcgctccgtcgacgcgcccgccgccgccggcgaggtgcgccactgctcgttcagcttcgacgcggtcttgatgccgacgccggcgcgcaccagccacctgttcctcgtggcgccgcagtcggaggcgatccagatggccatgtcgcgtatcatgtcgtgcatcctgacgccccgcgtgtcgccgacgacgtcgccgccggactccagaaggcggacgtccttcagagcggcgatgatccgcgcgcccgtctcgacgtcgtcgtcgatgctgctggagccggcgatgaggccgagcccgagccagcactcgacgagcttctccctctcgatcgagtaatcctcaggccagaggcagcacgtcaggaagcactcctgcatcgtggtggtcgggaggtagtcgtagctgaccttgagcacgcgcagcatgccggcgttctcctcctccatgccggtgatctcgtgcaggtgcgcgttcctcagcttgtcaatggcgtgtcgccacagctccgggtcggtcttggtagacagagccttgccgatggtgatgagcgcgagcggcagcccgcggcactcgccggcgacctccctggcgagcccggcgatcgccgggtgggacgtgacggccgcggccgtggcgttcatctcgaagagcgtccacgcgtcgtccggcttcaggcactccacgttgagaacccgatcggccttcatgttgccgcagacgatctccgacctcgtcgtcagcacgaccttccgcggcagctcgtcgccggcgctgccgtctggataaggaacgccgatgagcttcagatcgaagcattcccacaggtcgtctagtagcatcaagaagcctgtgttcttgaggtgctcggcgatcggcagagcacgttgctccaagtcggcgtccgagtgttcgtcggggaggctcgccaatggcaagccaagtttcttcgcgacgtcgtcctggagccgatcgattctgcattccttcgaggctactgcccagacgacgtggtcgaacaccttgctgctcacgcggcggctgccgcgcggtgggaaggaagctgttgttgatggcgcggaggagggtggtcttccccacccctcccatgccgcagacgccgatgactccaacggcgtcgtcggcgatgtagccgagcgcctccttgaggtaatcctccgtcccgacggcggccgccgcgggcgtcggcgccgactggtgcgtcgtggcggcgaagctgccgaccccgcgccgcgcggcgcagatcgcgccacgctcctgcacgagctgctgcgcctgccggagcgcgcgcgacgcgcgcttgccgatgcggtagcgcgcgacgaggcggaggcgtggcatggacagcgcggcgtagtccgccgcgacggcgttcccttgcttctcggcgacgcgggcgcgccccagccagttcgccgcctcctcggtgcaccccaggcggcgcagccggtcggcggcgccaccgtcttcgccgtcgtcgacgcccacgacgcgggcgtccacgatagcgccgtgcaagctgctacgctgcgcggcgagctggccgacggtctcctccaggcggcggacgttcctcgccacgtcgagcatgtcgtcgagttcgctccacaggtggatcgcgcagcaggtggacgtgctgtcggcgacttgttggtcggccggagcgtccatgtcgccgtcgccgccggcaatggcgtctgatcgtggccgagtagtcaggtgagcggcgatggcagtgtcgaatgcttccgtggacggactagatcaaatttgtgctagacatatataatggatatatgaattatgccgccttgatgataaatttcgtataaagataaactttgtgaatttgagaggatattgaacacgtgctagcagttggattgacccagtcacccagctactccctccgttttttaatagatgacgccgttgactttttctcacatgtttgaccattcgtcttattcaaaaaatttacg

SEQ ID NO: 36201 - DNA, 1983 bp, Oryza sativa
gcatgcaagcttggatcgaacccggctacttttcaggatgatggcaatgaagtcaggtgattgttcgtcttgtcttgttcagttcctttgccttgttcttgtacatgatcttaacttgtcaactgttctcttttttggggggtttacctggtagtagttttcatcagttcttactcttctctgagtgtactactgttgaacgtctgaatatgtccaagaaatgtgtaatacatcctgtttggtatgatcttgaataacttacaaaatgcagatgttaaataacagagaaatattctcctgtttggtttagtactgtaattatagaaactatatttctcgatcccattatataggcccatttattccaaatagcctagatgctagatgcacaaaatctactgttcatttaggcacaggctgcttgttcttttctcgtttcctgacttatcacttacgagaactgttccatctttgcagcattgtggcaactgaattagtgagcgatgtcactgttcgcatagggactacaaagttttaccttcacaaggtaaaaatgtccttcctttccattcatgcagcttttttttttcagagaaatgccttcataaaacttattgcaatagtaatttcttgtggttcagaagataatggcctcatgtaaggtttgatatttgcttgctggcatattctcttctctaaatgctaaaccacttataactagagcaaatgcttccattttttcttcttttgtggtttatctgtttattgaaaccttaagtaatattttaactttatgctacttttttttccttgttctttcaatgtttaatatatacttttctgagcgatgtcactgttataagtttatgctactttaactttatgcttccattttccacccgtgcagttcccacttctgtccaagtgcgctcgctttcagaagatgatcccaactactggtgatgaaaacattgagattcacatccatgatattcctggtggcgccaaggcttttgagatctgtgccaagttttgttatggtatgattgtcacgctcaatgcctacaatgtcattgcagcccgctgcgccgcagagtacttggagatgcatgaaactgtcgacaagggtaatctcatctacaagattgaggtcttcctcagctcaagcattttccggagttggaaggactctatcattgttcttggtactacaaaggctcacttgccttggtcagaggatcttaagctggttagccactgcatcgactccattgcttcgaaagcctccactgacacctccaaggttgagtggtcatattcatacaatcgcaagaagctcccaactgagaatggccttgatttggaatggaatggagtcaagaagcagcagtttgtgccgcatgattggtgggtcgaggatctcgcagatctcgacattgattcatacaagcaagtcataacagcaatcaagaccaagggtatggtgcccaaggatgtgattggggaggcaatcaaggcttacacatacaagaagctcccttccttaagtaaggtttcaatggtccatggcgacgcaaaagttcgggccatgctagttaccatcacatgcttgttgccatcagagaaaggatcagtttcatgcagcttcctcttaaagctactgaaagcaacaaatttgctaaaatgtggagagctctgcaggaaagagcttatgaagcgtattggacggcaactagatgaagcgtccgtgtcggatcttctgattcctacagtggatggggagaccacagtttatgacattgacatgatactcagtatagtggaagaatttgtcaggcaagacagtaagaatgctcagaaacataatggtggtgaagtggacagtcatgtccaagcacctagtgcatccatgatcaaagtggctaaagtggttgatgggtatcttgctgaggttgcaaaagatccaaatacacccattttgaa

SEQ ID NO: 36202 - DNA, 17967 bp, Oryza sativa
taaattcttctgtatttacggttgtacaaaatttgtttttaagtataacatctgtttatttttcttaaatgagcaggagcacccaagcttgggaaagaatgagaagaagaagctgtgcagcctcatggactgcaagaaactctcaccggacgcgtgtgctcacgcggtgcagaacgagcggctgccactgaggaccgtggtgcaggtgctgtaccacgagcagacgagggcttctgcggcggtcaccatccgagccgacagcatctgcgtcggctcgtacgagagctcgaggtcaggcgccaccaccaacacggaggacgagtgggacggcgtcatggtcgtggaagacctcagcctgtccaccaagaccaccaccaagctagacggcgcagccaatagccattgcagcaacggcaaggcgaagaaaggcggcgcgtcgacgccgaagaaggcggctcaccggaggacgacgacggtgccaaccggcaaagggcagtccggtgagcgcagcagctcggactcgtcggacagtgcgatcttgcagaagctggagcttcccaagaggaccccctccaggagcacgaagccggctgctgtgtagcgttagcttcctgcatgaattctcagtggattcgtaaggatcgttaggttcttagctgctgcttcttttctttctttcttcatgaatgttgcatagaagcaagaactaatggtttacacgtctgttggtagggatgttataatgtgaggtctgcttttaggtgatcttgttagtagcattgtaggcttgccatgaaacctatgaaaatgttggttgctactttgaggttttatgccatactcagaagttagtagctgttatgaaaaaagtttagaactttgttagaacttggaagcataattcatctgctgctagcctgtttatactggtatagtggtatgatctcagttcagatcgtgcaaagtcttgtgtaatttgtaattagacaatgctgtcctgagccaagaataacagagctgcggaccaaatagggatatcttgttgaaaggtagccagtgatgttcagtgttgtcgcaactgggctcaataggcattttgcagccattgttacctgagcgacttgggcctttttagtatttggattatacctctaaaaaagaagtatttggattgtagtatagtacgtcatactagtatcagctatgtcaagcgcatatcgttgtagagagttaaaattagtgctccttcgttaaaaaaaaaagaaacagtactctgaatatgtacacacttttgtaagaagcataatgtataatcctgtgaacgcatatgcaggaaaggaactatttttaaagtgtgtcttattgaacatagacaattacatcaagatgatagtataactatacagagaatatttttagcctatgtattgcaggaaatcagctaatgttttttatacttatcaaggaatctcacgcacgacaaactgctcaagaaaagacctgaagtcgatgatcatcctgatcgcctaggaattatgatgtgaatggaatgccatattttttaatttttttaatacatcttctctttttttaaagaaaattcataaccattcgagtgaatagttttccagaagttagaggctagtagcaaacaattagtgcaaattaaattatctctatccctaatataccatttagcattcaatagtagatttttttaagataatagaatagaatatctcggctttgcagcaaccaatagtagatactcactagtttgagaattaacgtggatactgtaccccccaacacagtaaaagatcatatccattgaattgcttttctgatccatgtaggaccggctaacagatttgactcggaccatgatccataggctcacctcgtccttcttgcttgcaaatcacttcatcgtgcatgcaaatcacgttgtctggcttgcacttgcagatcacctgctgggacccgttgacgcttctcgtttcgcatcgcatgtcttcctggaattacgactgcacgttaaaactgcatgtatttttaaccattcaattttatgatcaatggtccagatcaatcactacagtgttcactatatagtactctaaacaatattttatggtacattacttttgctacagtagacaagctaatccttaccgtcagatttagatccaaagtagcagctacgactgtttaagttgcagtccatactactactcgtcttcctggtccgtccatcacctaacctgttcaaatggctgttccaaatgggtaggactggtacacatacggtttcccttctctttcaatggtggaatatatgtccggtcggtggctcggtgcacatcatcacggaggtgaaattaattcattctacaaataggtcaatgacacttgcacctaggacctatgtgtaaatttttaattacaagtatgttctttctattacagctaggtcatttttgaaagaaaaataaataggccatcgtttatgatattggtgtcgccgtccttcacattaatgatttagcttttattggggttagagggatggaaccgcagtaccaataatgttggtgccgtgaaaaaaattatttatagaataaaatttttagaggtttacttgtagaatatgttttttaaaaggattgaaaaatccagacacacccctgacggctgatttgaccagctacgcgtgcaaaggatccatgcccaagaaatcagtactacagtaggtcaaaggaggtcaaaggagtgtgatatgcctgcaacgactgactgacacaacccataccctgcacaatcatagtaccgcatctcatcacatcgaaagctccgccacaatccaggtcctgttcagaacaacaggaggttaaagaattgtgcctccgttcaagttccgtaccatcaaccatcacgtactccgtcgaaatcgtgtcgtgccaggcgaagaagcacaaacgagctactacctccgtccaaaaatgtaatatttctagcacaatactttgtcttaaaataaagctatttttctacctaccttctcctctcaaccaatcacaactattctttttcacctactttctcttttcaaccaatcacacaccttcttcaattattctcacatactttcttaatactcgtggcaatcttaaaaatacttacattttagaacagacgaagtatcaatcgatctgaactttgcttgtcgtcggattatccagggcccgtccttctcatcggcggcgattttgtctactccttgtcgaccggcgagagcatggcgagacgacgtgcccccaaatctgcaatgaccaatgagctttcggtttatctcaccctggcatgcatgatgcatccatacatgcctcggtcttgggctcttggccatttggatcaactcaccaacagccaaatgctgaaactacgacagttcaagtaatagcagatgctagctgctggcctgctgcctagtactccctttatctcataaaaaactaatataatactgatgtgacacattttaatagtataaatttagatatatctttatctagatttatagatttattgtaatagaatgtgtcacatttagttctagattttttttttatgatagagtagactgaacggacatatggtcatataccctgtgaaaatgcaggggtcgaatggtgcaaagcgtaggctggctgcatgagctttgttgattcttccttatccactcaatctgggtacacacgtacttaacttagccacctaagggcagccacaatgtggccataagaagaggccataaggttttatagtgaccatatacattgtgaaacaaagccataagacattaaatgtaaaagaaaaatttaagcttatggcttgaccacaagcaataaaataatagggtaaaatgaatgtgaggatgaaaaattggcatggctgataaaagaagtactagaatagtacattgtgggatccatcttaaagtttactcttatttcagacattgtagtaataaccataagaatagtgggacccaccttaatactactcatggtaataaacattggagatacctatagtgcaacacctaatatagtgcaacacccaatttgtgtgtgtccaatgagtaagtaccaatgtgattaagggagtagtagtaaagcgtaacacaaacatcaattcgtgcgtgcaatcagtgatgccaacatgatcagattgcaagtcaacgaggttggataatctgctttgtctgctgagaaatgtaagagtagtactgatatgaagaaatgagctcattttaatcctgagattcttaacaggactatttcgttgcacctgtcatcattgtcgctcgatctgatatgtagccgaatgcaacggacaaattgaattattataccacgagaattccaatcattgtgcttcatgtactacagttattaccagtaccccgatcgattggctttccctgttacagtacgtcgctgcaaagcgacgacgagtcgacgacattattcattgcaccatttgaaaaaaaaaattcgcctctgcgtaaacgaagcagctagcggtgccggtgcagagccactgcacatatgcaattctgcatgagtcgaacactactagctcacatggaatcgtacaacacgcggcactgcacagtggtctcgcacagtacacaccgagcgaacgaccatattgcctgcctgccggtcaaaagagcggaacagaagcttggattggaatcgtcagaacgaaaaccccatcatcagacatcagcaaatgcatcacgcacgcatgcatcgctgatgctggtcattcgaccattgttgcacagtgcagaaactcgaacggcatggcgaacatgagccatcagcatgtactctacagtacaggataatcagttgatcacttgttctagcaacatcagtaatttggctgtatttttatgattattaatgttactgtgtactgtgtaaaggtgaagaagatgttagtgcctgattttctactattgacaccgcaacattttggcaaaatggcaagttagatgttttagtaaagtgcttaatttgatacgaaggtttggtaaggttatagagccccaccacacaatctctgcatttccatgttagagctcgggcgggccacgtattctgtcagccgtcacggcacaaatcattacggatagcagcatcacaagataagagctctcgatattgctatcgattccggcttttttccgattataattagggcagtgtatcctacaaaaactcgattgcctcccaaaacgaaccgtgtaaaaggctcacctaaaccaaaggagaaaaataccgagatgcagaagagaaaaaagaaaagggtttagatcgtacggtctagctacactcttgactctggtcgccgctgatttcttttacttacacttctctggggtcaacgaagatggagaggccaggaggtgacctggcccaatcccagccgtccgattctccgacgcggcccagccggttcatgcaccacaggtcctcggtgcacgagaggcggcgccagtgcgggatgcggcggcggagcgggtcgcaggccgccacctcgacggccacggcggccgccctgccgcgcgccatgttgacgaacgtcgcgaacagcgcctcggcggccaccgcggcgtcggggccgtcgccgccgaggccgtacacgaaccacccggagaacgggcggaagaagtccggcacggacgggacgcgcatccacctcgccgcgcggtccagcgcgcgcgtcgcggccgccgcggcgcggcgaagcgcgacgcgccgcgcagctcgaggcggaacacgcccccgcagtcccagaggctcgccagcgcccacgacgccggcggggacgccaggaagcgctcggccccgcgccactcgccgtggcgccacctcccgtcgtcgtcgatgacggcgaggaacgtgccgatggagagctggttccccagcacggcgccgatgtcggcggggaagaactcgacgtgcgcgaacctgccgtcgtacagccgctcggcgtcgcgggcgccgaggcggaacacggccgcgcggcgcgggacgcggcggcggtgcgcgtgcacggggtgcaccagcagcgacggcgtccggaacttggagtagccgcaccgcaccgtgaacagccgcagcgacgcctcgttggacttgtcggtggccatgtacgcgtactcggctcccatccgctcgaaccacgcttccatccgccgcaccatccgcagcgccaaccccatcctcctgcacacacagccaggaaaaccccccgagcgaatcacgcgccatttccctttcccgaaacgatacgccacgccacgcgacgccgcgcctccgcggacacaagaaacgaccaagtccgctgctgttacctgtggctcggcgcgacgcggagtccgagaatgtagccgacgctggcgacggcgggggcgcccgggcagctcttgccggtggcgaccgacttcacggtgcctctgatgatgccgacgatgatccgtccgccggtggcgcccgacgtcgtctcagctacctttccatcccaagacacaacacacactacaaaatgaaaacacaaccaccaaaacagcgtacgtactgacacgatatgatcgtagtacgtaccaacatgaggtagtcaggggagtggcgaatgcgggcgacggggtcgccgagcaggtcggcgtggagcgacatgccgccggtcgggccgacgtcgcactcccggtcgacggcctccgtgccggcgcggtctctcgatgggtcgtactcccggatgatgatcaccaccccttcctcctcctcttcatctctcatcatggcatatatccgatcgatcgatcgatcgatcaatctcgcaaccgtatcgatctctctctctctctctctctctctctcgactctgctgctctgcataggaatgtagcatatatatatacaggcacccggctgcagtggggttccggccttctattttctcgcagggataacaataaaactgtgagatttttttaaaaagttgtaacgcacggacgtaatcacgcagatatcgcgcgaatgcacttccttctctgagccctctctctctctcccctgaatcatgtgggcgcggttgacgggagagggaaagtgcgcgcatatacgcgcgggcgcatatgatcggccatgtatgcaagttgcagcaacatcgatcgatcgatcaattcattcaattggcaagaagcatatgaagagcagaggtggcagcagaaaaaggagaggccgagatcgatccaaccgttaattcggcggccgtttggctttgtgattccttctcaagattttatctgcgtggcgttattcagctgaattttatccatgtcgatatcgcttatgttctccgttgctgtaatagtgttgcctatgatcttgccaaaataggcgctagttgggacccgggtcaatccatcgtttggatcgactccttccagaatttgtaaatgcctttgtggttcgtgatatcactaaacctgctgggtgaataaaaaggcatcgatgaagttaaaaaaaaaagattttatctgcgtggcgttatccatccacgactccatcaaaaaaacagttattattggttcaatttaattatgggttgtgcgatgaattaacttgcgtcggctgggagtggagcgtatgattggagtggtggggagaaattaactgcgtgcatgcatgcaccacagcaccactggatcttttcttttgctgtggattgaggcttaaaaatcctgccacgatgaagctcttttgcttagcttttaattaccctgttaacatgattgggtttgtgaatccacctgtgaaaaagatcgataattgtatgcggtgatcagacaaaaggtcggccactggtggcgttacaaagatttgcaacactaaccgtggtcggttttaccatgacgtttccgttgcagagggaatggatttccgagtcagtcaaaaatcaaaagcggcagtgcgatctctctcctaggggagatagggcccacccaggcgcccaactctccaatagttaagcttatccggcaaagttagaatacagtaacagcattttagcaaactgttcgagctagcgttcttctcaacttgtggatcgatccatccattttgcatgggattaatctatccttttctgcgtcaatttgtgccgatacaaacacggttattagttaggcgatacaacttgtcggatgaagggagccaagtggggaaacatttccctatttttctgttctatcctaaatggagcgtgaatttctcaatcgaaaggattatggacagtataaagccacgcctaattctaattggatagtttgatccctgaccactgcacaattttctaagagagctcgaggagatgccccggatacatctctcacactcatgccaaatgcacatgcgtgccttgtgctgtgttgtgcaatgcacccggccctatatgcgtttcagatcgagagttatcgagagaccaaaagcttcgcggaacagggggcgagctaccatgacattttgccctaaacctgcacgtattcattcgcacttatctagcattctacaccttaacaaagtctaatatcattgatctgaaccttagcaacagaatgcaattgatattccctgcagtactgctcactgacatgtggacctaagaggctgtgggatccatatatcaatgagcagtactgcagacgatctgcatcccacagactgatgcagtaactagggcactaggtgtacaagctaatatatatgcacaaatctttcggtgacacagaaacaccggagctccaatgaggccatgaccgaaaagtagtaaagcagtagtgtagaaatcttgctcaaataattccctgaaaagcgatcctgtctgtaagtggatgagcatagatgtgactagatcgatcaccagaaatgcaccgttgaacagtagtcgaaaacaaaccgcatcgtacgtcctccttgtcacgacgacatgcctacggcctctactgttcgataggagtatatcgcgccctccctagctacgggctaccactcgcgaaaggacatgtgaggcgagcgaggcaagcgccgcgcatgcacgaatctgatgccgacgtacgcgcgctcgggcgctcgctcggctccgcgccacgggagtacgggacacccggccccccagcagttaacggcaacagcatccgcccccgcgaccgcgtatccgcgccgaaaacgacgtgccgccgcgcgctcggtgatctctcgtcgtttcctggttgggcgcccagccgggcggcgcgtgtcatcggcggctcatgatcacaaggcggggcgtgtacgcgtcagtcgcccgactcgagcgcgcgagacgcgaaacagctggtggttacccgggacgtaacgacgcgacgtacggcggaggcacggcgcgcgggggtgggttttgttgtgggtggggggtgtgtgtggccaatcgtttcggtggcgcgcgcttttttttccgccgtacaaaccaggggaaaaggcccccctttacacaatggaaaggcgaaccgtttttgaaagcgtggaacggtttttgtcgacgacggtggtgtgtgatttcaattttgcggtccggtcacgtgaaatgacccactcctaagagcttggctttagcacggatccgcaacccgatcgatcatgcggtttgagtccataacccctttgtttgtgcgtcccggattgggcataggagcttgtactacaaacgacaagccaagctacgtaacctgatctcgatcggtaacatgaggtaaaacccgatgtggtaaactgatcatcagacagcccgccgccggtgcattaaccgtcgaggggtgcaatcaagaagatgcaccgtacatgacacaggaactgacggggaggtatggagaggcggcggcgcataggccaccaccagttgccccccacccccccccccccctatacatgcatgggccccaactgctgggaatgtaccagtacagtattcttatcgatcttgaccgacaatgctacagcaaaatcagtcaatcatcagcacgcttgacaccccaacttttggtactatagtagtgccactacacctgttcggcccaagtgcacgtacgtggctgctctctccgttgaaatgaaaggtgagatcaagtttctcagacagttgacccaagatattactagtactgtactgctatactcgatagtggtagctatagctgctagctgctggtggtacgtggacgtagttgtcacgagcatgtccaccagagaaattatgcttgccatgacaggaggggaagcccaaagccccgcatgcacagcgcaggcttccgtgttgtacattctgatggtgacacggccgatcgagccgtgagaaagccaacgccggctcactcagcttgctctctccggccgggccgcgcgtgtcgccgtcgacaagaggtatggaggcgcgagagctgattgatatcagaagcaacaagcgcaagcgatgtaatcagaggcgccgccacctcaaaagagaaaaacagtgccgtgacgagcgcacagagacgaaacagcagagatcgacacaaacacacacagagagaggatagaagcagcgatcagagtcgtggcgaagttgtacatgcatccgcacgcccgcacgcatgcgcctagctagcttgggcaggtgcatccttgccaaagatggtcccaggcagcaagcaagatggatacaacggctcatgcgcatgtctccaactctcgccatgccggctttggcacatagcgagctagagatactgatcgacacacagagactgacccacaggcacctggctagctagatcaagtaaatgcacgcccgtatacgtaggggaccaatggtgccaaactcgatctctcgcaaaacgctgcagtgtgtcaaagctgattggaatgtcagctgtcaagtcctggatgcatgcaccttcatatgggcaatgcggccacgcacggatcgtgaaagcgtacaatcgtgggagccacacggggggatatctatctccaagcaagtgtacttccatcttccatgtgctgtttgctactactagtactagccagttcattgttgtttctatatcgactttgcgttcatttgtatttgtatcgtactcactgtgttcatattcggattcggattcttccagcaacagagatatgcgtgattgtgacaggttatatatggtcgtttaattgccgtttggaggtcatcaattatcaccatggtcagtcgcttgaggctaacttgcaacgggtttgttcagatgagaggaaagcagggtaggcacgagctcaaccgggtcgatcgaccatgcaagcatgcaaaccgcttccaacgctttccaggtgtcgtctccgtcatcagttcgttgcagcaacagaaataacagaacacgttgctttggacgaagtaacttctgcggttcagtactcccaatggagctgctctgatatttccaaatggcatattgtgatgggctgatggcatattggcaggtacaccatgctgttgccgttgtgttacttgctccatcctcgggacaaaagggaggtgtggctcaaagccaaaacagttcagctgaattttcttcagaaacagctcagctcaactgacggaagcaagacaagactcgtaataaagacaacggacaggcagatatttgagatggcgagtcgccgaatggactgggatgccaattttctggagcgtcgatgctctggtctactgattgagcgattgtaatgatgatcaagctaatgcattacgactagatcagaaaaaaaatgttcagtctacaggtacttccagtataattcttgacatgaacttcagatcaaatctttgaatgcttcttttggacaaattgttagaatgtaggataggtgggtcaaaaaagtgcacacaacgcaaggccacgtttttgtagtccaggtctctctgtaagtcttcctttctcaattttgaatgctttttaaaggagcttgagagtggtgaagtctactcgaatcagagtctactctatgcatagacattgtgcagtctactcgaatcaaagtctactatatgcacagacattcggtcgttggcatggagacctgtctgatactctgatctcacagtccagaaatgtttacgaggattgctgaagtgctgaacacttgagtgaaaggaggaaaaacttgaaggcagaaagagtggacttgcgcggttgctacggcaatatgtaatgccgtccaccagaaaaataccacttgggaaggaagactcgggaccgtggatttgtttttctagaggaacctgaaactttgtaggtttggattgtgaaaacggtgaacctagctgaagatgtaaagctaatgcctgctggcaagcaaacttgacaatgccagaattcagggggactgcagccatcccagatcgagctgaagacgttgaagctcaaggcctagaccatccaaaccgggctaactcattctgttggcccaacccaactactgagttgtgacgcagcgtcggtgtgtggccgctgcatgcagagcccacaaatctgcaccggcggctgtggcacatgcacacgccacatcccggattcccagtatcccaaccgctgtcccgccgccgccagcgacggcctcctaccagacgcaccggggggacggtggcctgcgccaacgagagcacgagggggtgctgcgcgctggtcggctcgcctgttcgcctcgtggtgttcccgtcgctctcaaccggaggcacccaggcagttggtggatgcaggcggctgctgccgcggcgcctgcgtcatccgtacgtgggcatgcaaaacgggggcgccctgacttgacggtggcgggttggtttccgcgacatgtaccatcgccgatgatgtgacgatgcgccaaccgaaacctctcgctctcccacagaaccaggggcttccatttacggtacgtgtaatcttctcatctcctcggatttttctttaaaagtttttttttgaacatttttttattttaattttaaaaataaacccttccaaattttattttcaaaatttgaaccttaccacgtcagtctatctagcgtggcaaaacaacattgatacgccatctacagcggacgtgacatttttatcatgcgatgcccagaccgatgtgaccaaataacaatcacgccagcgccagcgagatcggtgtaactaaataacaccagtgtaacaatattgttttgccactccagctcagttgatgtggccaaaaagttcgaccgatatggccaaaaagttcggatctaaaataaattttagaatggtttatttttaaaattaaaaaagtttaaaaattaaaaaaaaatctcctcgccctcacgccgccaaccaagtctagactctgcattgcacgtctcaaaatgaaattttggatttcagtgtagttcaacatgtaggtgaattgtgtgttctagggacttctcggaatccccaaaactaaggaccaatacacgtcgcacaaggcacgactcaacaacagcaatcacaacaaggtttagtgcgctacgaattagttccaggataagcatgagacatacatataacgtctgtatactgccccggagcaagttagaatgaacaacttgcatgttaatttgccatgaaaacacccgtatcaaactaacaactgtttccattccagaatacaaaacaccaatcatcaacacgcgaggcacgcaacacagcaaagctaggcacgcaaacgacaagcttttttcatatctacagaaagctcatccttggtcaacactaggttctctgtatacatccactgcagcaactgttgcaggtaaaaggggccatttctatggtgatatgcactcaaaaaattacatgaatcagctacactcggtgagatcaaagcagattaggacacacttcacacccaacaaatggttacagcttttattacctgtagcacagtctccagtgtgaaaagatgaggccgtgtgatgttagttgaccaccaatgtggcaagacaaactgatctacacccgtgtctggctctgcttttgctttcgttgtagcatatgagcttgcaagctacactgtttaacctgtttttcaaatatataattaacacaatgagccaaacaacaatatacaagggtacaatcaaataaaagtattacagaaattctccatacatgtattgctgcgaccatggacaagagatctcttgattgatccaacaacatttgttcttgtgttgcaagtttggcaagctcagacaccacagagcttgttccttccacctgaagaccaataaaacatgatcagaggttgccacagcaaatacgccatgaattacatgaaatgcatgcccatgtaagagtcgcctcattgtccaaggccttacaaatcaagtaatgttcacataacaggcaaacacctgcagtacacctagcttatgtttacagacaaatcgcggttctggttagccagcttatattcaatgcagtgattcaagttcgatataaacataaaaaataggcatgttttccttgggattctaggattccaactttccataaacctgtaaatacctcaatagatttgaatgcacgctggatcaaatatatcattcatgaaagatttgcagttgttagctgtccactcaggtaattggccacaaggaaattgtcttatctctcagattttatagctacaaaaatatatatgccggaagagtacacaattatgtatgaccatagctacccatcaggatggacctaaagaatctacgtactttgcaatttagatatgaaaattacattcttgataaaagagatatcaaggagaagaaggataggacatatgcaccttagacaacaaagtacacattgaggatgccattgtgtgcatcacgtccaccgctgagttaacagcttccttcacaccttgggcatcagcctgctcagagagaaacattaaaactatccaaaggggtatatcaaatcatatcagataactatattgtattatgaaaaaaatcctaaccttcgcaccaccaacaactggaagacggagagtactagccttcagtgcttcgattgctgctgacaaagcacttgaatgatgtttttcaatatgagaccactcgtctagatagtatatctgaacatgtcaaatagaagcacttagatacaatcaactttgccagaaatgctaccaaatcctagtgcaaactgcataaatagctaaaacaataatagatataatctcttttacctgtcttctaagaatagcgaacagtttgagcttttgttttagaagctggagtttgctccttttagaactgacattgtctcgtaattttgatatttccttccatgcactgtgcagagttttctgaaaaatagtgaaataagcaacattagttagaatagtagctcaaccctttttagattttcattctatggagcatacagctcaatgtattaagtgtcagaacaaatacatttgaaaacaaatggtttattccaatgtacacagctatcaaagaaaaataacaaaacagtgcaccttcacataaatccatatctggaatctaaaacaatacatttgattcaaaggcattgccaaattggaaccaaagatggagaaatgtaaaatttggtatctaggctgtttctctcattaatcaaaggcagtacaaggacctaggtgatatatcccagatgactttattgaccaagaaataatttcaatcaagttatcagccgctaatagtgcaataaagttgacaagtcactagactacgatttacgagttaagtcatctaaatcctgacactgccaacatccctagcaacatcgcgccagtatccttttgtaacctaacagtacagaaacaaaggggtatgggtccaaccattcacactaatactaaaagaagtctccttgggcaaatctgccataacatttctttgaaatgtaaggcctggtttagttcccaactttttcttcaaacttcaaacttttccatcacatcaaaactttcctacacacacaaacttccaacttttccgtcaaatcgttccaatttcaatcaaacttccaattttggcatgaactaaacacaccctaaagctactgaatgcgattgaaatgcgctacagcactggttgtttgaagtggtacatacagaaaaaaatggtttaaataaaataatcaagacatgactgcggacgtgaaaatatcttacagtttcagtatatttgatgtgaaccaagtaattaaaggactactgaaatttatctatatacaatatagagtagattctctcgtaatatgacacccaaatgcccatttgcccaccaaactaagtccactacaagcactgaaccccacagtgctatttttattaatacgcttcatgggacttctgaatggatcataaacaatcgataggtatgggttgaaggtgaatattcaaaactcaattcttcaaaatcagggagcaagtgattagcagctccattggttctcctttagtcaagatttgcatgcaacgcttgcagcataacacaccctagtttacaatgcaactatcgtgaggactagtaaataagcagctaaccagtcccaacctttttagtagtctacaaataccaacttacttatcaggcttctacagtcctcaaagactaatatctcacaataaaaatggaacttttgtattctttcctcgtctgcgagatataacaaatactatgacctcagtaatcatattgatcaagcacccccattgagttgtaaattgttctgaattcaaacaaataatgaaacagaatgtgcagttgctgattacagataccccagaggcccaaatgtacccccacacatttgcatttaggaagtgaaataaacacaataataaaagtgaaactagtagaacattaattgttttatacatagagtggataattggatactatgagtaaccaacagtaagaggattttggaatgttatagcttaaaaccagataggtcaacataatttacctcagcattgaagctctgcaccaggagagctgcatctgtccgagcattgatgcatcgccactgcaaatgtcgattatcgagcagccgcagcctgtgtgcctcctcaattctgttctccccctttttcgccctcctcacctctgcagcaaagctgatgatagatggcgcatttgccggcgcctgcattgtgtgaccattgggtgatgcctccccactccgccctcttgctgggctcgccatgcccctgcttccgcggcttggagatggagagcggccaggcagtctcggtgacatttgactgtctgagaacgatctcctgccagaggatgatggtagcggtagccctggttctggaagccggcgaaggcggctgttggtctcctgccagaacctcgccggcacgctgatgccgcggcgtgggggatcaccggcccccgagttgctgccggatgaaacgctgtcggtgtcggaggatgcagagaggtcgtgggccgcggcggcggcggcggccgggtccgaaggggagagggatgtggtggagtcgaacgccatggagcggcggagcaggtggacggcagccaggatggagtccttgcggtccaggctgcagtcgaggctgcgggcgagggggtccgacgccttgggcttcgccgccggccatcggtgctgcggccgcgtgttctccgcctagggcaccgaccacacgctcttccgccgctccggcgtgggcccgcgccgcccgcctggggacgacggcgacgccgcccgcggcgcgcgcgacgtctggtagaagaagg

SEQ ID NO: 36203 - DNA, 1647 bp, Oryza sativa
aaggtttaatggaaaaaaacaaatatgggaaattaaattttctcaagaagtaaaaggtgattggtcgtgtcaatttgttacttgggttggacaatgacatttgtgcggacggttgaagcaaggtggcgcagtataagattccatatatgatgatgattcaatggtagcgtttttacttgaaaaaaaaacttggtaaatgcaatagcgtgatgagaaatgggagccaggagtgaagtgcaagggtgataaataataggaaattggaatacatgttttctcaacttataaaatatatattgtatttgaaatagataaatcaaacgtgaagaagaaaacgatcaataagggacaaattttggtgttggaaagccaagtactggctgagaagatttgggtaggttagctagactgaatatgtctagtagtacttcctttagtttaggatgttagcgaacgaatcgaaggacattttgtcctgtttatattgtttagtaattgggtgtttgtgcgtgtaacttgcgggaggattaggcacacgtaccggattgttttttgcttttttaactttatcttgttcttcaatgaaatgatgtactcctaattcatttccaagcttaaagaagttgagttgcccaaaatgctatagtacaatccgtgctgccttcatttaatatggataataatacatgacctagatctcaaattttgtagaaaagttaagatacataattctccattatggaattaataaacatttttactgtattggctatatatgcttgacttgatttcctacctcgtatctacaaacaaatagccatcctgctttgtttgattgctacatgcaaaaaaaaaaaaagaaaataagaaaacataatagtgttttttctaggtaacaaaaagttaattgaatgcgtgacagggcgatattgatgcaaacaggaaggcaacgttgttataaacgcggacaccaatcacaccaaagaaaaaaaattatcaaaatgctctgcattgttttgttaatttttttttctttttttggttgctgaaagagaaagtgagaaacacctgaaagctttgagccacgatggttacgcaccttatagtttgactaagatcatcagctaatcaaaagtaaaagtagtggacatatagatttttttcaactagagatatttacgcttgaattaattttgatggaggagataacacgagttcacttcaaggcttgacccgcatgttatctggcccggttgtgaactcgtgtgatggctacttatgatcttcgttgttgggactgatttagttttcttcagttaaacgtcacaattattgatttttatcacactctattaaacttaaaaaataatagcaccaatatggatgccccaccagaacaattctttagtaaaaagttcagtgtaaatggctcgaggtataaaaattgacatgagcagtttctccgaaaaggattacttaaacaatactagcaagaaacgtatagtttaatttttttctcttttgataaatagaaagagtgatggatagcacacaaaaggtaaacaggggaaagttgtttcctttcgctaaaagaaaggtaccatctccaatttcttgttggactttctgtactaaatctccaatttc

SEQ ID NO: 36204 - DNA, 543 bp, Oryza sativa
  unsure (1)..(543): unsure at all n locations
tctaaatattgcaaataggggattaaacacaaaggaatagttacgattgaagtggtagatctaatcgacccggcaaatcaacacaccaattattaggggctctaaatttatagtcgccgactaatcaagcgaggacaagagacaagtgaatgacacttggcaaaattcaattaaacaaaactcaattgttctagagggtgtacatagacatttatagaagaaaatagatcaaaggtttagtgctaattcgtggaggtgggcctagtgtattacaaggtccaagtaccaagttnnnnnnnnnnnnnnnnnnnnnnntgttttgacaatttccgtttactcggaatgaatttgtatatgaaaccggatgcgtttgaaaggtgacgagataagctttccatcaagtctaacatcacccgaatcggagttggcatgaagacactacgtccatttgaagtcaatgctgtctccggaggtcgaactggattccaaaactcattggagatgtatattgtagatcctccattcatccgatgtattctttgg

SEQ ID NO: 36205 - DNA, 659 bp, Oryza sativa
catcataacagacaatggctcccagttcattagtgccgacttccaggattactgcatcaggctgggagtcaggatctgcttcgcctcagtttctcaccctcagagcaatggacaggtcgagagagcaaacgacatagtactacaaggaatcaaaacccgtgtatacgacaggcttatgtcacatgacaagaaatgggtcgaataactcccatcggtactatgggccgtgcgcaccacaccgacaacgtccaacaaggagacacccttcttcctcatgtacggcttagaggccatgctccccaccgagctacgatatcagagtatacgagtacagaagtactccgacgaggatcaagatcaacagtgaaacgacgacgtgaacctactcgaggaacaccgagaacgagttgccgtcagggcagctagctaccaacaggcccttcgccggtatcacgagaagcgcatccaagcacatatactttcgatcggcgactacgtcctccaggaggttcaaagccaagcagggcgaaacaaactctcacccaaatgggaaggaccgtacacgatcacacacctcttgcagccaggtgcattcaagattgcagatggcgatggtcgcgagttagcaaaatcttggaacaggggtgcaggaacaagat

SEQ ID NO: 36206 - DNA, 538 bp, Oryza sativa
aggaaactttactatggttgtgtaccaaacaatacaatggattgaaaacattgggttagagtggattatatttttctttgttttcccataaaagtggagggatagaaaattttcatctggtgcattcctttgaacgaacgatagtgcactgtccattccaaggactatatattactgtacttttccttcacaataagccctagcagtgcaagccacgcttggcttggcgtgccttcagcctattccaacaaggattttggaccaaaattcatctctaggtcacccaccccacagtgctgtacccacgtcttcctcctcatcctaatccccacgccgcttttctcggcttttcatccccacacgctgattctcgccagaccgcctctttcctctcccctctccacctcaccgacggcggtggcggcgtcctcgatggcggaggcggcgcggtggcctcgctggcggaggtcctcgaggcggcggctcagatctggacggacggcgacgcggcggcacacgtggcggcggcggcggctcg

SEQ ID NO: 36207 - DNA, 430 bp, Oryza sativa
tggaaactagatatactatgtccatccatcgatccctcgactcttgaagaaatgcattcgcttagatcgaaccaacacaaaagaaagaactagtaaaatgcagtcgcttaattagttacctgcgtttggctgcaggttcactactacagaaagcgtttttgcatacgggcggaatcgatcttcacatgcggttggccggcccgcatgcgcgaaatggtctgcaaagatcaccatttgcgcatgcggccgtcgcagccgcatgcgaagatcgatcttcgcatgcggtcacttaagacggccgcatgcgcagatggagatctttgcagaccatttcgcgcatgcgggccggccaaccgcatgtgaagatcgattccgcccgtatgcaaaaacgctttctgtagtagtgaacctgcagccaaacgcaggtaac

SEQ ID NO: 36208 - DNA, 596 bp, Oryza sativa
tgcaccccagcagctgcctatcagttgagctaggcaccgttctcaacagagttatactaaacggatcatactaccagaaacttgttaatccgtaacggattcttggtgatggattcataaaccgtcacgacagcggcaatccgtgacgataatcttttttccgtcatggacgtgcaccagtggttattcttggcccgctaactcatgatggttttatccagatcgtcacagtgtgtgattttaaaatcttcacagtgtgaagataatcaaaaggcatttcaaaacttgttttgcttgaaaaggatttgaatttgaggttcaaatgaattttttaaaaaatgaaaaactacactctctcttgggccatttctggctgtcctgcagccccacatggccacacccacactctctccttctcttgggctcggcccagcctccctcttacgctttcccccttcagctgggcccggcccattttccgcatgggctagccgcaggccacctgcgccttgtaaaaaaaaagagacaaaattgtgtagctctttaggggattcgaacaccctcaaccaaaagcacaatatccctaaggatccacc

SEQ ID NO: 36209 - DNA, 1485 bp, Oryza sativa
cccctgttgttttcccagaagaattaacaaaataaacaggccaaggatttgagaaataaaatgataacatattagttgcaaggttaatcaatactggaaacctattttatacacacaagccaaaacaaaatcaccaaaacttctaaaaaaattgtacatgtacttttattgatattagccctgctggtaaagtctcctcttcaaattcaacacacaaatagggaggaaaaaaagtaggatagatttatactctcaaaactataagattaatttttttatttgtttttttaggctaaaatataatgaatttgaggttatgatttgacacatgaatgtaatattatttgaagtatttgtattttttttagagtttttgataaaatttgttagttggtatatatgatgtgtactctagaaaccacgtgtacacgtttctcaaaactaaggttgtgtttagatccaaaatttagatccaaacttcagtccttttccatcacattaatctgtcatacacacataactattcagtcacatcatctctaatttcaaccaaaatctaaactttgcgctgaactaaacggcgcctaaaagaaaataaagcatatgtacacagcattaattgttcctaatgaatactactgtactactgtacgtacgtttacgtctatatcttaccttcacttggcttggacccacgtcgagaactgggcacccgtccgatgtggctgtgatgagtaccgttgctctctgcggcacctactccctccgtccaaaaaaaaaaaagataaacccttttttccgtatccaacgtttaatcttccgtcttatttgaaaaagttatgaaaaaaattaaaaagataagtcacatataaaatattaatcatgttttatcatctaacaacaataaaaatacgaattataaaaaattttcatataagacggacagtcagagttggacacgcaaactcagggtttattttttttaaggacggagggagtacgttcatcccagaggctccagctcctaatcctactgaatacaaaaataagtcgtccgggggaattgatcaagaaactaaaatgatatagctagctatgttaacaaatacatatatatggtttgttactggttgagtgtcttacgacagaggctagggtgtaatatatctttatatattattactaaaggattcaattatggttatttgtgtttatcttaccatctcccgcctggttgtgcccatcaccttgagaactggcactggtggagaaaccatctttcgtcggtcggccgatttccacaatagtcccggatgcaataaaaaccggggctaaagatgatctttagtcccggttcaaaagggaaacgggcatatttgatctttagtcccggtttgtgttaccaaccgggactaaacatcatctttagtcccggttcgaatgctgtcaggacctgtcagacccccccgggatctttagtcccgg

SEQ ID NO: 36210 - DNA, 3168 bp, Oryza sativa
attattattcaaggccccaagcaacctggtaacgacatcgacgtgtacctaagaccactggtcgaagatcttaaacagttgtggcagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcacttactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcacagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgtagcatatggaacaacgcggcgaccttcacccggaaccaatggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtctgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcattctgaagaagtatgttcgtaaccgtgctcgtccagaggcaagcatcgccaagggttatggaacagaggaggtcatcgaattttgcgtagaatttattgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgcaaggaacatcggtaagtccgatgcatggattacacgacatcacattgatactttccccgcgtggctacgacaacatctcatgggtaacgagtcaatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggtagagggcctgataagcctaagcgtcaagtggttctcccaggcaaaagaaaaatcgtcggagttgaggacaagactgacgaggattacgatcagttggatgggcaacccactttcacggtgacgattgaccctagcatccttctatcaaatgaagacaccccttactcacgcagcgatcacaaggagggaacaatagtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttaaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagccaaaaataatttttcgaagtaattgtcattaatctttgtactttaaataatgttaatgcattaacttctattttataaacacatatgtaagcgaaaatcatatgcagcgctataatctttagtcccgggtcttaaccctaaccgggtttaaaaagaatttcgaaatagcgggaaaagatatttactcccggttgttgagaacaaccgaaactaaagatatctttagtcccggttgttgagaacaaccggaagtaaatatcttttctttactccc

SEQ ID NO: 36211 - DNA, 8827 bp, Oryza sativa
cccacaacgccacgccgcggccgccgtcgcacgccggcgcgccaaccgccgcctcgatgccgccacaccgccgttaacgaacgagaacgagaacgatcgaacgaacgagagcgagaactaacagatgcatgtacgttgccgcgacaacgtgaacgagaacgagaacgatcgaacgaacgacagcgagaacgagaacgatcgaacgaagacaagcgagaacgagggaacgaacgtgaatgaggacaagcgaacgaacgtgaatgagaacgagcgaacgaacgtgaacgagctagagaacatgaacgagcgaacgaacgaggacgaacgttaacgtgaaatgcaatatatatatatatatatgtatatatatatatacatgtatatatatatgtacatgtatatatatatatgtacatgtatatatatatatacatgtatatatatatatatatatgttacttcgcatttatcctaatacattttttttatcttgcagaaaagacgtgttgtcggagtcgtccgtcaagcctgagtggaagaacagcttgagtggaagacctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcccgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacacacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggctcgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactagcgaagaacaagggcacgcggagatcatgagagctttgtcccagattcggagaaagagatgctgtggaccaaaatgctcgagacattcacccttcctgcgggtacagaggacaaagtgaaaaggtggactctgaagaaaatggcagaacagtttcagagcttcaagggagatctgtaccagaagtatatactgaaggggcagacaccaaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggatgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccaacatcgactcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccctagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgactggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatatacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggataatctcgtccatctcctgaaggcgcagcattacaagacgttcatactgttgccatacaacacagagttagtttaattttactgtcttcctatataccaaatttcattcccgtacgaacttgctaagtgtttcatatgtaatgcatcccacgcacattgcagattccactgggtgcttttactcatcaacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttatccgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatatatatatatatatatatatatatatatatatatatatatatatatatatatataaaccatgcagcaacaggggcatgcaaaaaaaaaaggttagctggatctttagtcccggttggtgttaccatccgggactaaagatcgatctttactcccggttatttcacccgggactaaagatagcgatctttagtcccggattggtactcccggtttggaaaccgggactaaaggggggttacgaaccgggactacaaagggtttctccaccagtgtggatcccggaatctggctttgaagacggtcgccccctgtactgttagggttactgcctccagttgtagcattagcaagctgcagagctccggatccagctacttggatagaaaaacaaaaatagatcaccaggggaattcagaaactaaactagccaggggaattcagaaactaaactagaataatatgtatagtaaggaaaataaacatagtctcgtttagacggtttagttaaggtaaaatttcattgtgagaattcacttggatatatatatttttagaaatcataagctgtagttaggagtcctatcgtctcaagttagcatgcaagtttttttaaaacagatttcttatatgattccttctgtattatcaaaagtgaacattcctaataaccgactcaaatacggatatgtatttccaatactgctgcttcaaacctttatatcttgaaaaataaaaaggctatgactgaaaatatatacattttaaaaatctactgaacaatacctacaacttttatgtagaaagcatatttttattctgccatttaaatggtctaatttgcacttgaaagcagacttcagaatctgtccagaatttcagagggtactacaacaactatatctggagttctactcatccgatcaaagtttattttaccaatacgaaaagctaagaaaaatctctataactttgtctataggcggtctgattgattccgctgtttaccccctcaaaagacagttcaatctactactatccagattacgacataaaaacaatggtcatactaaaaaatttatatctcctaaaccacttgagataaaatcgcgccatttggtcagaagatagatccaaacattgtctacaacttactagttatatgctttcgcagaaaaaatcgttttgatcctccaattggagaacttctgagaatatgatgggaaaaccaacccaccactcctcctgctcctcttgtcttcctcaatccgttttttccaatcagattcctgatcgcctattcgatcaacagtgtaaaagctgaacttttgcacgtttgttctaagatttccccaaatacactaatttaaagctcgaggtattacaacttttttcaaagttagagtatcacgactataaagtatagtatgtctgaagtttgcatatgagctaggcaatgaacacaatagaataatgcctaaatcctcttcatcatactttacctccatagactcaaggttagcaacaattttcttgaaagtggagagatgatccatcgcagatccatcatcttgcaacttgtgcaaaaataacttttgcttccggtgcatcttactagttagatccttagtcttgcatatctgttccagcttcaaccacaacctagcggctgtcttcttcttaagcacctcctgcataatatttttagatagatgaagatgaatatatgacatagccttatgatccatttcttctcatcgtcgaaccaatcttgagtcctcttgacaaatccagatagcgcatcatcgaggtcttgctgtgcaggaacggttcgcatcttcacttgtcaaagtgaaaatcttgtgtctcggtccaggagcggtagatcatacttcaaactcgccatgggaattaatcctgattttgttggtaagaaattaggtacacctagcaaaatcgtgaaacctggtacacttctcgtgtgcacgtagcgtagatctggcttcttcctggtacacaagcttgtgtgcgcgtagaaaaatcaatgtgaaatttaattcacatgaacagtcagaagctgtactggatcctggtcctcctagggaaccgtgcgcagtggatggcttgctgctgctcctccaccttttcctgcgcgacgagacgatgagacgacgcgcggctgctgcggccgattctctgcgacgtgcgctgctgctccttccccggcggcgtcgacgacgaggctaattagatcgatactccgatcgtatcgatcttcaatgataccacttgttataaaaatagatagacacgaatttttacgtggaaaattcttacgggaaaaaaccacgggtgtctaccggcaatgattactatagagaaattgattacaaacgtaggagaataagggaacgccaccccttcccgtactatttacaagactatatataggggacacataataggaaaagaaatagagttctattaggaaactaatccgaatatattgtgggcccaaaattcgaattacatatttaacagcagacttaaccttgattgagcagataatataaactggctggaaaacacaacttgaacgctttttttaacataataatgtaataagttttatgataatgacgtacttattgagtgcaaccgcatcctttcttagctggatagacaaggaaaagaaaaatgttgaaacggttagtcaacgatacaaacgaccatcaaatatagactaattataatttaatgttcctattttctctataattttgattaaacttaaaaattagaaaaatatgagcgaattattatatgaaacggaaggatataatgtgcgtctctcttaccgtcgactggtgaccccggcggcccatcactgtttcgagcacgtgcaacctgcgagcttccatgtgttgctttccctgaagaattaacaaaataaacaggccaggatttgagaaattaattgagaatgtactagtagctaggttaataaatactgggaatccttctatacacacaagcctttttatatacaccatacccaccaactaaaaaatataaccgtaaattccaaacaaattgtacatgaactttcagtagtattacacctcttctaaagtctcatcttcaaattcattgaatagagagcaacaaaaaagataaattatgacatatttatactctcaaaacagttaaattttttattttttttattacgtctaaaatataataaatttgatgttaagattttatacataagtacaatactattggaagtacttgtaaaattatttttaaattttttggtaaatttattagttggtgtggataatggtgtgtaatctctggagtcttgtgtgcacaataccaatcaatattactgtatgtttacgttctctttttgggcccaagtggagaactggacgcccgtctcatgtggtttaattagatcagtaccgttggtcgatgcgacaccaatgttcgtccccaagctgcgtactccagctcctaatacaaaaaagtcggcaggggaaattgatcaagaaactaaaatgatatagctatctaagttaacaaatatatatatggtttgttactggtttagtgtcttatgacagatgctaggattgtaatatcttt

SEQ ID NO: 36212 - DNA, 24492 bp, Oryza sativa
  unsure (1)..(24492): unsure at all n locations
catctgatccagcccggttgtgcccatccccttgagaactggatcccggaatctggctttgacgttggtcgcccccctgtgttagggttactgcctccagctgtagcatgctgcagacttctggatacagctacttggatagaaaaacaaaaatagatcgccaggggaattcagaaactaaactagaataatatgtatagtaaggaaaataaacatagtctcgtttagacggttcagttaaggtaaaattttattgtgagaattcacttggatatatatatttttagaaatcataagctgtagttaggagtctgatcgtctcaagttagcatgcaagttttttttaaacagatttcttatatgattccttctgtattatcaaaagtgaacgatcctaaaaaccgactcaaatatggatatatatttccaaaagcaaacgaacttaacaaccgactcatacatggatgacgtatcaaaataccggcaaaaatatcttcaatttttataatactatatatatagacacacacactactctatctactccataatataagacgttttggcctcttcatcggccgtatatattcactgatattcatatgagtttacatacgcatataaaacacataaatggaatagtgcatgaatctatttaaaacatagtgtgaaacagaggaggtaccttttgcgcctttctgttctgcaggaggactattaatgttgccgggcggcatcttgctatgctttttagcacccggtgcatgggaagggcctccacttgcagatggtgccctgaagaagaacaagtaacagaattaagcggggggatcgatgtgagtgagatccgaacgcattgcatgattgcatgccgaaccacggagataattaatacaaatcacagaattactaataaattaaaccaaacatgaatacgtacatggaactatacaagaaagtatgtgtatgattttttctagattttttagtgatattttttagttggtgtgcacgtgtgtacacgtgagggcctgtgtgcataggatatgttgctatatatatatatatatatatatatatatatatatatatatatatatatatatatatcccctggtgtggacggacgatatatattaattgcaactctctgaagcagcaaattaaaggaaatgcgcaatgcagcagaaagatcgatcgatcgatcgatggagctggattgcctttgttggtttgagtcgacgacgtaggagcaagatgatcgacatatatatagtgatcgatcaggaacgcgttcgaaaggcccaaactaacaagtatatttttctgttattattattattattcgtcattcacaagctatagtagctagcaaggtttgatatgccagcctccatcgttcgatcgtctttcttaaattttctctggaacgcgcgcaggtcgatcgaaacctaattcaactcggacggatggattcgttccacaacaatttgaaagctacgtaccacgtaccaacttcatgaataatgcatgcgtagatgtttctccaataggcgcgcatgcttgctggtacgtaccatatgttacaatataattatttgcatcaattagtttcttgtcactactgcctagctagatctacttaattaattactccctatatataatttgtccgacctatcccgcgcttgtggagattaattagcactcctaatatataattagctagtactacatttgtatatacggaaacttcctgttgcattaggtatacgccatgctgtagtacatatcaaccagctttgcatgatcgctcttaatttgcttgtcaagcaacaattcaattaataattacggaactagtagtactgcatatatatggtgcgcgcgcgcgtagtgaattatacatgtacgcgcctttcacgtattcgagaaacaatatatataatatataaatactcgtaaaatttgtaaagtacttacaacgggttaaaaataattaattatcgttttggacgaagctaaacttaatttgaagacaaacaagaagagcatatttttatagatttaacttatataaaaatatacttcaataaaatatttgtttatatttctatatatatttgaatagaaaatagtggtggttaaaattatttttttataccgcgtgcccatatctaaaatgaaaattatttttagcttgagggagtaatttgttaagaataatcgcatctcacgtacgaatgtgcacaattaaccttcggcttgatcatttctaatctccatgaatttcttccatacgcgcgattgacatttttttatggttactcgtgctaacttccataaaatataaagggaagaagagcacagacatcctggacgcgcggtcttcatgctaattaagtttacttgatatattactgtacacgtagaagaagaatgaagtctagttgacccctcctaatcttccatggaaatccatttagtctcatgttagcgtgtggaaccttgagtcaactgtactgttgtaatcatagaaatgcatatcaatatataacgggtatatgtttgtcagttctctgccagacatatctaatatggtttcatttggatatatatatgacacatttggcatatagctagcttgggtcattgttttattgaaacatattaattatatctctgaattctcatgggatcgttcctctcaattaatgggctcttgcgcattgaataggtcgactatcattcaaatatatattcagcgaataaatttattgcaaaacttaatcactaattaatggttgaataatactgtaatcttaaccgtcaagcattcggtcattataaaaaatatagttaattagatacaatgggtcagttattttggggctacgttttaattgagctagtcacagctttgagccttaattagcttgtctataactcatcgttataaactgttaatgataactagaatcgttagtgattagttagagggttaacgataaacaatgcccattagatgcattaattatcattcatctctatacgtcgtacgtatctattccctccttctcaaaatataaatatttttagaatagtgccaagtcaaactttttgaattttgactattaatagcaatgaaaaaaaatcgatcatataaatttgatgttacttaaacaatcataatcaacaagcgcccgggttcatcattttacgtactccctccgtttgatgtattttacctatgattgggttcgggtttctgcaatgtgtttttaatttattttcccccaaaaattgtgtcgcaatcgatcgccataacatgcctacctatggaaatctgtttttgcgtgcagatgtgctgcccgtctaaaaaaattgtgatttttaccgacatcgggtgactggtccccccatctgcaaaaatggattcaatctggccgtaagggaaaagcgcatttatatatatatatatatatatatatatatatatatatatatatatatatatatatatatatatatatatatatgtatgtatatatataagtgaagattaatgtatatttagttttagggagtttcaagatttcagacaacccatatttttctaattccttgaatagcaatcgactaaagtctagtgacttccctatacttattatttaaacaatgtatattctttatgatataaaaggacaaacaataaataaattattctaacctcaacctgaaataaacttaaaattcatagaaaaatataaaaataataaacatggatcaaaaataaactaaaatcatatataacaaaaagaatgtagttaaagtgaaattaaaaaaagcaagttcaactgtaatttttgacttaccaatgcgtaatttttggttagtcaacttttacacatttttggatgtgtaatatctagcaaatacaaatgttctacattacatacgggttttcgttctcttaccaattcaatatataggaaagtaataatgtaattagaaacttacatatttatacttgcatagtctaaataattggagtgtctacatttcaggtgagtacagaaattttagtcacttttttcgtcgattagatgacaatccggtggttctcattacccctctttctcttatataaaaggttgaacaacatattttaacatagaaaaattaaataataacaataaataaacttactattcataaaagttacaattacattaaaaaattaacttcgatcaaaaaagtaaaatgatatataagattgacattgcagttaaaaaattgtaaaattgcacattaaatatcactgcaatttaatatttaggaatgtgcaattttaggtgactaaaaatttataaacataaaattaaattttacgtttaggaattgcacattgaataatcacacacacagactcacgaaatatatattgactcggaagtagttagtccatccatcaaatgtacaacatgttcaaacacaataattgcattttacgtacttgtaatatatcacatctttctttctgttcattctttgtagttaatgaagagtcagtcttgcaataattcgttacgtaattataaaatcggattctttgtcaggtagttcgctaatctcggatagatccgaaacagttgtttgctaaccccaacttgattccaaaacaggacacattattccctatggtttgggataaaataatgtataataattttccaaatccgtgtgatcgatataactctgcccgctgaatgatataagttgactgattaattaatactgactttgaaaacttcgtaagtcctagaatttcaaacatgagttttttactgttgtttaaatttttttgacactttccacatccatatacttgtcgtggattgattttggagctcacaggcacatagagcccgtgactcactccgttattgagcatcatcaccttgtccattcctccattcgattaacaaattaccaaacatatatttggtactattgaagttacttaaattttataaggccaagatatatttcgaaaagaaaatgtaattaatacaatagtactttttatttaagattctgttagaaaaaagtaacagtgacaaagttagcgtaattattaggttcttgtggtgcaaccagtacaacgggttcaaatcctagacttgatacatgtgctcacatttacggctaattattctttcagtggtacacaacatatcaatcgacagcaaaagctcgtgatgacttcatcaatctcaagatatgccggtctaatttttcgaatgtaattataggggtagtgtatatattcataggattgatagtgcgcgtgttatgagcggcgtttgtaccgtgtttctaaaaatataaaggaaatagtatatatccaaggagaataagtcgaccatctccaacctcgacagtgtaccagccaagtaatacctagaaatagaacaaaaatacaaagggaaaataaatttcagtcaaaacaagattttcaattctgaatagatactagtaaatattttgatgatatcaaaatatatacgctaaaaaattttcactactagaaaaatcgttttctcaggcggccaaaaattattttccccggcaggtggaaggcccgcttgtatgcataagcctgtgaaaatattttaggcgaacaaaaaaaaaaacaccaccactcccaccctctaccctacccacctcccaccgcacagccgtcgtagccctcccacctctggccagatctagggcaggggtttcgggatggagagggagagggagtagaggtgagggcagactgttgcagaggtgccgctgccgccgggggccgccactgcactcccccctccccccctctcccctctgggcagatctgggagggaaggagggaggggagccgccaccgctgggagggaagccgtgtcggggagggaagctgccaccgcctccaccctccgcgccgccgccgttgcctccaccagatctgggaggagggaggggagccaccacctccttcaccctccgtgccgccaccgccgacagccgctgccgcctccacccttcacgttgccatcgccctctggccacagcttgggagaggaggaagggaaaggtactgagggagaggtgggaggggagagccagagaggctctaacttagggcctatttagtttgtgaaaagaaaatttttaggtatcacgtggaatgtttgaccggatatcggaaagggttttcggacacgaatgaaacaactaatttcataactcgcctagaaaccgcgaaacgaatcttttaagcctaattaatttgtcattaccacatgtgggttactgtagcacttatatggctaatcatggactaattaggctcaaaagattcatctcgcgattttccccataactatgtaattagttttatttttatctatatttaatgctccatgcatgtgtctaaagattcgatgtctttatagaaaaagttagctattttggtgggtaggtggtgtttttaatatgtataacctttttgcaggcggaccttttagtgtaccacatgcgaaaagcctgcaataataaaagtatttttgcaggcggacctcttaagtgatccacctgcagacaacgatatcaccgacggttgtcaatttcgcaggcagccatttagctccgagaggcctacccacctggaaaaaaaatagcatcgtctggataaatggttttctagtaatgtttagaagacaaagaacgacaattaattcttgtacatggaggaaaagataaaacttgtccagaccaagacaacatcgatccttggtaaaactaagggttaattggatccatgacattataaattctttagttttgaaatatgctattactattcacctatttgaagtgatgccattacaattttgaaggtatttgaaatatgccactgcataccctttcaacacatttaacaaaaactttagaccaaattgcccttgtccttttcctctgtctcctcccatctctcctgttcatcttcttcctccctttcttccccttctggatctaggtcgggcagcttgatttcttccttcccatttttcgccggtgaacctcggctaaggacacccccttcacctttactccggcgtggatcttcaaaccccgcgaggaggtgatgaacgtggcgtcgagggctgggtcgtggcggtaccatggttcgactctgtgaagtggacgaggccgagggaccagaggccctggcgttggagctcagccatagccgagggaccgtgatagtcgtcgtcctcggtggggaatccagtgctcggacgctcggtagggaggtgcaggcttacagtggctgggtaggcacaggcttggtggatccatggcagcagagataaataggagagatggaaggagatagaggaagaagacaaggacaatttggtctacattttttgttcaatgcatcaaaggggtatgctgtggcatatttcgaatatatgaaaaattgtaatggcatgacttcaaataagtgaatagtaatggcatatttcaaaactgaaaaatttataatagcataggtctaattaaccctaaaactaattggttctacaaagataatcaaatttcacaacaaatattatttcttaaataatacggtcgacacagtcgactctttaaattcaaattaaaatgaacaagcaaatgattttccatctccctataagccaaaccccacatgataaaaatatgaaattataaaagataattgagccctatgatcacctctacagaaatcatttgtacaggcatctgccatatttatctaccaacggattaaaaatgcagttacctatttatttgacttacagggccatccgcattgcctctcgcactgagaccggcggtgacaacccttgccgctgtaagcacccgtccctccttacttcgtcacgtcacagccagagcttgctgctggaaaggcaggcagtgagctaggacggcaatggataggctccattccgtggcgctccaacagatctagcgcgagcaaagctggatgtgcgtggatctagatggccggggctgcgcaggggtgaagacggccgaggtggcgtgagaaggaagacagcaggtggcgccgcaaagcctcgcgctgaggccgctcggtggtggtgaggtgacccgatggtgatgatgctactatttagtgacgcaaagtggcagcggcggttcgaggtggcctctctaggtgtggggatggctgtggtggtgggatggcgccggcctcgcgtgcagacatgaccgtcgcagcgaggcctcccttctactcgacgacggtggggatggtgagcggcgggcagatctgcaacagcgaaggcggatctgacgcagtggcatggacatcagcgcatcgaggtggagtccctgggtgctccctactaaaattgcacaagaaaatagggaaagagccgctaatgagaaaaaagaattagatgctaaaactgaaaatcaacaagtgcttaaattgaaaggatttgttatgctagctgttgacggtcgttagcgatcagtttcgaccgtcaatactaccaaaataaaggagaactagttatgcttgtaatgtatatttgtgttagaataataatattccactagtattaggattactaaccttttgcagagaatgaaataaaatggaggagaatcgacatcaaatcaaacgatcaatcaatcggatgatgacgagaatcagacttatgcatgaatgggccaagaactcagaattgacacgacaaattggaccaaaattcacaagtccgaagtgagcaacagaagaggaggccgccagccgaaaatgggctggattgggccatgtggatctagggttggcgatggacagtgtggattgcctccctatggcggttggagggtattactgacctttccaaccgtcgtaacggtcattacctacctatttaaggagctcactctctccatttcaacacacacttcaagtaaaactctctcatattctctcaagcttagtttagtattctcaagctagtggagcaggaatagaatagtaatcggagtctggaagtcttcggaagagttcgggtatagctctagtagctcgcctttcttcttttgtaagatttgtactttatttagaatattcttctttatacaattctggtattgaaatactttccaagtatatgaatgccaactttactttattttcaagttatactgattatactactagcttatctgggagatacataggtagaggtatagtgtttgcttatgcaattactatatgtcatgacaatgatattagagtagtatctgatagtttagacgtggtgtctagattactgggtatcattatttagggttatatgctgcggatgagaggtgggctgctgatggtgacagctcagtatgggtattcctccgcgcgtgtatatagtcctaagtaaatgtcctagggagggtactcctccatttttagccccggttgtatggtcatgacgggctttcataagaaactcggcagttaggggtggcttctcgaagtaccaggaggtcatcggatagagagtattagctagtatgtcagataactaggatgtatgtatactatgtactccccccgtcctataaaaaacaaatctaggaccagatgtgacatattctagtacgatgaatctggacatatatgtccagattcatagtactaggatgtgtcacatccgatactaggttggttttttatgggacgtagagagtatactagaagtataggaatatattcttttctattttctttccacttggctgtaacatcgtgaaaattcccgacaataaaaaaatcactaaaattttgaactttttaaaacttgttgcatcatgctggatgttatggttgctattgcttgccaaactataaattgtcacaatgaaacattaacttaaggatgtacaattcgctagaatattctatctatcgattccataaatattatgcaggaagctaaatgaaggaaaagttaattattaatttgtatggtatgaattacaaaccaaatattaaatattcaaaccatgttgatagcttggtttcatatttaacaaatggaaacagtaagattaaatggaattcatctgaatccaatctcacgtgaaataatgaccacttcattacaatgatcccatctataaaagagtgtttcgctggaatatttaaattaatatttaaaacactttatcaagcccatatggtgtagaattcactcatataaataaatagagtaaatacatcactaccattataatggtcacattagaatattttaattaatatcaaagcctagaagttatattggataatttttggataatctaatggaaagcaaattcgtttgagaactaatgaataaataaataaatattcaaatgaaatatttgaattaccaaaatccaaaatgtgtagagctacatttcaattccaaatccaatcttagccattttgcagtttagcccttccctttttccctctttctccttttctcttattttccaccggtactgttcattgcgcaccatgtgctcgactcggactccacccggtcgaacacccgacgccgccttcttcggtcgcggatgtgccgcacgcccacttggcgtgaccgtgcgccgcaccgcgtcacgccgcgccgcttgggcccgccgcccgaccgagccgccggattcccgcataaggctgcgctgccatgagcgcctgcgtcaccctatcccgtcgcgagtcgccatcgcatcgccatatcatcgcccctagctgagaccgttggataatgcggcgtttcttccccagctaggactaaaactagcagactataggctataggcgcaatgatggagccacagaactttaatggagaaggagatgaaccttagccatgtcatccacctcattgctcttatccgatcgccattagagctccagctcatccaggccatgtgctggcgatcttatccccatggtttccttacaccctaagctaagcccccaataaaatccccattcttctcagctttcttcccgaatgcatttcatcgaacaccttgcgatcactctctcaccaccactagagatcaccattgcgaggcttcccggccagagctggaggttggagggagtggaggaagagttgtgctcctgccgtcgccattgaaggacccgaggaccgctggacaccgggaaccacgcgtcgaacactttcgggcgtcaccaacagctagccgcctccacttcgtccgcaccgcagcacgcgtcgccgcccttcgccgtctctccatcccggggtaaaacctcgagcccatagcatcctctacacctctaatagctagcgccggctccagtttgtacgattaatgccgatggctgtgccgccccgaccgccgttccgccgccgacgagctcaccgtggataggccatcccgggtgctctccctcccatctttctggagaaatcgaacgcccatacaccgtagatgctcctacgcccatcaatttggcaggagaccgtaccaatcacccaagcaccaaacctcctcgagctcggtcatggcagccgtgtcgtgccacttgcctaggcgccgccgcacgccgcattcggtaccagagggtcgcctgagctccaccgcaccttccctagccaccgtcgggtcgccctcggccggctctgccgtgcgtgccgtgttcccctgctgctcccgcttggtcgggaggaagaagaagacgaaggttgaagacgacctttagccgtgccactgacgagccgtccccactcctcctatttcctttagaaaattaatcctgtgaaaaagaaaatcaaagctttgaccccacatgtcagcagctgttagggataaggatagatttcggattaaaataaatcaattaggaacagtaacttttcgctatttcttggattaattcaaatttgggtctttaaactagcataacctattcattttaactccgatttgagtgaaacttgaatctaaattcatctaaattcataagctttccaatggtatataattcactatttaataacatatattcatatttataaaataattaatgttcaatgattagattatgatcaacttaaaaatgtgctaataaataaagttggtattgtacagtaagataggtagaagaataattgtctttaacatgctttgtcactgtaacaactacattaattaattataaatattgtttcaaattaattgaagcatagaaagtaacattgctattcattagtcgctgaccatatatgtagttaagtccatgccttactaattaattaaattaagtttagtcttataattaggtaaataaaatatgagtatacatagatcattcctaagcttgattgggggggaggagataatagcagagctagtgtgattaaatcacctatacgaaattaattacttaatgtcaagtcccatggagtgagtagtatcttttaaattggtaatcaatcttaagttaataaacagtaccaactcgccaaatccacctacatcacatatactgtatatatatagattacagtaaataactcatgttcggtaaatggtccaatattaatatattattgaactgccataatgacaatagaagattaagaaaccttatccattagcaagaccaggtagtatgagaaaccctaggttcgacctcaacaattatattttgtttgtgcacattggattgttgtttgaacattggtttttctcgcgtattatagaaattgtatatcggttagtcgtgaggcaacgtatgcagcttccaggaggtgaagattgatcaagattataccaagaataagaactatcctgagcaggcaagtcatcaccccatcccctgagcatgttggtcccaattgtgaaattgttttgtttataaataaaattgcatgcaatgatgaatatcctacttgttattttgccatgcctttgattattgtttacctcattatttccttgtacccatgattacgtatgagtccttagtcaattatgacaaaagcttagtaatgctactttagaatcatgcattctcatatttatcaaatgctatatgcttaggcaactaccttagggaaagtagttgagatacggcttgtggagacatgagcgccacattgccatgacattggtgacatgatttgtgaaaggaaaaatgaaactaaacaactgttttcgactggggcggctggaggacttgggtggtgtccagaaaaggctagtaccgtccctggtcagttaagaaccgagccatgaagttaagcatgaaacggtccccgtacaaccatacttgtcgtgtgggtatagacctagcggagtaaatagctgagcggaggcggtacccaagccgtagtggttttcttgatgtgtgtgaggcaggccctacggtggggcagccattggtaggaccgcgaggggcgggtgcctacagttgtgtcgccatcggtaggactgccatgtgtaaacctaaacttaactataacttaatgcatgtgtgagtctgcttgtggcatgtcaaccgggcccttgtattattttgtcttccgctgttgttctctgatagttgttggcctacctggccctaatgtaagcatttaactcttttagcctgaattcattcgtgatatgttgtgattcggctatgtatgtgtgtaccaactactgatccagggattggtactgataaacacagaagatttccgatttccaaaattgggggtcgacattggcttagatagtttaatatgagaatgagtagacttatgcttgtgtgtcactctaccctatgaattatattaaccctgcttagactatgattattacaagtaatatataatttatcagtacggttctctctactgtaatcttcccatgggattaaacaaatacaatacccttggaatactctcgggtgaaaagctacactggtatatccgtgcgcttgcggataaactctataaccataatataccaggagtattttctacgacattgctgggaattatatttctagtaatgtcattaagaaataccatcactagcaacaaaatccggtcttgctgaaatttgtgatgaataagacacatgttatgctttggtttgcaaagatactctattttctgttgatgacgtctagctctttgccttctcctgtcactaatctttttgcaggagtttcgagatgtattcccatctgagttactgcaggtctaccacccatttgagggatttggagtatgaaaaagtggtttgataacgccatagaggctggtgatctgcctcaagcaaagagtggttcattcatgttgaggatcacccaaaacattaaagttgtttttaggagaaagtagtgaacggatggaagagggtggaaatcgcaaggagaaggtacatatatggatccttcaaatacattgatgtttacgaagacatcaattttctatgaatatccatcatactgggagcatttagaagtttgacatagcattgatgacgtgcacattatgaaaaatgtgtgtgaaagcattgttgacatcttattggacctctcatccaatacaaagaattcacggtagacctggcaaggaaagagttacaccctacgaaattgataaatgcaatgtattgtctataaccgactagcttctctatgataactgaggagaagaaattagtgtgcatgtgcttacacgggtttaaagtgcctatactaggtacacatctaacatcagaaacctagttccgataaaagatttagagataatagcaacgaagcctcatgattgccatgtgttgatgacacatctctcagtagcaatcatgggagtgaagccagaatcttcaaggtggcactaacatggttctgtcattttggcaacataatttcacaaaaggtgatggatgcttaaaaaactccaaggtttgcagggtaatttgcaactaccagaattttcaatctcgaactaactctttgcgcatttttttgtgagtgttgtgctttgcatctctctctctctctctatgaagatcaaatgtcttttgagcacctggaaatacaaatgctagcattgacttgaacacgtcttgtattgtggcttttcccaagagtgaaaatttgaaatcaaattgaattaaatcgcctagtgtcctttagccctttgctttcatttttaggggtcaccaagcatcaatcaaatcgccatgggactaataactctactttagctcaatacacacataggtcccctaattgccttgtgatctgtcatccaaaatccgctaggggccgagatgcactttcagtttgttcagggcttatgtatacttgttaaaaaggtctttcatatggtttatggtcgacatcaaaattccagatgaactgctcgaaatcatacaatcaacaaagcaaagctttgaacctcttccatccaagtcgtaggctttgtaactgagtcttggttgacacatgatatggatgacctcccacccatgtaacgcataaatagctagacatttgtcgccacctctaaggtttttgttttgcttaaattattcctactctatgtagtatcgctgctagattgttttctgcaactctaggctatgtgtgcttcatattcctttgcaatttaaactgtgtttttcttatgaacttctcgattgtttgcaggctcaataccttgtgagagcatcgttgataactacgagacaaacagatgtagggattgcgaggtgatatctactgatttaaagcctcaaattgtgaatgtacacatgtcgataaatcaaacctattgaaagatctggtaactattcgtatcaacaagtatttaaaaattacaatgtaagtttttaaatttaattgtaagtatataaaattcaccaatgtaattattaaaatctatctattattatatactaaaagtccattaaacttcctaaaaacacactcaagccaccacgtggcaccctataaatactgttatgccgccacgttattttcatttaattggcggacccgttattttagactattagattagatctatttgcttcctcttgatataacatgtcctgtgcatatggatgctgtttataccggaaaaaccaaaccatcagtacgtacttggacaacactaaaaaaggaaaataaaggaaaaaaaggaaaaaagaaaaaaaagaaacagaacgtacttacgtacaataaaaaaaactataaaacagaaaaaagaaactgttcacttgaaaaaaataacaaaaaatataaaaatatatatcataataataagaaaattataaatatatgacctaaaaaataagaaaagctacaagacctaaaaaatatatgtacataggtagaaaacaatagagtctttttaaaatatgtttttctttactataataatatatttattccacaaatatggtcatgtggcgttcctacaagcactcttaccgccatatgtcactttataatttcgttgtcaattttcatttaaaatgatggacccatttttagatcaatagattagtccgcttactgttaatttcctatgtataagagataaattgtttaccggatgtctgattgaaacaaaacaataaaagaaatatgcgtacaataataaagctataaagccaaaaaaatacatataaaagagtacataactacgataaaaaaccatcaaacaaaaaaattagatattgttcacttgaaaaaaaaatatgtacgtcgatagaaagaaaaatataatatacggtcctttcaaaataggaatttctatactataaaaataaaatttattactcaacaaatatgatcatatggtgtttcaacaagaactcttatattgcaacttggcactctaaaattttgctgtcaatttttatttaaaataatggacctattattttagatcattagattagcctgtttcttaatctcctgtgtatatgagagaaactatttactgaatatttgattgaaaaaaaataaacatacatacatacatacatacatacatacaacaataaagctataaagcccccaaaaaatacatatataagttggtagaaccttcgaaaacatatagacgttcttcagaataggattttctacactattaaataaaatttattactccagagataaatatgcaaaataaactacattaatataaaaccaaattaaatgtgtttaaacgcccattttaaatttattttaaattatacggtcaacttataatcaggtctattcaaatgttgatgacttatcatagttatattatagtgctaaatacattacaacacatggagctgacatataatctcaagctaccacgtggcactctataaacactcctataccgtcacgtggcactatctaatcttaccgtcgttcttcatttaattggaggacccgttattttataccattagtttaaatttatatctatagttgattttcatttaaattagtagatccattactttagaatcatttggtgtatatataattacttccccgtataaaaggtgtctaatttgaaaaaaaaagtacagtcagcaaaacaaaaaatcataagtacagtacgtatgatccgggaaaaaaaacaataaagcttatgttccgttggccggaagaaagaaaatgcctgtgtgacaaagtaaaaaacaaacgtacatagtataatcggggaaaaatgtaaatataattttctaccatataagataaagcgaaaaaccatatgtatgtagtactatctatctatgggtgtgtatgggtgtgtttaattctttaggtgtaaatttctttgaagtatacggacacacatgtattaaacatagataaataacaaattacagattccgcctgtaaactacgcgatgaatttattaagcataattaatccgtcattagcaaacgtttacggtagcattacattatcaaatcatggcataaaaactgtgcaattggtttttttcaccatttaatgtcctatgcatgtgtccaaatatttgatgtgacgttttggccaaaactttttgggatttaaacaaggcctatctatctgtctattatatattaaaagtctattaaacatcctacaaacatttccaaaccatcatatggcaccttataaatactctcaagtcgtcaagtggtaccttaatgaaatagagaaatctaacactcgattttcatttaaatcggtggaatcaatattctagatcgttagatttatcttagaaaaccaaaacctcccacgtccccgtaccatgtaccgcgcacaaagtgatcaatttgtaggctccctgttcctttatgttttttcatccctatcacaattaaaattaaaattatatttatggaaaataatctcaaaagtaggtgttaaagtccattaaatattttataaatatttctaaatctttgtatgacattattaaattagagaaaacccatccattggtttccacttaaatagattcgcacaatattttgcattgttattgtatctatttttttaatagaacaacatcccaaaccatcttcccttcctctccatccctatgggtgttttgctaagctgctacttgtctcacttaaattagaataaatcctaataaacctgagggaaaaaatagcatccaaccatcaacacattatttaggtcatcagatcaatcaatttttttcttaaaaaaataaacatcccaacctttcctccatccccgttctcatgcggtgtgcggtgttacttttctctgtttttaatatctctatgataattaaaattaaaattatttttatgggcaaagaaatgatcacaaaggaatctccacctattaggtctagccagttaatattttttttaagtgaaaacgatagctttatgtccatattgactatattttaagtgctaacaaaaaattacattatggactcacatccatattgaagcctctactcaataaagttaaaatttgttaccggacatccaaaaaaagtatgattagctaagagacactacaagaacgtatatctgctctgggacaccgcaaaaaactagtaattagctgctggatacccatggcattattctgttatgtccaaaggaaaaggggatataaacaattgcgcaagtatgatttttgccccttcctgccatgtgtagcttgtatatagctatgatgtcgaggtagtcacgacatgggcggtgaagggtatggcagcgtggcatggcacagctatgagaccgacagcaatagcctacgctctgcggtgccctgcttgacatgaatctggaggtggtccacgttgtgcttaccccaagcgctgtgtgtcgcggagcatcggcgccggcatggccctcgtgctgtagcggcgacgagtgcgggaacgacatggagccataggcctagctgcactggccctccttgaacccacctccccccctctagagagccacctcaccgacggcgggtgcggttgcaacatcgaaggtgtatgcgagccggaattggtaggtaggggaaaagtcatgcttttgttttttctttctccatttcttttggatatgataaaataatgtcatgggcctccggtagccaattaccagttttttcggtgtcccatgacagatacgcgttcttgcggtgtcccccagctaattacacgttttttaatgtcccgtagcaaattttaccctaataaaaggaaatactaaaattgctcactctacaaatcaaaatatcccagcttattttttaaaaaaactggtagacccattacttatatcccgttagacatctaacgactttccatcaactttttctcagcttgtatatgggagttatttacccatacattttgatgttgatgctttaatcaataaatgatcatttaaggagataaataaataatctttagatgaccatagcatctaaattatatatatgatctatgaagtcacgtggcaagttgaagaacatactagttgtactgagcatgttggttgcaccaagacaaccatggtatggcctcagcaatatataagccaattacagataggaattaaaagaccatatccatttcttttggtaaaacttgctgcagtacatcgtgaatttgtgacatatagcatagaacaatctagaaacatgacgctccagtttagtggtaatttgctaagaaaatactacgacatctattttaatttttcttacataattggagcgagataatttagaattgatgcctttaccacatgccagcttctaggaccaacccacttatattttcaacccgaattacagaatcaaagcatttcaaacatgcttcataaagtggatttatccaaaaaaatgaagataaaaggaatgaaaattgaataaaatttatctaatttaatttttttgttgggtttataacccattctaagtagaaatattcaaacattttagtaggactaataaaatgaatatatttaaaatttcaaacagaatctaacaaaaaaaaaggacatttataggaaacacatctattgtttcaacacaacattttctcatgaaatagaaacaacacggtttaaagtaattttagttcacaatttatatgttgtaagtaaccagtgctcaaaggacgttaaataagttcagttttagtttatgataaagtgaaagaatatttttgataggaaaccatcctcacatgacattcgtaataaaattttacgtacatgcccgcgcatatgcgcgggctaccttcctagttacattctaattaaaattttagtacaaagatttaacaactttttaataaaaaatacagagccataaatataaattctcccttaatataatttggacatacgcacacgaatctggatacactaattaatattgtcagacatagtacatccgtatgtatttaacgtacaagcaaattattgcaaacgctaacacacacgtccgcaagcttatgacgttattaattaattaactagggcaagaagccctatatatatccctatatttctcttggagaattcaatacattatctaatttgttcttacatactatacagctcgacgacaaattattacaatacttaattataactgcaattaagcaacagtacatattcatttgttgttaggtctcgatcggttgatccttgacccaactattatacgtaagcgtagataccgatgtttgccagccattccactattggagtttgtctgtatatatgcagaggtcgtcgtcgacgactcacttcttctttcctttcttattatcaccttgcttattaccatctttcagtgtttcactgcatatgtccaattaagcacaaattcagaggttaaccactgcacgacatataagacggctacaacacactatataaggataaattaattttatgcatgcactcgatcaattgtgttcatataagtactaaaacatcgcaaatgcaaactcatttgtacgtagtaccctgtagcttcgaggcgaggctgagtgctgagtgacgcgctcttgtctgcatgaggagaaaaacaacaaagaaaaaatgagcaagtcaagcaagctacctaggccatcatgcatcacgtaattagttgttttctgacatacgatatattgactcatttcatgcatattcaattgaaagaatatatatatatatatatatgcttttaatcgtgctctccctccgtccatggttataagggcttcttggctattgtgaaattattttgatgttgagtggagttactgttgactgcaaatatcaggactgacgttgtaactacgactactgagcgaagtaagtgtagtggttagatagacggtttgggaattactccctccatccgtttactttttaaaatatatttgaacatttgtcttattaaaaaaatttaagtaattattaattattttcgtatcatttgattcattgttaaatatattaccactactcgattttttgaataatattcataaaagtttttgaataagacgaacggtcaaatatgttttaaaaaaatcaacggtgtcaaatatttagggacggggcagtagtacgctaaagtctgtacgttaattaatttgtagacaaaagcagaagcataattcaattttggacggagggagaactcaatcatatataccgttgattgaaaactaaataaaaacgaatgcttcgcaccaattggcatgaattaatacgatagtataaactagtatatgaattaggtagttactagctagagtttgaaattaatcgccgtcaacaccgtttcttacctggcgtaatacatcttgtgtcatgttgattggaaagcaggcctgattgtgccacaagtcttggatgatccattcttaaggatctcaacgacaaacctccatctgcacatactgaagcatattaacagcgctagctaggaagatttcttatatgttaatggatgagatttactttagggccgacagagttcacattttcggaaaccaccgaaatttcgtgaatttcagaattttttttgtcctttttgcacgaaatatttaaaattttaaccttttttactaaaatttgaatatattaaaccaaatttatagaaaattccaaatattttgggggagatattgcttatcggggatatgaaatttctgctttaggggcttgcatagacatcaattatttccttttaatgatatttttccaaattaacctgcaaccttttaattgcacgtatctaaataacccttataattaattggatcagtgaagaaatcagcaggggctcgtacctgcgatgatgtggtccccggcaaccgggacaatcgtccagcagcagaacaactgatcttgatcactccccatgatcaccatgggcttatctgtcagctcgattatggagccgtctctgccgccggtgttaacggctttgaagacgagattggcgttgctcgccctctggatgtagcatctcctgctgatcagtcgccggtcatcgtcggcgtcggccgtggccggcgtcccatccgttgtccagcgttctccttctgcaccgtgcttcccgagcactacctgcagtggcccttcttcgcggcgagctggccgcttgcctgcagatttactgctgcctgtctccggcgtcgaccgccgccgttctccagtctgcggctgatgcgtccggctgctgctgctgccggcgccggggacgatctgctcaggcttagtcgtcccctgcttgtctcctcctgctgcttctgctgcaggtttactggcgactacgagggcgcagttccgtttcttgtttcttaggatgaacggcttctgctgctgctgctgctgaccatgcggtggcggcggtggcggcggcggcggacgtctgctgcttgtgttgctgctgcggctcgtcggccgtcaccatgtaccacagctgcatccacaaggcaatatatatatatatatatatatatatatatatatatatgtaacaaacatgtattacaattaactagaagttattaaaaagtttatactgctgctgctgatgaatgatatgatgatgatgcgtgtgtgttaattatatatatcgagcatggctggagttagtgttttaaaatttaaatagtcggctaagacatttaacacacggtcttacctaaaatttaaaacattgcctcgagatagcggtagctatagctagagatttaaaaccttacctggagatcatcgaagacgcgggagccttctgtattctccttaacgatgacttcgtcgctgctgtcgacggcggcaacgtagtatttcctgtcattgggatcgaccgtgaagatcgtgtagatctcaccggccggctgctggggcaaatttcccatgccttcgttttgggtttcagccatagttgacctatagcttcctgtagtttgtagctagagatcgatcgatcgagcagttagcacttagcaagcctatctagcgagatcgattatgcaattccagttctacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36213 - DNA, 611 bp, Oryza sativa
tttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttaacctcgtacgttgtctcgggcaatttgtttccccccggaagaatgttcttaaagagtttcaataaatcgccaaatgccttgtcactaaccccattttttgccttccattgcaacaactccagagtggtatccaactttttgtgcccctgctcgcaacctgggtacaacgaagttctgtggcctccaacatcttgtccaatttatgggcctccttttcactttcgcagtcctccctagcgtcctgcaacatctgaccaagatcatccgcaacgtcgttaccatcagcagctatttcctcctcgcccgttcgatttccttcaaatccaacatactgagcaaagtccggaatattggcggcttccacttcatcttcttccatttcaacaccttgctctccgtgggatgtccaacaattatagcttggcatgaacccc

SEQ ID NO: 36214 - DNA, 750 bp, Oryza sativa
actccttctgattcttacacttatggcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaatagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaaccggggctaaagatcaccgggatcatta

SEQ ID NO: 36215 - DNA, 4735 bp, Oryza sativa
atatttgatggtcgtttgtatcgttgactaacccgtttcaactttaaattttttcttttccttgtctatccagctaagaaaggatgctgttccattttataagtacgtcattatcttaaaactttttacgttattatatatatatagtttgcgcatgcaagtttaacgagcaatatacatgtgctgacgaaacttttataatctttttcattgacataatgccaggtgtatgtgacttgtgaggatgcaagagcagtaacctttgatggacgtacgatctctctgcatccaagctttgtgtgcaaaatggctggcggtcgaaaaaaacaaaaaacaaaaccaaaaccgaaaaaaaccaaaaaaaccagaaaaaaacagaaatagcaaaaaaaaaaacaaaaacaaaaaagcgttcaactttgagcccacaatatattcggattagttttctagaaggactccatgtctttttctattaggtgccacctatatatactcttgtaagctatacgggaagggactcttgtaagctatacgggaaggggtgacgttctcattgttattcccctacgtttgtaatcaactcttctatagtgatcattgccggtcggcgcccgtggttttttctcgcaagggtttttcacgtaaaattttatgtctttgtgggccatctatttttataacatgtggtatgcataacactcaggtcggcaaaatgggctattgtatgtatatttgtcgtcctttgtactgaaagaaagttattactagtaaagatgaagaggcgtgttgtggaattcccgtttcctccatgacgctgataaatttgaatgtttctaaaaaatatatatattgtttatttaccgaactattcctcaacaaggtaggcccttagctggcagtagctggtgacacccaaataatttggtcccgtctaaaaaagtccagcctctaccttccgtgagcctcgccgcaataaaaaaaacaaagtgggacctaccataatattattactccctccgttttaggttataagacgttttgacttttattaaagtcaaactactctaagttagacaaaaacgaaactctgtagaaaaaaagtagtaatatttacaacataagtatagttttcattaaatttataattgaataaatttttataatatatttgtcttgggttaaaaatattactacttttttctataaaattagtcaaacttagagtagtttaaatttaaccaaaatcaaaacgttttataacctgaaatagagggagtagttgatttcaatcttaccggtgataagttaggccatatggtagtttaaaattgtcctcaacgtattccctgctccgtcaaaaaaaaattaaacgtaatctggggtatgcagatttatctttaaaaaaattaaactttagttgaaagtactccgcccaaagtcttcttatcatcttacctagaaacactcattgtcatatatgtaaatactattctttcgatactattctcatccaaaattaataaactgaaaattattttcaaataaaatttaaaactttatattaaaaatgaaagccatattcaaaatatgaaaaaaattactcaaatttttaaatttcaaaaaaattgaaaacttttaacttaggatttgaaaactttcaacatatgattcgaaaactttcaactcaaacataaaaaattttcaactcgaaatttaaaattttaaagtcaaaatttgaaaactttcaacttttcatctcaaatttgaaaacgctcagttgaaatttaaaactatcaactcaaaatttgaaaacttttaacactaggtttgaaactttctttatactggaaaactttcaagtcgagatttaaaacttttaattccaaaagatttgaaaacacataagctgacaactaaaaaataagctgacaactaaaaaaatccgaaaagaaaacacgggaaaaagagggaaaacgaacaggtggcaccaaaatagaagataaaaaaaaaaaagaaaacgcatgcagtggcgccagctcgcgcgcgcgataggaacccccgtgtccatctggtgagcgcaatcaaaatgtactgggaacctagcttcaaggacgaattcaatgcgaaccaataagcgggccgaaatcgaatgaacgaacgaacaaggtgctgctcaacaaaggagtggctgacggccgagctcaatatgccggtgagctccaaattaaatcaatccacgacaagtacggagtacatggaaagtgtcaaaaaaatttaaacaacagtaaaaaaacaactcatgtttgaaattctagggacgacatacagaagttttcaaagtcagttttaattaatcagtcaacttatgtcattaagcgggcagagttatataagttcacacggatttggaaattattatacattattttgtcccaaaccatagggaataatgtctcctgttttagatcaagtgggggttagcaatcaactactgtttcggatctagcagagattagcgaactacctgacaaagaatctcattttaaaattacgtaacgatcgaactattgcaagactgacccttcattaattaactacaaccaaattaatttctattttgcgaatagaaagtaatactatgtgatattgtacgtatgtacaaatgcaattattgtgtttgaacatgccaacacaactcaagattgatggatacatggactgatcgacaacttcgagtcaatatatatttgcgtgcgtccgtatgtgtgattattcaatgtgcaattcctaaacctaaaatttaaattcatatttgtaattaaatttttagtcacctaaaattgcactttcttaaatctttaatttcagtcatacgtacttatgtattttttttgcacgtaattgtaacttctaagaatagtaagagtgtgtatatatatatatatatatatgggggcaccatggtacccgggcatcatggtatcaaatacacaaattcacccaaatttttcaaaattttcaaattgtgagtatatacctagttataagaattcgattcatacctatacttatcaacaaaacaactcaaatttaactttatttcacaatccatgattacgtacgtaactaattatacatttagatgctatatacctagaaacaaaatctaacaaaaacaagttcaaattcagttcaaacttgcttcgaactagttagtaaagtagttaatgttaatacctaaacatttaaaaaagtttcatactcatttgagttgagtatgtactcaatttcaaccatgttgcccgggcatcataaagcaccaaacttattatatatatacatatatatatatatatatatatatatatatatatatatatatatatgcgcgcttgcacactatacatatctacacaattgatagcttataatgatgaacagctgatatgtattaagggatatctaataatcagcaagcgggttcatcgatgaattaatgcatctaattaatgggcaatgttcatcgttataacgattctaattaatcgtctaattaatcactataattatcattgatactccctccggttctattttaattgacgttttggacaataacacggtctacaagatacatctttgatcttacttttctattatagtatatataataaataaatgcatgtttaattttattatagtattttaaaagataaatctatatatgttgttctagttcctttaaactaaatatttttaaagttagtgatggtcaaaattataaaagtttgactccaaccttattcaaaatgtcaattaatatgtaaccagagggtcaataattaatatgtaaccagagggagtagcttataatgatgaacagttgtagactagctagtaatttaggctcaaaagctgtgcctggattatcgtagccccaaaatcactgacccaatgtagtactcatctaattaactgtttttttataatgaccgaatgtttgactgttaagattacacagtattatttcgaaccattaatataattagtgaatttatatatatttgaatgatagacctatatattgacgatgcaagagcccattaattgagagaaactcccatgataatgcagatataatatgtttccacaaaacaatgacccaagctagctagctaatagctatatgccaaatgtgtcatatatataaccaaattaaaccagattagatatggttggcagaactgacaaacatatactcacctgttataaattgatgtgttttcatgattacaacacagttgactcatggttccacacgctaacttgacaccaaatggatttccatgggagattaggacgggtcaacaagacttcattctttttctttcctgtacaggaatatatcaagtaaacttaattagcatgaagatcgtctctgctctaattttttttaaaagcaatatgattttaatggaaaatcacaaaactataggtcagttagacgaaatcgcaagtttagcaccctgtcgaacaaccgcggttcgacagggatatctatcgaacaaccacagttcgacaggtacatgtcgaactgcgtcagttcgacagggtaggtggtccaaaaataaataaaaaattacatgaacagtatcactacaatgctagacagggacatatcgaacagccaaagttcgataaggttgcgtgaacagcgcgctacagtgatgct

SEQ ID NO: 36216 - DNA, 6478 bp, Oryza sativa
ttcgtctaactgacctatagttttgcgattttccattaaaatcatattacttttaaaaaaaattctctctgctcttgttcccctttatattttactagttttatacggaagtcagcacgagtaaccataaaaaatgccaatcaatcacgcgtatatatatgtataaaagaatttcaatgtgattacgaataaaaccgaacgattaccatacgcaaataaaaggaaattcttttatacaaatatgtataaaaaatcaaagtgtttaaaagtttaatacctgtctagttcaaaactagaattattttcaacctcacgaagagtattttacaaatttcacaagtatttttatatttaattttttcgattacgtggtagacacttatacgtatataattctacactacgcgcacacacaccatatgcattgctgggtccacaattattgctttctcttatgcatggaaccaaattaagagctcaaggtggttgatactcctacagcatggcgtatacctaatgcaacaggaaatttccgtatatgtacacatgtagctacataaaatatactccctccgtcccaaaataaatgcagttttgcactattcacatttaacgtttgaccgtttgtcttatttaaaatttttttaatatttctattgctattagatgataaaacatgaatagtactttatgtgtgactaaatatttttaaattttcacaaattttttaaataagacggacggtcaaacgttgggctcggatatccacggctgtacttattttgggacggaggcagtactactcaccaaggcaagcacaatatatatatagataggacaaaatagagctactaattaattaaggagatctaggcagtagggacaagaagctacttaatgcaaataacatggtacgagagcatggattcgatgagcgcctaagctagctattggagaaacttctacgcatggatgcattcatgcatattacacatgaagttggtacgtggtacgtagctttcaaattgttgtggaacgaatccatccgtccgagttgaattaggtttcgggagaaaattaagaaagacgatcgatcgatcgatagatggagcgtgtggttagtacgtactacgtattttttgggtcgtctttggaacgtacgtacgtcggggaacgcgttcctcgatctctatatatatggaatggaccatcttgctcctacgatcgtcgactcatcacacacacggtcacaccacacagtggctggttcgtcatccatcgagtttctagcagctccatatatcgattacagatcagtcccatgtacgtataactgatatctgtacatactgtatgcgtatattcatgcacagtttatcatcagtagctcgatctgtgatttgcatgtaccgcagtgtactttctgcgagaccaagttttaatttatactccctccgttccgaaatgtttgacgccgttgacttttttaaacaatgtttgaccgtttgtcttatttaaaaaatttaagtaattattaattcttttcctatcatttgattcattgttaaatatatttttatgtaggcatataattttacatatttcacaaaagtttttaaataagacgaacggtcaaacatgtgctaaaaagtcaacgatatcaaatattttgaaacggagggagtacatacatgtgcatgtagtagtgtcgacgatgcccgcatacatgcatttggatcgatctcacttcccaacttaattttgttattattcagggcacctgcttttggagatgggccgcaaggcaaacaaagcaatctcgtgccggacgatcctattaataataaccactactataaaaatcgtttttctgtacaagggggtcggtaggttccatgcgggacgcttgtggcggcgcctgcaaaaaccgcccccccgggggcgggttgattagccgcatgcgatgatcggccatatatgctccttcaggcccgagcttgaccatttgaaaacgaagctttctctctcctaaagcaaacaccaattaggggggggaggttttcaactcgaaatttttacttgaactctatacgaaaggtgaagaactctctatcctgcttcatttggctccatttttgttatatttcgttggtggaaagtggagtttttttaatattttgacaaggtttgttctaactattttttgcaaaatctagcttcaaaatatatgttttgatgggtaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggcgcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatggttgtcgatgtttccaccgatagtgatgatttcgatggtggttttgatttagaggatatgctacgccatgttgaaccagatgtgctagcggcaggtcacgaggattggagaattggcaggcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatgaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccatagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaggacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacaatgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttcttcaaatacttagattactggaagaacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtagtgctgccaaatgggaagaccgagattcctcctgcttgttactcattgacacttgaagagaaaaaagccttttgtaaatgtttacaaggggttagagtgcctactggtttcgcatcgaacatcaggaagctagtatcaatgaaggatttgtccatttcgggatacaatgcgcatgactgtcataggttgctaacggtgttcctaccaattgctataagggcagtcaaaccagtccatacaaaggtggttataacaaagttgtgctactttttcaatcgaatttcgcagaaggtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtatggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttagtgattctgtggaggaacttactttacaaagactggcatgtgggccttcaagtattgtcaattcatggcaaggttacgacatcaatggatttaccttgagtacgactacgaaggacatgaaaagcaccgcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcataacctttagttctcattgtattccaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttagaaaaaaaaatatgagtttttttggtaaaaagatctttctatgcggacgacttaagccagccggatggaaagatctttttcccatgcggccggctttatggcccgcacggaaatatctttttcgcatgcggctggcttaacagcccgcatggaaagatctttttcgcatgcggccggcttaacagcccacacggaaagatctttttcgcatgcggctggcttaacagcccgcatggaaagatctttttcgcatgcggccggcttaacagcccgcatggaaagatctttttcgcatgcggccggcttatgtcaaccgcatggaaagatattttttccatgcggtcccttaagccgcccgcatgcgatgatctgcgcctatatatagggagcgcggggagccaaaattttctaagtcccggctcccgcgaaaccctagccgccaggttgccaaaatttcccaagtcgccgtcgccgtcgtccccgccaccgccggctcctccccaaagtcgccccgccccacgccgtcgccgccgccgacgtcaggacctctc

SEQ ID NO: 36217 - DNA, 5557 bp, Oryza sativa
ccgccggctcctccccgaagtcaccccgcccctcgccgtcgccgacgccactgccaggacctctcccccctcgccgtcgccttcgcccgtgccaggtcgccgtcgccgccgcacggacctctcccccctcgccgttgccatcgccgccgccatgtcgtccccgccgtcgctcggtaacatttacttttaaaaaaagaaatgtgaaatgtgcaactgtggattgtggattgtttaattgtgcatcgtggattgtgatatgtgcaattgtggattgtttaattttgagaaggtttaattgtggattgttaaatggagatttatgtttaaattgggacttatgttaaattgggatttatgtataattgggacttttgttaaattgagatttatgtataattgggacttttgttaaattggcacctatgttaaattgtgacttatgtttaaattgagacttatgttatattgggatttatgtataattgtgatttttgttaaactgagatttatgtataattgggacttttgttaaattggcacctatgtcaaatggagatttttgtttaattgtgactgatgctaaattgggacctatgttaaattgggacttatgtgaaattaagttattgggacttatgtgaaaataagttaaattgtgacctatgttaaattgagatttatgtataattgggacttatgttaaattgagatttatgtataattgggacttatgttaaattgggacttatgtcaaattgagacttatgtgaaattgcgttaaattgggacttacgtaaaattgggacttatgtcaaatttttttacgtcaagttggaagatgtcgaacgaaaaggttccatccaacgcaccaatagcgcctcaagaaggtaacgctcctcaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacacccctacgtctgcacctgaacgtacggagacatctacaagtgcaggcgggagtgggaaaaaaagacgtggtgagagaagcaagaataaattacccaaggaaacttacaacgtgattgctctcgatcagtatgggaagcccgtcgagccaccgatagtgcggtccaagttcagcaacgcctgtggcactctagtcaggacacgttgtcccattaatgtcaagttgtgggaaacagtggacgacaacatcaagacacttctctggaatgagttgcagaagtattttgtgttccctcctggatcagagatcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcagatcatacaacagctgaagcattggctttgaggaaaaaaatgtccgagctcgcgaagaagaacagatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgacaactaattagcagcagatagtcgagaaagaaagatcaggacagttcgtcccacggagggagcgagatcagcttactgcggcgttggggacggctgaacactctggacgtgtaaggggtttgtcctcaaagacaagttagaaggtcgggtttccacaagatgcaccaagttataagaagagagacaaatacaaagaacaactatcggacaagatctatgcgcaagtgaaggaacacttctactcgttggcagctgaaaacccgacagcctttccaaggttattccctgatagccagcaacccacacaatccgcatagcaaacaactaatgtacccagcagtataggctcagtgcagacaactaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcctgcagcaggatcttcaaccccatcctcatcgcaggcaatgactgctgccgctcctgccccaccgtcgcctcctgaaccaccgtcacctcgacatccgccgtcaccaccaccgcttaggtcaccgcctcgccaacctacaccaccaccctccccttctcaacaaccgcctctcccggccccgcaaccagttcaagcctctcccacctccccagctaaacagcatgctcccccggctccgccctcagttcaaacctctccacctacaccccaatctgctctggtagaacaagtgcacataccagatggtattacatccgaaccgaagtctaatactttggaactgagtcgtataattccaaagttgatatcgacatacgacccaaaggagattgacaaggataaggagaagttcatgttttcagctttcaggaattctgagaagagaaaagaacttgctcacgtcttgtcagactcccagaagttagtactagcggcccaagatgaagtgcaatcctggttatctgctgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatggaatattttttatctctttccaagacctttacgccctctacaagctagataaaatggacgttaatctcgttgcggctttctgtctgtaagtctgaactctttattacatgttgtacgtttcattcgaaacaaataaaccaaatctcatttcttctttattcattgtatagtatgcaattccacgaagctgatagaactggagcaaaggttggatacgtcgatccaacaagaatatgcaaaacacaacacaccgtagagctgagagaggactgcgagcaattggttggcaagaccccggaagaaaaggaagaatatgtaaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttcttcaaacagagcacacaagtactaccgcaaaagaggtggaccagtacatattccatcccagaagaagttatccgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccattttattttcctttctgtgtgcagatccccgaaatcccatatattgcacaacgattcaacgacactactatcttgaacgtggccgctgacctctgccgattcatccgtcgcgatgtctgcaacgcaagaggtctcttctatgacaaccagagtgaactcgcaatggacgacaaatttaaacctctcagagagtgggagaaagaacatatacaataacatgtacactacttatacatatgcaataacatgatgaaaaaactgtgccacttgctattatatatttgtatgtaaattacgattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatacggtctacttaagacgcccgcatgcgaaaatagatcttcgcatgcggtcttcttaggtcgaccgcatgggaaaatatatcttcgcatgcggcttcttatatggaccgcatgcgaagatctattttcgcatgcggccgtcttaagtgaccgcatgcgaagatcgatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgaacctgcagccaaacgcaggtaactaattaagcgactgcattttactagttctttcttttgtgttggttcgatctaagcgaatgcatttcttcaagagtcgagggatcgatggatggacatagtatatctagtttccatgtcaatggatgatttttaaacttttgtggaagtttagagacgtaacttcaactttttataaattatttgcaaatctatatatttattgcggtggcgtattcctcgtgatctcttgcatgtgtactgacatataattaatcaatagatcgagaaacaaatgggtcaattgaacacattatttctgattgattagggcaaattaatggatgcttccgcggtttatttagtttgatgagcttaaacattgaattcttgcttcccttcttgatgttgctctttattcacttcgaacaggcactgctgtagaattcgcacatcaaaataatgtcacaaccaccggggtgca

SEQ ID NO: 36218 - DNA, 7643 bp, Oryza sativa
aaaggctccatgtttgccgacagtgtgacgaagcgatgtgggcagaatacaggacaatgtaagggagacacaaataactactaaatttatttacctactctctcatttcatattataaatcgttttgactttatttttctactcaaaccttttcaaacttgataaatttataaaatgtttagcaacatctgcaacaccaaattagtttcattaaatgtaatattgaatatactttgataatatgtttgttttgtgctgaaaatattactacaatcttttttgagcttggttaagcttagaaaaatttaactagaaaaaaaaataaaaaaaaatcttataatacaaaacgaagagagtagctatctatatcattctagcttctctcagttcctcagccaaattcgttctgtggggaagagctcatcatgactcgaagattgatgaccatggcagctggaccatgtaatcaaccatatttatttaactagcaaatttaattataatttcagttttgttccccagccaattttcccgccaaaaaaaaagaatccccaggcaatttatttaatttgttgttctttagtggaccatggatcaacgtgggctgatgctgatgtctagtcctccagttaagagagacgccaacgaccacatttatttagctagcttgttaattatacgggaacatatcctatgcatgtaaattttccatgcgcaccaactagtaattataaaaaaaattatagaaaaaaattgaacatttacttctaatagtattacatatatatgcaaagctcatgttaaaattcattatattttcgccataacaaaaatatgaaaaatctaacagttttaagagtaaaaatctatcaaaatattgtctttttttaggctaaaatataatgaatttaaagataagatttcgcacataggtgtaatactattagaagtatgtgtctaattttttctaaaattttctgtgatatttgctagttagtatgtatgaaatgtacgtgagaagtttgtgtgtatgtatatgatatgttccctaattatgctactacaaatgataaatattaggatactaaaaagtaacttagcacctgttatcgatagagaaaaaaatgttaagaaaacgtggacatgatcaagtgggactcaaacctaggctggtccaagcgccggtatagcgctcttaactaccactgggcatgagaccggtctcttgtactacttcatccattccaaaatataagagattttaaaagatgtatcatgttctagtagtacgaatttgtatcaaattttactactacgaatctgaattgttactccctccgtcctaaaatataacaacttttaaccctcatgatttgtcccaaaatataactacttctccatcaacattcttttcccaaccaatcacaaccctctactattcacttttcccacctacctccattactcttccaatgcaacccttcactactcacttctacctactttcttaataaccgtgtccaactctaaaactccttatattctaggatggaaggagtatatcacatctcactaaaatctcttatattttgaaacatgatagtactattttagtacacatttgtggcagattaggtcacatatcgtatggatccgtccattcatatagtttgagtttaaacattgaattatcatttcccccgctgaatttgttcttattcatgtggaactgctgcagccaacaaaccggttccaccagtacttaataaaagctcaaccggggagaataatatccagatcactgtggaaagtactagtggggaaaagaagacaacaggtagagacgcaaacaactattataattttactttctaaattccctatcctagttgatttttttaatgttttttgtacgatcattattacctgaaaaacagagcatataatcctatataatttttgccttcacataacgccaggtccgaatgggaaaggaggaaacatgtaacctttaatcgacgagctctgcgtatccaaacttgagtggacagaaatatagtccagctggactatatacatctgatgttctgcacaaaaaatcaagatcgtagagctccaattcccagtttggccagtcatacatggccatctatgtatctttattatatattataccttgtggcttttcttccttgcttgatgtgattaaggtgtgttttgattattgatgaacaattcgcataagagatagttggttttgatatttggtggattattgtcgaagttgtgctgactgtgtgggacccagtcaaactggcatgcggtgcatgattagaccggccggcccgatggtctgaacggctggctctgtaatagagtcggtttcgagttttttaattggatactcgtgattatttcatgattactatacttatgcaatactgttgtgttgtgtgttaatgttgagtcaacaattgttgaaaaacatgtgctcgcatatggttttttgtttattcatctgtaggtgtgttttgatacctcgggagagcattgctggtgatagattgggaggcaacttgagagaagatggcatccagatgattaggaataaatcatgtagtatacttaggctaaacaacaaaataaatatggtggtgaagatttcatgcgtcatacaagagggtcgtgtacatgtagaatgcagagttgaatttgggaggagtccaaacttgggaaggttcaagtttaaattgaaaagaaataagttagatacttgtacaggaatgttttctagtggattaagactacttgtacaagtagtattcatggctttgggccaatcacctctaggtataaatggaagagggttgaccctctcggtatcgattgtgtaagagacaagataagagaaaagttagggtttagcctatattttgtgtttaatcgaatgttgagagagtagtattttttttacactttgtaaacataaattagaagcaataaagttgatttgctttcagagagttctttgattatgtttttcttgatcttggcaattagaccaatgagaaaccggcggcatctaggcggttgcatcagcatcttcaagaggttgcggtggcaaggagggtaataggaccagccaatccacaccggttagatcggcagctagggtgcagtcagcccagtgtgcacacagcagtcagatcggactccgttgtggacttcgttgtgatgacccgtgccgtcattaccaaaatgacttcactagtccatggattattatttgccatagccgcgctttagcgaataattaatgatccacatcaaagatagcagtagaataatagctgtaaggtttagataacattacaataccatgccacgcagggctaaattctgaaacagggcattacaagttcacccatttaataatacaagttctaataagcagtagctatcagtactttagtcattacatgcttcattatcccaggttctctgacatagctaggatcggagtagctactagaagtaccactcccctgcataactcatcccatcctccataatacacatcacatccccttgattttcagcacaccaaggggcatagcaccgatcctccaatctataagtatcatttaactcaatggcttgcccaaaattgcttgcgtctaaacaaggaaggttaatagcaagggtgagtacaattacttagcaagcagtattaatagcaaggatgtatggcatgccatttcataagtcatatcaaatcatcatttcgcaattataatttctttaaaaaatattattgtaagaagagtccatatttaatttataagaaaagctactactcacttgcactagtacagatccttccatctgtgacggcccataacaagactagaatttgcgggccgtcacaaggaagtaaaactaaagtactgtgacgtgcccatccgaagttttgcccgattgagatatggtcgcacagccatggtatatcggcataaaactaaagcccgtcacggatgacacttatctgtgacaggctatagttgaggcccgattgacatgagggttccatatctcaatcgggccctaaaagaagcccgtcacaaatgagggtcatctgtgacgggctccaactagaggcccgattgagataagtttaatgcccgtcacagatgacactcttttttgacgggcttttattaaggcccgatagagattacttgtatgcccatcacggttgattgttttagggccgttacagatatttgttgcacagtataaataccccccaccacctagtgtaactgtatcccactgttcactattttggtgggaggctgtagggggcgattttttgtcctttttccaaggaaaacagaaattaaattcccaaaaattgatcaaaatggatcaatcaagtgagtaatattattcattaattgagcaatttcatcatgtcttacttttgcaatactgatcttacaatatgtgcctctaatttgttttttttttattttgcagcaattgatcgaagttggatgtatgagaaaattttgaaacgtcattctatggagtacagaaagggcgtaataaattttatgaacgctgtggaggaggatcggaaaagaagaaacagtgattatatgtgttgtccatgtgcagattgcaagaatgagaatatgtttgatagcggagaggacgtacacggtcatctgatacaacgaggattcatggtctatacatgttgggtgaagcatgcagagcaagaatcaggaattggagcagcagcagacagaagtggtgcgcataatcaggaagatgaagatgagcatgacatgtttataccttctccattgggtggtgaaatggttgatgtgaatcacgatctgctgcaagacatgttacgcgacgttgaggacccagcccagaatgagagatatggaatgaagttcagcaggttggtaagtgattccgagacgcctctgtacgctggatgcaaagcaaaacacactaagttgtcagttaccttggacctaatgaaactgaaggcaagtagtggatggacagacaagagtttcacagatcttttaggaattttgaaggctatgcttcctgttgagaacacattgcccgagacgacatacgaagcaaagcaggttctgtgtccactggggttagaggtccgtagaattcacgtttgtcccaacgactgcatattgtaccacaaccaatatgcggacttggatgcttgtcctgtctacaaggcttctcgatacaagcgaaagaaaagtgctgacgaaggaaataagtcaaagaggggtggtccggcaaaggttgtgtggtatctacctatcattgatcgtttcaagagaatctttgccaacccgaacgaagcgaagttagtacgttggcatgccacggagagaaggaatgacggtatgcttagacacccagcagattcgattgaatgaaggaatatcgatcgaaaacacaaagactttgctgtagaccctagaaacatgaggatatgtctgtgtacggatggcatgaaccctttcggtgacatgagtagtactcacagtacttggccagttcttattgcgaattataacctcccgccatggttatgctttaaacggaaatatattatgttgtgcttgttaatctatggtccaaggcaacccggcaatgatatcgatgtattcctagagcctgttatcaacgatctagagattctttggaaagaaggtgtggaaacttgggatgcatatggtcaggagaacttcaagctaagagttctattgttctgcaccattaatgactaccctgcactcggtaatctttccggataaaatataaaaggaaagaaggcatgctccgattgcaaggaacatacacgaagccggtggctgaagaaattggggataggaccctcttggaccgtagacgcatggcatggatacgatataaatggatacacattttacaccgtcaaacaagatgacaaaagcacagtgcaaaacagcggcgttcgtatagatgcattccaggatcaagttgggtcaaacacatattacgcccgcattgaggatatctgggagctaaactacatcaagttcaaggttcttttgttccgctgccattgggtgaatatatgcactggtgtcaaagccgacaaggaaggtttcactttagttgatctatctaaggtgggatacgccgatgaactatttgtacttgtgaaacaggtcgagcagatattctacataaaagacccttcaaacaagaagatgcacatcgtgagggatggaaagcgccgaattgtaggagttgaaaacgtcgtcgatgaagaagaatacaaccataatcttcatgtaagacctcacattgatcttgacgatgatccataaccttgtaactgatgcatctatacttatctattgtaatgaatgaagtattttatttcactgcaaagacttgatatgtgtagtcattaatatggctaattttgttttattacaaatgaccaaaataaaagttgtagatcctgatgagaggatcaaatttgttgttgaccatatttcaatttgaaatcacttagtatttacaaatgctgttaattagatttgtcatattgtcaaaatcaatttcaagttgttgggaaaaaaattttatagaaaaatgaccaaaataaaactagtagatcttgaaaggctctacaacttttttgttgaccatatttccatctgaaatcttttactatccgaaaatgtattctgactaataaaatgaattattacacagctactatatattttgcactcacaacaaataaaagatggaaaatgagtcatcgatgacgggccttagtttacggccgatagagattaatctatctcaatcgagctttgctgtagggcccgtcacagatgacgcccgattgagatgacattcaggcccgtcacggatgagtcatctgtgacgggccctatgataatgcccgatagagatagattaatctctatcgggcttgaactaaggcccgtcactgatgactatttttccatttttccagataagtctttatatttgtgagtacaaaatatatagctgctatataataattcattttatccgtcataatacatttttggatagtaaatgatttcaaatcgaaatacggtcaacaacaaaattatagaggttatcaagatctacaacttttattttggtcatttgtctatataactttgtttccaacagcttgaaattgattttgacaatatgacaaatctaaacagcatttgtaaatactaaattatttcaaatgggaatatggtcaaaaacaaagttgatcctctcatcaggatctacaacttttattttggtcatttgtctatataactttgtttccaacagcttgaaattgattttgacaatatgaaaaatctaaacagcaattgtaaatactgcatgatttcaaatgggaatatggtcaacaacaaagttgatcctctcatcaagatctacaacttttattttggtcacttcttcatccgacaaagtgatagttatattattcacaataatcacatttctctcatctggtttatagggctgcagga

SEQ ID NO: 36219 - DNA, 16423 bp, Oryza sativa
  unsure (1)..(16423): unsure at all n locations
cccatcaccgatgagtcatcgtgacgggccctacggcaaagcccgattgagatgactcatcactctactatatctagggtttctcagatcggatcgaaaatttttctaagtcccactacagtttcccgcctccttagaaccctagcgccgccgccaactcctccttcgccgccgttgtcctccctcgccgccaccgccaccgagcccgccgcctccaccgagcccgccgccgccgccaccgagcctctacaccgaccagcgtcggccttcctcgtcgtcgccgcctgcctcttcaccgacgcgaacagctgcccccaccgaggccggcgacgtccttcctcatcgtcgtcgcctactcctcaccgacgcacgacgccgcccgcccgacgccgacttgcccgaccggcgtctacaccgaccgccgccgccgccgtgaactcctccttcgccgagcccgccgccgccgccaccaagcccgccgcctccaccgacccacgaatccctccaccgagccctcccggccgatctcatgtgagtcctccatcgcgcctccctctgctacctgcatgtggttgatgatgaaaatgtggatgttgggatgaaatgtggatgttgggatgaatttagtgatagatgattttagtaattgatgacttgatgatgaatagatggaatgtggtgcattaatgaatttagtgatagatgattttagggattgatgatatgtggtgaacgaatgattttagtgattgatgacatgatgatgaatagatggaatgtggtaaattaatgaatttagtgatagatgattttagtgatagatgattttagggattgatgatatgtggtgaacgaatgatttttttgattgatgacatgatgatgaatagatggaatgtggtgcattaatcaatttagtgatagatgcatgatatgcggatgaatagatggtatgaggtgaatttatgattttaggatttgatgatatgtttaatttagttatatgtgccatttaattttttgttattttgaaaaaaaagtagacgatgtctcggcaaggcgaaccaatgtcgacgacaactagtgggtcctcaagagcacgtactcctaggacagggaacaaaatctctaaggaacggttccgcataacatcggtggacgccgtagggttgccaacatctccaaggaaaatagtgagccgatttaggtctatctgcagggtcatagggagacagaaattcagtattctgcaagatgacatcaacttcgtgccggccgcagagaaggacattgcttggctaacgttcaagaagagctgtcacgaccggaaataacccaacgggcgttccttacgtgtgtgtattattccttgtcccaggaggcaaggtacaccaaaagttgatacatttcagagtttatcaagcgaaagcgtaaatagttactttattacatgggcggcgaaggcccagcacacacaaagacaaacgggaaacagcggaagactagggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagaataaatgcaagggagtacaagggagccataatatagggggggttagggtttgcagtaaacagcactaaatgacacttagttgctcaaagctattttgtaaacacggtcctagagctatacaagattattaatcaaggccgtgaacccacacgaacctgccttaacccaaggcctacgatgattcagaccgaactggcaacccgaccctgggtcccagctcgtcccaagccaacccaggccagccattccacattttagttgttaagcaggttttaagaattaaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggatggaagacatgacatagtttccaacccatcctagccataaacaagagtaccgacccaaccccacctacggccgaaacccccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccaaagaccggtccttatatggccgaggtgctactgtcaaaactatgcaccccgagcccagcctaaaaccattttgagggttttgaatagagggggaggtgtgaatccaattccacaataatcccaccattccatagtgtccaggtgatatgaatattcccaaagtctagagttgtaaaaccacctaatgttgcctaattaaccagcgaagcatctacctaaaatcatactagtggtaccatgagtagagtgtccactagttggtgttttgtttattctagggtgaacaaggtaataataacaataacaataataaggtcataacaaaggtacataggcatggctagataaaacagtgataacgcgggaatttaaataaagcgataatgcaataatttaaatcaaaataattttataaactaggattcaatatgttcaaggatgatgtgacttgcctcgctcactttcccaaacgtcggcttcaacctccacaaagagcggatcttccgaagctgcaacgtctacacgaccaacggaaaagaaaaggcttttactctaataaactccatataaccagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggagggggcgcgcggaccgggtccacgggagtggggcccacgcggcagcctcacggtccacggtggaccgggcgcacccgggctcgcaccggccggcgccgtgggccccacgcgtcagccgcacccgagggccctggcggctgacggccgggccccacgtggcggccactcggcgtggccggcgggaggcggcgcccgcgcccctatggtcgccggcggcggccataggcacggcggagcggcggccgagagaggggaagggaagggggaaaagaggcggcggtccgcggctcaccttaggtcgacggcgacgacgaaaaaggcggccggagcggaggaaggcggcggcgcggctcgggtcgtctgggtcgacggcgttccggcggtccgcgggctcgacgaggggttggacggggtcgacggcagtgcggcgaagccggaggaggcgacgccggggcgggagacggtcccggcgagcggagaaggccggccggaggtcgtcggcgacggaggagagagagggcaatggcgcgagctcgattccggcgaggagacggtgcggcaagggcggaaacgggcgagggaggcgcggggagggtttatatagggttggaagggggagagggcggccggaggggaaggaaaccggcgcggcgctctcgggctccatcaatggcgccggcgggattagagggggggtttccaaacgaatccaagggagaaagggagggaaaatagggggaatgggagagggaatcacggggaataattcccccctattgattgcacgcggggaggacgggatgcggcggattcggcagcggcggcggcgcttggcgcgggcggagcagcgggagcggcgggaggaaggggatgacgggtgggccccacccgtcagcgagggtggcgggcgggcccgcccgtcagcggcgcgcgcgcggggagaggctagatgggccgcgggggagaggagaaaggggcagggagatgggccggattcggcccaagagagggaagggggatttttaaggtttttctttttataaaaccttttcaactttgtttatttcttaataattattatttgtgctctgaaaattccactaaaatttatttacgcattttaggcttttaggaaatttacaaaaatcctctaagccttatttggcttttaactttgcacattttaaatgttggaagctttcacacggattttaattattctaggcataatttaaaggatatattttagggtcgttttgggacgtgacaagagctttgattatcctgtggagcatgataaccgtctcaggcgggctgctttcaaggttatgggcaatgcttggaagaacttcaagactaagctaatcggcgagttcgtctacaaccaggcgaatccagatccaagagagaaatttccttggatcacggcacaagtctgggaggaattccatgcgaagaagtcgacccccgagtatagagctagaagcgaggcatatcgcttgctctagatcaagaaccagcatccgcaccggcttggcaccgccggatatgccggtaaggaagaggaatggcagcgtgaggatgaagaagcggaggaatcgtgcacaccgctcgtgtttggcgatatcccacaccctcgggctaggaactaggccagggccaggtaccagaggaatgatgatggcacaatcttcatgccaaatgcagaagatcaacgagtatacgaagctatagtaagtgtctactcaaactagatgttcgcattgtttcccatcgtgcagtttatttaaccccactaaattgtaatgcagaaggagttggttgccgagcaacaagcctcacaagaggcctgctctcaaagacgcgaggacgacctcctcacgaaagcgttgggcaacaaggaacactatggacagacacggggcgttgggtcttctgttccctagaagtatggatttccagactacgcttggcagtacaagaagcggacttccaaaaaggcgaagaaagatgcacgccttgaagccaagatccgggcgtcgataagagctgagctgacatctgaattcgacgaaaagctcgagtcgatgagggccaagattaggcaagagatccgagaagagaaacagaacccccaggccgccgctgctgctgcgcacgaagagttaggaagtcccacccaaaaacacagcagttgcgcatcaactgagttggcggaaaatccaacatcggtcgacagcgccgtcgaccacataatggtaaccgtgaacttacttaatacatgaaagacttaacaaatccatatgatatataatattctaaaaaaattgattaatctatcacaggaaccaacgagctgcaccctcacagttagggtgatgccgaccttcacggttccagcagccaagggacttgcgtacaagccgaccccagagacaagagtgcatggagcgcaactcaggacggactgtgcaaaagttcaagtcgactcggtgaagcccgaatacgagctgttccctctgaagtatccaccgaacgatgaggtcctctcactaggaaatgcccatggtaccttcatccaatggcccaaggacctcattgagatcagggttacagcgaggccaaccactgcaccaggcggtcatccaccaaagagacccgcctctgctccttcagcccctgctgctcaagattgtcatgcacaatcttacgatgtgcagttgcagtacgacacggattttggggaggaccgaacggaggccgacagcaaggcgattcatgaacccccaccgatgaagaagagcaggaaggcacactcttcccctcagagaattactctcgataaacccgaagcaaaggggagaggaaggggaggaaaggtgcagaccttagttctggctccaaggaagctagatctgggcaagggccaggaagagactaagggcaaagaggtcaagaagaaatacgtcgctccacaggagttccaactaggcatgcaattggttggagatgacgtgcttgccgcaatgggcaccgcttgcaagcaccttcacttatagtacatggagaaatctaacgccaggaagccaagtaacgctaccgatatccttggagagcacgatggaaagccattccttggtccaacaaattatatcgtggtcaacttcaaggatcttttcgacctctacaggctccgagcggtggacacaagcctccttaagtgctactgcttgtaagtattgtcgcccaactcaatctggtaataacaatcggtttaacttgcttataagatcgtttatcttgtgtgtaggttaagttggcagtggtgtcagaagcatgcaccagaagttgccttccttgatccacaagtggtcactgtcacaaatctccagaatgaccgtctaggaatggtcaactacatctacgacaccttgtggtcccgccgagacaaggagtacattatgtgcgcctataatcaatagtaagtgtgttaactaaatatacacaacggcatgacacattccttgagtacttaattaactttcactatattaatgccgcagtgcccattggatccttctggtcataacacctaagtggagtacatgtcactacctgaactccagaattgataagaacgcatatgattggaccccaattcaactagcgatagatgaagcgtgggcccaatacgtgcaaagaggaggcctcaggaagataggacatgacaccctcatccacaaaaaagacttcctggtgaagcaacaaataggtgaccagtgcggattccatatgtgccacaacatgcgccttctgtatagagaaaaggtgaagactttggctgagtttgaggtcggtagtctcaattgtgatagactaactacattttagtacttatatatgatcgatcaactaatctggaattatgacaatgtagggcacaataaccaagtctctgcctaccagctttgaagaggttcgcgaagagatagccagcttcatcctccgcgaaataattaaccccaaaagaatgtttaggcttaaactaaaatgatgaacaatgttgaacttttatgtttaggcaatgatgaacacttattatgcaactgtgatgatgtatatatttcatatgtttatgttaggacttgctaaataaatatttgatccaattaactcggttttgcaggtgaaatatgataaatatttgaatggatgtgaaatatgagatggctgtgaatgtgtgtttgtgtgaaatatgttgatgtctgtgtatgtgaatgcatatgtgtatgaatgggtgatgctggggagctggggatattggatatctgtgtttgtttctgtcatttttgcagcgggcatggctagcaaaggcctgaggctagccaaaaaaacaaatttttttttgtggattatagtcatctgtgacgggccataactaaatgcccgattgagatgaggtcatctgtgatgggctctaggttaggcccgattgaggtcagtagtcatctgtcacgggctctagtttatgcccgattgaggtgagtagtcatctgtgacgggctctattttaggcctgatagaggtcatcagtcatctgtgacgggctatagtttaagcccgattgtgatgagtatcatatgtgatgggctctagtttaggcccgataaaggttagtagtcatctgtgacgggcgctagttgtggcccgatagagataggtcatctttgacggactatagtttgactggtcgtctgggtcaaagctatcggtgacgggcttcacttagggcccgaatgagatatattcattcatgacggccgtttgcccgattgagataactcttcacatcagtgacttctagcctgtgacggacgctgtgcctgattgagatggggcttaccgcccgattgagatgagggtatcccttcttgtgttgtatagtgagaaagaaccacaataggctccgatatcctctaatctaagagacaggcgtgaatcacaatctatttgagcacgcactgcacaagcttgtatcactgtatccattttcactccatatattataagtcgcatatttgtaatatttagagtacaacgcacttctcttatttcagcacattacactccactccactacgtgctactgtactatcttgatggggtttatatcatctcccatccaagtactaacgttttatggggtttatatcatcttccatcttaccactatatctatagttacgcatcatgcggagtgtaacgacttgataagatatgaagcgttgctcgtcttgcgacaaggatatcgttgacacgacttctataaggcacacgtatacaagtgagagtgattttagtccctaattatattatatccgtatgtaaagggtcccgcttccagtcaatccccatccatgggcaccctctacccttctagtaagtgttggaaggtcaattgctccatcaactgcccctcccagtatctatcatcatccttatatatctgacttatattttggtaaatccattttatgcaaggtaacagtactataaagcaaaattaggtttacaataattcaaatcatcatgataaaaggattgctttcctgaattctcgtagttcaaatcaaaactagctagtgctcccaactgacctgactccgcctctagttcctttccgcattcggtcaaatgtgtcgagatttaattaaactatactattagaaatacaataatttacaaatacaaatgtgcttacaaatttatctatctatctatctgtatctatactaattagacactttatacgagcttccacgttaactgaaaagatctaacaattgattaattaggatattaaaataattgtgaccgtagattaaaagatctcatgtgggccattatttaaagccgatcgtccaacccttcccgtatcaatctcctgttatccaagaaaacaaaaggacagtatatatgtatacaatcatatctctaggacgaatcgctctcaattcccaagcatataaacacgaatatcgatccattcgacgtagacacatagtagtcatcgtgccgtctgagatcgacttcgcatgtggctcgggattggggaacgacgacgcaacacttgatgatcctgttagctgatgttggacgcctgcgacgagatcagtcgcgtgagagcggaatcgacacagcgaactcttatctccggcgagggtgctcagtgtccgctctaataaatctatatatacctgctggactgatcaccctgctggcactctctaccacttcgacatgcgccggcggctgcagcgtgtgcatggtacaaacgtcgtggatgaggaggatgatcctctacacgtcgagcagctcgcctactgtgacgacgacggccgaatcaaacgtggctacgtaccgggcatgcatggtaaatttgctttcggctccgcggctaatatattcaagtgcaagtgtaagagcgccgtctcgactcttaagctagctctgagattactttctccatcaagttatttttattcaaactgaaatatcttgctcggttaatttgctattttcttaatcaggatgtgattatcttttttccaattcaagatctatctgggccaccgcaggaagctatatatgatccattgctttttaccctaacaaattcgtatgtccctttgttggtctagctttcaatgcctttagactaatccacgtgtactgtacaatagatccgcatattattgatgattatgctattatattttcaaaatattgtatgaaaggcatacaccatacgttcttacacaaccgcaaatgtctctccactggcaaatcttgactcactactttaggtttgattcataatgacaccaccttcttagcttgttatgcagatattatttctttagcatcttacatatccaagattgaagaagaaacacaaacaagtcatggcataataaaattcgtgaaaaataggctctgaattgggtgagttgagataaaataaattagtatatgaaagtattagctatatttattttaactatcaattcagtttaaatgtttagaaacatattataacgtgaaaagtgaaactaactgaaggaaattcaccgccacgtgttaagcaaggttgtcattatcccgattcgtatcctatagaatctatagaatcttacgatactacgatcctaccaagccgaaacgataccgatctcacatctatacctaattaaaaaaaataagcaaagcttccggtaaaaaaatttccgtccgtcctttcctttttcaccgttttcctctttttttcgtttgcttttcattttcctttttttttccgttttctgttttttcctttctttccgtccactttgtttcccattttttctcgcccttttttcctttttttttctctgcccgcttatttttccgtttctctccgtccctctattttttccatccaaaattttcaccttttcctccttttttcggtttttttcatctgttattttatttttacttttttcagtaggatttgtttttctatctgccatatttttttcgtcgtcgagccaaaccctagcgttgtagtcacgtcaatttgtctccccatgcgttccccctccaattagttgtaaaaatcaattccccactacgctctcatcattttcccatgattttcccattcaattccgctttaattcaccgaatttaatatctaattgaaagtcactttctttatcaagttttgcggattcactccgattttgataaaaacaaaaagaggagatcgagtatatcaaaagtcctcaatcaatcttagaagatcgagatagattcgactgaatttgatggggaggatcagttttagcatcgtatggatatgagactatcttctggagggttggctatgtgagctggaattgcagctaaacttgtgggttaggtcttagagaggaaggtccagcagagggaggtagtgggctgggctaggactataaaggaaagaaggaatgagttttggtcgaaaatcaaagagtaaaatgtatagcgatccaaaaataaatttacccgttgcaacgcacgggtattttttttctagtagtatcctaattttcatagtatctcgatcctactattcattactacacgatcctatgaaatcttagggggtatgccgattctacggtccccacgatactacaaaatattatttaaaataacatggtttgaaaataatgtaaataaatatgctcaaatttttataaaagtcagttaaatatatcaaaaccaacgtggtttctcttgataaatgtctctatttgcatgccatatatcattactacatttttttatatagaatggctatatataattaatataaatattaattaaacataaaaaaataaaatctcatagtatcccgatactacgatacgatccaacgatacgatattacttttagcaaacgatactacctagtatccaggtcctgacaaccttggtgttaaggtagtcccatccacagccattaaaaagatccaaaggtatatatttattattttaaatacattgcattttttcactagcatgctttgcaattgattaaaaagactaataatattacctatgtgtaggttactattattaaacaatgataatcaacaagtgcagcatagtggatattcctgaaacagtagagcaatggaagaggaatgatactaaatgcccaattatggtgagtcaaatttccagtctccactaaatgccattatcttataattacaaagttttgcatttatctgggtggcacaaaattaaaattataacaagtaacatcacatattagaagagccaaattagttttggatgagaatagtatcgaaagaatagtatttgcatataagacaccgagtgtttctaggtaagatgataagaagactttgggtggaaagacaggtcatggattcaaactttcaagccacatgcacgctaacgtggaaaaagaatcttgttagttatttgaaacaaatagtaaaataccaaatatttttttagaatattttttgatgcccaccaaaataaaaaaaagggctgcaccctacaagtgtccgctctaaatttagaaccggcacctataataatgccattgtgccagttttagaactggcaccaatgaggcatctcaacatgacagcctgaatggtgccagttgctcggcacacgacactttctgcagtattcactactagaaaaagagtttttcttgcggcaaaaattgaatttcgctgtcgtcatgcaatgccaaccgccagtaagcaaaggccagtgaaaataatgaattttcactagcgggcagccagccgccaaccaaaatcgagtttcacaggtggcgtgttaagacaaccgctagaagaaaaaccgtctttgctagcggttaagtttagaggatctccagtgaaaacattttttaggtaaaaaaaattgaaaatcagcaccgctagccaccacggccgcatgcaccgcccaacgcctagccctgccacggtggatcccttgccaccgctgagccccatccccagccggtcactgtcgccaccgcggagcctagagaggaaaggctcccctgcgccacctcactaagataagcccgacagtcgccaccagatcaatcgcccgcaggagtcccccctgctggttcgcctcctgcacgagtcgccgccgccgagcctggagagaagagactccccttcgccagagagaagagactccccttcaccaccccgctccagatctagaaaggagagaagctaggctcccctacaccaccccactccgctgagccttgccgcctccctaacgccctactggggcaatcaccaccatggacaccgccttccagatccactctcgcgagggagagcttggccggccggtggtggatccgccgctccttggcccactgacatcggatctggagcccttcatcgcctccctaacaccctgccggagccgtcgccgtcatggcccccaccctcaggatccgaactcgcgagggagagctcgagtggccggcagtggatcggccactctgtagctcgctgacgacggatccgcggaggccaatcatgtttcgttgctgctatcgccgccaccgagcggcatcaccgcctagcccaaccatgcaccgccggttcagccccacgcgtcaccaccgagtcccctcctcgctgccgctgccggtggacctgccaccggtgggaagggaggaggagatgggtgcgatgaccgacagtgggtgagcaaggtgctgctggtgctgctggctagtaagatattaaaaattgaagtttatgacaagtaaaatttcttatgtccaataacaattatttattaaaagtcagtctataaattcacactaagtatgatcctgtatgtcacgtctgataaattcatcccgaattaaaaatcattctctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcaccggaaataattattaagtaacaaaaacaattatcaaagtttattaaaaagaaaaagctaaaaataatccctctccctcctttgggccaagtctggcccaaagcctccctctctctccctcggcccgcggcggaagtcctctcttcctccctctctttctctccctctccttctctccctccttctcttgggctccccttcccctcggcccagcttcctcctccctctctctcccgggctgcctctccctcctctcctcttgggccggccgctcggcccaagccgcgccccctgcccgagccgcccctccctcccgcgtgcacgcgcgtcgcacgcgcgctgagcgcgcgccccgcgtgggacccgcctgccaggcgcttcttcctcctcccgcacagctcctctctctctcccgtgaaccctagtttcttgctctctcgaatccgcgcgattctagcgttggattccaaaattaattggggggaattaatcccctttccttctttttggattcggcccggtttccccttggaaaggcgcccctaatcgtcggaaacggccgcgcttttcccggccaccaaccatggccgccggccgtgtttcccgtcgccgtccgccctctcccgtgcccggctccctcccccatcctataaaatggaaccacctcggtacgttctccagttttagccccctcccgcgctctctcgtggccgccccgcctctccccgccgtcgtcctctctctcccgtgccgccggccgcctccagccgcctctccctcctcgccggagcgtcgtccggtcgcgccgtcgccgccagcagcgtcgcagctgcttcccctccactggcgtcgcctccgtttcacgcggagaccaccggagacgcgtccccgccggcaaccagtggcattggtgccactgtactccctccagccggctgctgtccctcgtcggagcgtcggccgacgtcgtcgtctcgcggcgccgcctccgtcatcgtcatcgcagcggcgtgttccacgtcgtccccgtctccgtgcagccactgccggctgccctcgtcgcctcctcgccggacccggtcgtcgncgtcgtcgtcctctcgtcgtttccggtcgtcgtggcgttcatccctccgtcgagacattctcgtctgccgcccgcgtttcgtcaagtgtgcagcagccccgtcgtcatcttcgtcctcagctccgcgtcgtcaagccttgtgccggccgcgtctcgccttcgtccaaggatcgccgccgaagtcgttccctcgccgttcgcctccatcgtccctgagctgtctccgccgcgcccgttcgtcgttgtcgttcccacgcctcgtcgcgtggtggtaaggatccctctccctcgctgccctgtcctcgtcctttcggtgtcgctcgtgcccgttgtgcggttgtcggccccggtacccgtgtatcggtgtcggcagtcgttcgcttgtgcgcgtggtgaccgtgttagtgtgtccgctcggtagccgcgtggtttccacgtgtgcagctcgcgtggtgtctagtggagtccgtttgtcggctactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatggttgcaaagcctaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgattaattaggcaacattaggtggtttcataactctagactttgggaatattcatatcacttggacactatggaatggttggattattgtggatttggacgcacacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggatgaagtcgggggtcgatggacatctctaagacaaatgaaggctacac

SEQ ID NO: 36220 - DNA, 10046 bp, Oryza sativa
  unsure (1)..(10046): unsure at all n locations
tgtgtcttgtgggtaaagatgtacacctctgatcagagtataatctattcgaatagccgcgccctcggttatgggcaagccgagcaatgtacccaagttagtgtttaattcttaaaatttgcttaacaactaaaatgtggaatggttggcctgggttggcttgggacgagctgggacctagggtcgggttgccagttcggtctgaatcatcgtaggccttgggttaaggcaggttcgtgagggttcacgaccttgattaataatactgtgtagctctaggatcgtctttttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataaggtaaatattatcgatataataaagatgtgtcttttatatcatgtttgtatggtgtaccctggcttttcctgggacggggattgatacactagcgttcgggaaaatgcaattttctcggtcgcgacactgtatataattgccaccatataatcctaactttagaatgatattgggaaagtgtaatcgagactgtaaatcgattactgctcagtatttattaattctaaatttcagaattattatatcaagaaaagttggaattatatacttactaatacctaatttccaaattaaattatacaaaatagtaaattaaaactctaacataagtacggattggctctttttagttttgaatattaaaattattaaattaaccaaacagaaagtaacatgaaggattctataggtatttgtaaataataattttgatattttctgacctgaaatagaaattttgagttttgtaagtacaaatgaaataaaaccatttgtcttttgaactttaaaacaaactttgcatatatacaacttttaagataatttaaaatagttagcctatctaataatttaatttatatggtgcttaagtaagtgcaacgcactagtaaaaaggattgtggcacaactacagaaataaagattggtgctggttaggaacccaacaaatgtgccggatttctgtaccggcacctagaaggtagcactgatgtgaagagaaatgggtgccgattccatgaatccaaaaaaaagctggctcaatgcatgcatttagcatcgagcagccccttctcccacatccgcatatcatcatccatccattccatatccatcttgtttacacccgaatttggcgccagattcgaattgggaaaatattgccaaaatttggaagagtcttggcttcctttacaaagccggtctgaccgccgtatgttggccagtcagaccactgcttgtgggccaatctgaccggcggcgtgtggctatgaacactttcgaaaaactggactgacatatcttgagattgacgaagttatcatgagcgttttgatatcgactggtagttacctaccactgaaataataattagctgtaaatgcgaacacttgtgtcaagtctaggacttgaacctggtggattagttgtaccataaggaaactaactagtggagctacactcaatttgctaccgtttagtttttttttttaccagagtcataaataaaaagtcctatagagctatctccgagtcactaaccaacctgctgaacttcatggaatctttctcgttgtaagatgggtcctcaacgtcacgtaacatgtcttgcagcagatcaaggtccacatcaatcatttcaccatccaatggagatggtataaacatgtcatgctcatcttcatctccttcttcatcattgtctgcaccacttctgtctgctactgcaccacttcccaattcttgctctccatgcttcgcccaacatgtgtatcccttcataaatccccgttgtatcaagtgagagtgtaaatcgtccactctgctttcaaacatattcttattcttgcaatctctacatggacaacacacgggcgaagctagagtgaaatagagaggggtgccacatgcttgctttactctgttttggatcaaatttaagctgatatgaatgtctaactttgcactgagggggtgcatatatggtgaaaaaagataaactatagctaaaaaaatttcttgaccaggttcctgggtacctcctttgaacatgttgctccgcccctgacaacacatgtatttgttgtttcttcttttcctatcctcctccgcggcgttcataaaacttaatatgccatctctatactccttgcaatgaagcttccaagtagtcgcatatatccaacttcgatccatcgctgcaaaaatgaacaaaatattagttaacatcttataagataagtactactaaattaataagaaatgattagtactacaaaataagtactacaaagtactacaaaatttgcccccttctacctcccaccaaaatagtgaacggtagaataacttcagacaacaggagagtggagtatttatagtgtgtaaaatatatctcaatcaggtcaaagaaacgatatctctaacggcggcgcacaattatctctaacggtcataaatgaaagcccgtcaccgatatgaactattggtgatgggcgttaacctcatctcaattcgggccttatttggagcccatcacctatgtcattcatcgctgacgggtttagtagttgggcccgattgagatatatgaggtaatctcaatcgggtctaacggtgtgcccatcacagatgagtgtcaccggtgacgggctatagatatatgcaccttgattatgtctgtacgagtacatctacaatggtgttaatttagaccagattgagatgacttcgttctgacggcccacgttgtccaggcatgtaaggggccatcacagatgagagtatctgtactagtgattacattttttttcagatctatttttgccttacaaaattttagtaacttaaatagtaccaaaaatagatgtttggtttgctataaggttttgcccatacctgttcaaattctatcttaccaatttgctagtgctaaaacttgtcaaagtttttacattacaatattttggtaattttgatatggtaaaaattggctctaaagccctaaataactgtacacttagtatggccatcatcagtatatgagcccaaggcgtagtgatgtccatctggtgacaaaaccgctgattagtggtggtgcgccaggaggggcaaggcacgtgcgtgcggttttttctttctttttgtctttttcccgttttctttttcggtttttttttgttaatttttgtttttccaggtttcttttggttttctaatatatatatacatattttttaatctataagtacacaaagtttgtatatgtacgtatacaactttatgtgtgtacatcgtatataaaatttatacacgacatatataaactttgtatatatatgtacaccatacacggctgtcaatggtcgaggccgggctgccggcgttctggtggaccagccagtttcgacctaatagtgggctggcgagcggcggcaccccagccaaggatgagatggcagcaatggcctgaggatgacggggtggagatgatctagtcgaggagaggacgagccgaggggcggcagcaccagccaccaagcgcatagccgcagatgaccagatatctggacaggacagggagtctgttgctgccgcacagatcaggacgtgagcgtggtagttttcagattttttttttcctttttttttttggttgttgacggcgttttcaggattttttttcttttgcaaaaaaaaaaaagatgtaaatgtaggacgatatataaagcgtctcacccaacgtctttactttcatggtgattttgaaaattgagacgactactgtctagctagtcttaagagaaatgtctttatacattcatcttgttgtagtgagagggaaaagaggaagatgtattttcgcgtgcgatccactaagagacgcctcacggagggcagaaatcgaatggaggtggataaggtggtgctcaacaatggagaggagagctcctaaaacagtccacgacaagtatatggatgtagaaagtgtaaaaaaaaaacaacagtaaaaatataatattttaaattctagagactacatacagaagttttcaaagtcagtattaattaattaatcagtcaacttatatcattaagcgcgcagagttatataagttcacacggatttggaaattattgtgtacattattttatcccaaaccgtagggaataatgtctcctattttggatcaagtgggggttagcaaacaactgtttcggatctagctcggagattagcgaagtacctgacaaaagaatccgattttaaaattacgtaacgaactactgcaagactgactcttcattaattaactacaaacaaattaatgtctatttcgcgaacagaatgtgatattgtacgtgcgtacaaatgcaattattgtgtttgaacatgtcaatatatacaacccaacattgatggatggactgatcgactacttccgagtcaatatatatttgcgttcgttcgaatgtgtgattattcaatgtgcaatttttaaacctaaaatttaacttcaaatttgtaattaaatttttagtgacataaattgcacattcctaaatgttaaatttcaatcatatatatttaagcattttttgcacgtaattgtagcttctatgaatagtaagtttatttctggtaattagttaatttctttatgttaaaattttttttcatccttttatataagaaaaaagaggggaaatgagaaccactggactgtcatctagccacgaaaaaattgactaaaatttcagtacatcacatgaaatgtagaaactccaattatatttaaactacacgagtataaatatgtaatcggagtttctagttacattattatttgccaatacattgaacatatgtaatatagaacatatgtatttactggatattagacatccaaaactgtgtaacggttaattaaccaaaaaatacacgttggcaagtccaaaattaaagttgaacatgcaaatcttttagttcactttaactacaacttttctttatatatgattttagttcatatgttatccatgttttatttttatattttttatgaattttatgtttatttcatgttgaggttagaataatttatttgttgtttatccttttatatatattaaagaatatactttgtttaaaataataagtatagggaagtgacaagatttagtcgatttccattcaagaaaatacaaaattctgagtcgactaaaactaaatatatattaacctatgcttttcccaaatggcccggatccatttctgcatgaaggcggaccagccgtctatagcaagcaagatgtttgtaaaaatcacaattttctcaagcgggaacgatatccgcatgcaaaacggaattttgcaggcaaacaagttacgacgcccgactacgacatgatttttggtgaataaaatataaattcaataaaaaatctagaaattctagcccaatccgagctaaaatcagccgctgcgacggattattgtagccaacattcgtaccaacggatccaccatcgtagaggtcccaatgctgaatttggtgtcacccagctcctttgcacgcacatccgcccatggccaggctccacacgttgaatctgccattggcaagttccccatggcccgattccaccgccgctgagctcacagtgctgactcngtgattgtcaagcttccttgcactagaaacactgttgccatgctcccagcatcggatctgtgtcgccaatgtccctgctactggatctatcgttgtcaagatcctcgccaatcgatccgcccttccctaggccggcgctagcgttgctgccactcactccaatgctgaaggcagatccaccctacgacaattgcgagccttctacagctgatctcgagcccgccgcgcgaggataattgtgagacaaagagagggagggaagaggataagagacaagaggtaatggggggtaaaggagaggataggggaggtgtggaggagataagtctcatgggattggtattcatagtttgttacgaatttgacaaggtggccattttttaattccaaggcattccaaggcagaccttgcttgcaaaaatcagatttttacatatgcacgtctccttactaggcttgcttacaaaaatagccatacttttacatatggccgtcacaggatgaccacttgtgaaaatcaagtttcccaagcggttcttgacccgggatttctatgcatttttacaaacggatcttattttttcccacttataaaaatggagggtgtctataaaaatcattttctggtgcttttaaattgccaagaacctattttgacgctgattatagccaataaaatactaatatcttgacattatttgaactagcaaatacaacaggattacacatatgacaaaatgctaatgtttagacattaattaattacggtctccttgtcacaaaaaaatcgttcacaattaaatatatacacacatgtgtatatttctacgtataaacaaacacatcttcgtgcacattatacacagatatgtacactctagctgatttgtatgaagggatatatctaataatcagcaagcgggtttatcgatgaattaatgcatccgatggtcaatattcatcgttataacgattctaattaattaaccgtctaattcatcactaacaacgaccataattatcattgatagcttataatgatgaacagttgtagactaactaggaatttaggctcaaaagctgtgactggattactacgtagccgcaaaatcactgacccaatgtatctaattaactgtttttttataatgacctaacgtttaactgttaagattacacagtattatttcgaaccattaattagtgatcaagtttgcaataaatatgtatatatttgagtgatagatctattcaagatgcaagagcccattaattgagaggaactcccatgagaatgcagatataatgtgtttccataaaacaatgacccaagctatagctatatgccaaatgtgtcatatacataaccaaattaaaccatattagatatggttggcagaactgacaaacatatacctgttatacattgattacaacacagttgactcaaggttccacacgcaagtaactcgacaccaatgtatttccatgggagattaggaggggtcaacaagacttcattcttcttctttcgtacagtaatatatacatcaagtaaacttatatagcatgaaaaccgtccaggatgtctctgctcttgttcccctttatatgttatatatatggagtagttaattagaacgagtaaccaataaaaaatgtcaatcatcacgcgtatatgtgtgtgtgtatgaaagaatttcgttgagattatattacgaataaaactgaacgattacgtgcacaaataaaaaaaaatattttatataaatatgtataaaagaatattctgtcatatgaaaagataaggcaaatattttagaagctttttttactcaaaatttttaaagtttaacatcagtcttatttaaaacgatagttattattttcaacccacatagagtactgctttacaaatttcacaagtatatttattgtatttatatttttgcgttacgtggaaaacgcataataagtatataattcttcagtactcacacaccatatgcattgctgggtccacaattatttctctctcttggatgacaaccaaattaagagctcatgcaaggtggttgatacgacgtactgcagcatggcgtacatacctaatgcaacaaagaagtttccgtatatacacacacgtaataatggttgtctcgctatagaccggacaaacatcaaattaattagtactccataccaacgaattaattaaggagatctaggcagtagtgacaagaaactaattaactaacgcaaataagatggtacgagcatgcgcacctattggagaagcttctacgcatgcatgcatgaagttggtacgtatagtacgtagctagctctttcaaattgttgtggaacgaatccatccttccgagttgaattaggtttcgacctgcgcgcgtcgagagaaattaaaatttaagagaatatcaaataagatatagttcaaattgttgtgtatcgatcgatcggtatatcaaataagagattatagttcgttagctagtacgtacgtcgcggatcggaccgcgttgctcgatcactatatatatctgtcgatcattttgctcctacgtcgtactcaaaccaaggcaaaatctagctctccatccatctctctttctgcttgcattgcgtcctctctctctctctctctcgctgcttgcgatttcattcctttcctgcttcaggcagctgcaattaatatcgtcgacaccaggatataaagctccatgtacgtatatccaacaaacatctcagtaaagctgcacgcatgcgcgttcggatcttacattttctgtacgttttttatcttcagggcaaatgctgatggcatttcctttggagcgggtaggggcagtcaaagcacgaggcagcacaatgctagtaattctcattcctaactatatatattatgttgcttagtttctgaattctccgggcaatttattttgtttttcagtccgaagtgctacaggtgggcagtttactatgccttcaggtatgacacggtccgatcaaagccagatggcccggttgcccaattctcaacgtcatgggcacaacgagatgacagaacgtaagaaacatatcaataaacatactccatcggtatgtaaatatttaacgctgttgatttttttaagcatgtttaaccgttcgtcttattcaaaatcttttgtgaaatatgtaatatatatatatatatacacaaaagtatatttaacaatgaataaatgatagaaaaacaattcgtaattacttaatttttttaataagatgaatagtcaaatattttttaaaaagtcaacggcgtgaaatatttagagagagatatagtatttattaacctatctatttcattttagttactcaatattcctaccttgcataaccggtttattttattaattcttcagtggaaaatgtagctcgagcctcggcgagtactgtacatggtactggccccgaatcacacagccgtcaaaacaaccaggaggtgccgccggcgtcatcaggcagggactacgacaccggtttaactattttatacacttgatgactatgttttgtgtgcaagctagtcatatcgtttgtatatatcattgactaactcgtttctctttttttcccttgtctatccagatttcaacgatcgaccatttaataagaaatctaaaaagaagagtacgtctcattgcattttttaagccaagtacgtcattatcttcaaacacagtatgttatcacatagatagttgatgcatgcaagtttacggatcgatctacacacatgtgtgctgacgaaacatttaattttctttctcattgacattacgcaggtgatttgtgactagtgagaggatgcaacaagtaaacctttaatcgacgacctctctgcatatatacaagctttgtgagcataatggccggaagttaattatttggctgtcagcaaacccccccccctcccccccaaaaaaaacacatacacatacacacaaaacatacacacaaaacgtagaggacatatccggtgaaaa

SEQ ID NO: 36221 - DNA, 7910 bp, Oryza sativa
  unsure (1)..(7910): unsure at all n locations
tcaccggatatttccctgcttactttctacttgtgttgtccggccattttatattatctgttctgtcagggttaagtgtagtagatacaacagatgggtaaaatgagctactttctccgttccacgatataagattttctaacattacccacattcatatatattgatttattaatatctatatgaatatgggcaatgttagaaatattgatttattaacatctatatgaatatgggtaatgttaaaatgtggacaatgctaaaatgaaataggtgccggttctaaacatggagccgagcatcccctcgtctactctactcattgagaacaagcacatccgcatcacattcatcaagaacaagaatgaacaagaacattcatcacagcaagcacatccacatccaacattcatccacaacacaagatttggactcaaatttatgcaataaaaaaaagaagggattcacacctcgtcgtgccacctcccgtcggcgagcccgccgcctccctccggccagcccggcgctgcgtctcctctgtgaacccgccgtggcaccgcctgccgccacctagtcccggcgagcccgccgcctcccctcccgccagatctggcggaagggaggcgtcgcccgccgctgccgcctcccgccgccgcaactgcagcctccctcctaccgccgcaactgtagcctctcctcccacccttgccgagcacctaccgggccgatgccgtcgccgccgcccttcctcccgccggatctggcggagggaggcgcctccgggccgccgccgctccttccgccgcgcaccgccgaagccgccgacgccgcccctccagccgccgtgagcgagaattataggggagagagagcggagagaacgggagtgctggctcctcgacactatctcctcgatcttatctcgatgctagtggtggggcccgccgtctcagctcatcccggctcggctcaattagctggtgccgcatctataacaagtcataggtgccggtttttaatattaaaggtgtcggtttttaatattaaaggtgccggtttttttaaaaaaaccaacccaaatgtaataggtaccggtttttatttagaaccgacacctataattactaaaaggtgtccgtttttacgatttcagcccgcactattggaacctatagtggcgacacatatttgatattttgtagtagtgcttctataatccaaaaataagtccaccatctgcctggcacactatggggtataggtatggcatacaggtcagcccccgtttgatttttggttcctataggtatgtccgttacgcgtggtgacagtttggccacatgccaatcgtcaccaatttgagaaaataacttttcataaaaatataattgtggcctctcacatgcaatcacatgtcatccccttatatcttcttcttcctcactctccctcctcttctctctcatgccaccgcctcatcatgcaacctgctcgcctgtgcttgttgtggaagaaaaggaacctccacgagtgcgcctggccaccgtcgagctcttcacgcgaccatcctccacgagctagccagctccactcatcactcgtgtcctttatgaactcgatggcagcagcccactcgctagcacaagccaatatatcaagctcctaacctgatgaggaacacgcatgcccacgtgcattgagcaggctagaaagaaacaaacggtccagagcacatatttgttgaatagtatagggagataggatactatgaatattggagatgttgtatctgttgtttttataagcacataatgatttaatttattccataaataaatcataacattgcagatgtaaactagcatcaacacatcattagatttacatatgtaaactaatcagtaaaatatgaacaaatcaaatatgcgcaacatgttgaacacgtaccgagggttccggatgaccgctgccatgccatgcgaggcaaggcgagcacgtgtgtgttccccctcttctctccacctcacatgcttaaagtggtaaggagggcatcctcccttttaaggaggtcccctgtctagaatgagtaaggaggttctaaactcaccatgcatgccatcccatgaggtgggcttttgtgattttctaaagaattaatcttcgagtgggctaaggcccatctattaattccaacagtattgagcctccgaagccagtatatatagaagtacatatggagtagataaggaaggattacaaatatggaagaaatctactacagatgaatcatatcctaatatgactctaccatacactctaacaatattcacatcaaacagttcgaatggctagaaaataggctcaaagcggcgaccatgcatgtcttcttagactaccgctgccatggaaggagggtagcgggatctagctacaacgaggacgtaaggagatcaagcggagagagatgggatacaaatggttgtgtgcagtgctaaagagggaaggatgccgacggagacgacgagctctgcgcttagctcaccggtggccctctcctccacgtggctatccgatcgggtcctacccccaacagggacggtagcgaggcagccaagcgagtaggcccattatttatttataattttagagctgattgtatatcacatggaacggaaatcactttggagtgaatcaggggtataatttgtccagttaaaaaagtttgggggtatgaaatatcttgtattagactttaggggtataaatcgaactacgcaaaggttagggaggtaatttggatttttttttccccaccacaattccatgagccctgctgcaaaagaaaaaaaataaagtgggacctgccataatatttgttgatttcgttcttgcttgccagtgataagtgatcccccaactccaccatctccagagatgccattgtcgtcctagtcgaccaccgtagtctttagcacccaaagaagggatccatcgcgttatgccacccatgcaatagttgatgccccccgtatgcccagtagcctgctagtggattgggtgggaatgggtttattggattggatttcctcttggattgtgtttggatggtttgtaatgggctgaggaaatgtgggttggtgtggtttggatttggtcgccgtttttctggactagaaatggtttcaatccatgggtttctattggatggcagaatgggcacaacccaaaatggttgccgtgcatcgtcaatccccaattcctcttctcctcgacagccaagtcaacacgacaaatcgctcgatgcaccgccgctgtgcttgccaatgctttcctcgctgccgtggctcgccggcgagacgcgcaatctggggcaagcacatgtggtggcgaggtgagggcgatggagcgtgcgcggggggcgtggaaggaggtggagctcctggacgagcggcgtgactagcggtcactgctgcaccgacggtccagccaccgcagctaccttttgctccgcctcttccgcgccggcaggcagccgttgccatcggtgacgatggcgccatggagttttgcttggaggtaattgtggcaccatggattagcctatgccgcgcgaggaagacgattggttcgtcaaggtcagcatccttgttgatggtcaatggattgaaatgggtttgagtggtttggaaaggtggattgaatccatatgaggggaatggattggcttggtttggactgaggtagaaaatgggttggaatattggtttgggttctaaaagttgatttgtggactggattggtttgggctactttaactggttgtcatggtttggactgggaatggtgcgggttttgatccattggcaggctttattgctcacatcccatcaccatcgatgagttgctgccatttcgccaacctcctattcaagcttccccgcgtcactctcctccatctaggagttgattcttggatgctccgacacaattgattttttggatcagttttctagttttcaaggatctagtagcgagaaaatatcttggattggcttcttaattagcaacatgatttagaatattcaaggatgtgttcgagagaaggggaaagaagaaaattgagaagatatgcataacgagataaaccattaatgcatgatctattacatattaattattttaaacataaaaatgattaatataatttttaaaacaatattttttttattttttctaaaaaaacacattgttagtagtttggtaagtctgagcgcaggacaccagctatttctcgtatcgttcaaataatctgctttgggtgtgtttagttcacactaaaattggaagtttggttgaaattaaaacgatgtgatgtaaaagttggattgttatgtgtgtagaaaagttttgatatgatcgaaaagttgaaagcttgaaaaaaaattttgaaactaaagtcagctttattagtactctgctgataatctgaatctgcagcttaaggtgacctatgtgcttgctcttgcccgccgccaacaggagctactcctactcgacgtgtgcatccttctcctgcgcctcaacaacagtattgattgagggtgtttttgattcatggtcatgtatggataggatatagccatctatattttattgaatatggtgatttaattttctgtttggtttgtatggatatggcgatccaatttcttgtttggttcgagggatatagcatagatgagaaaagccaaaagttagtaggacccatttgtcatatatatatatatttatcaaaatataatcatccgagatcttgttttaaagatttaattacaaatataatggtgtaatcaaatcataaattagataaatggtttagaagaaaaaatcatttggagcttgcttaagaggacaaccacagccaatcggaataggacacttcacccagtccaaaactggatggcttcatccagccaaatcggccggatgcactcatccagcatagtaagggaatactctctattatgtaccgtctcatccaccctgacctccaaccaaacaccacagaaactcgagcggtcatctcccatccagactcatccacccaaccaaaataactgatgccgaccatgtaaagcagcttagcagcgacgctctcgttctcgctgggtcggttggtgcgtcacggtgcgagaactccgggcggggatggccctgggcgtgctggccgaacggcgcgggaggtggcttggttgggcctactgaagctgctcggtcgtcaaagcgagcggcgcgacgaggtgcgattcaggcaccgagcacatttcgagcgcacacgtgcaacatgcttgccaggctgcctagctgggccggcctgggaggaagaatggagtacatttggaataagttcactttagatccctcaatttgtcatccagtctgatttttatccctgaaccgcaaaaccggatacaacgcatctcccaacttacagaaccattgcacataaggtcctaaggcggtttggatggcggttttagctgacgtaacgcctatgtggctagtttgactttgtctttgtcctacgtggcagtgacatggactggaagtaaaatgtaaatttttaaaaaatgtgggtcccacatgtctgtcatacaaaacataaaattagtggggcccacatatcagtcaaacaaaacacaaaaaaggtgaggcccacatgtcagtgggtcccacatgagcaggtggaggagatgccatggggagacacccctgatttccagctgcatgtagccgaggaatgttagaaggggtcggagagacttctacaggttgtcgagcacaatctcggcggtagacttgatcggggatgtttccggcgggaagaacaggtcgtggatcttcacaaggacgaagaagggtatatggttctccaggaggtagaacacgtcacggatgtgctcgatgttgtcctgcgcgcacatctcgccgccggaggagctgcttcctcccccgaatctgccgataccaaagcaatggaggatgtagaacccatcgaccaacaacagtttcgacggcgtcaggtcgtcgaacttattggcgccgtctgcgtagtatctcctcacttcggcaaggaagttggcggcggcgatctcacccaggtagcggtgcagcgtggaccgctgctcctgctcgtcgccggggagggcgccgtggagcgccgcaagcttcacgggttccatccgctggtcgggattgcggtggtaggggccgacgaggatcgagtcttgggtgtactgggaactgtcgacgttgcgaatgcctctcttcaccattgagatgtggtactctgaagaagggacgattcccttaaccttcaaatcaaattgcgcatgctctcgtacaaaccctcaaccaatgccttcatgtcgatgattgtttgcggattggggtttcctgcaaatcaaattaaaagagcccgttgctaccattttagaccagagaggcagagactatctaatgatatttacttatatactatttacatcgtcagatttttttctttttcacaataatattattgaacgtctacaaattatatggtaaactattatatatacaacaaattaacgcttggacacactgagagataagagttagcacgggcattttaaaattgaacaagtgaatgttattttcaaccctcccaccccctccccccctcccccgggcttaaccatagaagtcaaaagttcatcatgtacaaacgtagacgctcatagcgcgtcatgttaattatagccacaagtcatgctttttgttccttgcgtaatttctgtgcatatgttttcaggcatatcattaacatctgatataaccacaacgtcattcattttatcataagaccacatataaaaaaatataaattccttttggaatactatactttgttggattatcacagtacatatttttaggatgtgtcactattttagtaaaactagatatgtatcctgcgctattgcacagaccctgctatttttctaaatgttaaattgttttttggtaactaaaatttattagtaattacatatttatatccgatacgattttttatatataaggcaatcatacgtcatttaataaatccatcgaggcttgcttgcaggggaagaattggagttcttgtttgcatgcatcaagtttaatatatactactaaaattgagatcttagataatacaaactaattattatttgaaatttgttttttcaatgttttccttagcgactagcgcatgtctcatggctgatagtggtacctaattggttgttcataacattaatatcaattccaataattttaactagatatggagctcctcggcccttttcaaataaagatgatactaataataatatatagatatacaaagttcaaaaaaggtttagtcatcacaaattagttgtcaagggattccattgttgtcatgtgttggtggctcgttgtgatctttgctggactcatgtagtattgtggttggttgactagaaacctaatgcaacttgaccctagtcatcgtcttctacaaccctactctccttgtgacggcttaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36222 - DNA, 594 bp, Oryza sativa
ctccggctttgtcatctcgagggccccgccggccctgggccgcgtctccgtcatggtcgggtgtcgccggaactgccgttcccgccgcctctcgtgccagtcgccgacatcctttccgccgccagccgactccctgtggtcgtatcgccgtcgccgtcctcggtgagaatccccaccgtcccttccccttttttccctcctccgccgctccccgtgcccgttgccgcgacgcgccgctgtcgccggcggtcgtctggccgcacgccgccgcgcgctatcgctttaccaggccggctgtgccgtgcccgtgccccagccgcgccgcctcgtggcggtccgatcggctttgggccgatccgggccgtcggttcccgtggaccggcggtggaccgcctcggtggtcccggtccacggtggaccggcgcccttgtgccgctgaccggtggggcccgcttgccggcgccgcccctcccccttgatgacgtcagcgaggtccattttctttgtaaaaataaataataattgcgcaataattcgataataattatagaaatccattaaaatggctcaaaacttctaaaattcatatctaat

SEQ ID NO: 36223 - DNA, 1054 bp, Oryza sativa
ggaagaactggctggggcggcctcggccgggctctaagtagccaacgtcagcgccaacttacttggcgctgaggttgggcacatcagcgccgaagcggttggcgctgaggtagctgccacgtcagctaggggatcggcccggccgccacggtggcacaatgtcagcgccagtcccgttggcgctgacacagccaacctcagcgccaatgcgcttggcgctgagccgacggcctagttttggttgaagtttttggcaggggttagtttcgaaataagtttttgaaaagggttaatttgtcaaaaaaacggcatatatggctatacattcctaataaaatatagtagcttcagaagtaatagcagtacaactacacttgaagttattggttgtctacagatccagctaaaagataccaagtaactccagctaggggccattaatctaactcgtttcgtacccttggcaggaacacgaatggcgttctttcacccaaccacactagcatagttgtcaactagcagcataacatgctatgtatttgctctctgtgatgcttagtatgggatgagtgatacagaaattgagcaagagcaacagcaggcctccaatcaaaacccaagaaattaacaactgtatactgatacaacctccacctttacatggtaattgataaaactgatgcactgtatttattatccacaaagaaagattcatttgaagaacagaatctcatgctggtcttcagtccttctctcaaattcttttcaaaattatcataaagttcacgtaccaggtacagttgaacatatgtattgtagcttcagaagtactaacagtacagtacagtggacttgacattatcaacggtaatattgtgattgtctttaaacctaataagaacaccaatcaattctttggtttatcaaaaatgatggtgttgtagcatgggataaactccgtccccccatgctcgtccggaaacatatgctaagaaaaaaaatgagttcgagtcaaattatttgctcaaatgaagtttccatgcaaagtgatttt

SEQ ID NO: 36224 - DNA, 8491 bp, Oryza sativa
catgctggtcttcagtccttctctcagattcttttcaaaattatcataaagttcacgtaccaggtacagttgaacatatgtattgtagcttcagaagtactaacagtacagtacagtggacttgacattatcaacggtaatattgtgattgtctttaaacctaataagaacaccaatcaattctttggtttatcaaaaatgatggtgttgtagcatgggataaacaccgtccccccatgctcggccgaaaacatatgctaaggaggagaatgagttcgagtcaaattatttgctcaaatgaagtttccatgcaaagtgattttcagtccagaaattcgtgctcaccaaaaaaggcctgttccaaagggaaatgtatttgagtgagattgcttgctcgaactaacatcactaatgaagttgtgttttgagcaggtcaaagagacaaggagccagaaaggtgggaaaatgtgttcgagtcctaacatggatgttgtcttgagcatgtgaagttgaggaaaagtaccatcgaggatcgagcaaagggtatattttgggaaaatatcaaggggaccacctcaactcctctcaccaactagcaccagatgtcacctagggaccactaaaatgtaccgatatgcccctataggtcatgaactttataggggtaatataataacttcgtgtaaacctgtaatagccaacttgtaaatcttggatatacggttgagcactatttaagctaaccaagaccctatagcatggggcgagatcaatagggaaaaggcatatttattcactttggcatttgtcttttgagctcactctcaggatagacgggtgtcggtgaaatgggcccgagggtacgcacagtagagggaagccgccttcccgtatgggcacgtggctaagcggcctggatttcccccgcccccttcggggaggcggtcaggtagcgctgacgcggccaagggcctcgaggtgccacatcacgaccctcgggccctcagcgtgcgccaccccgaggccctcgcccggccaccatgtggcggggagagcgggaggtgcagggtgccccaatcgtcccacgccgcatttaatgcggtgtgggtgggcgtgtggcgccgctcgattgacccctgtcaatcgagcacgaccggcctgtgatcggtccttggcgactggacgagcgacagtgcccccacgtcccgccctgtgtcaggcggagtgggggcaggtatgccccgtcccgtcagcacactgccgagtacgccgcctacgcatggtgagtccaccgtcttcacgcatttatgaggaaatgacagggatgtcccccgtgtcaggcggagggcggcgcaaggccccgcctgaagccaggcaaccatgttgcttccggttgaagcaaaggatagcggtatgattagggccatatggcccccctcccttagaggggtaggtgcaaacgatgcatgtggtatccccttgaactataaaaggaggacttcgcccgccgagaaaaaggacgactctcagataacttgagctcgggaggaagaacagttaggtttccctccggagctcaaaacctcttataagaattcaccataatcccatacataggagtagggtattacgcccgatagcggtccaaacctgcataatccttgatctctcacacagccacgagggcgatctagcggttagacgacaagcggaagcaactccttgatcatcgcgccatttcccccaaccgaactcacaaagggggatctcacgatcacccgctagagaggatcacttctcgacagtgggaatttacttttttctcgtctatcccccaactttgtccgtgccctaaggtcacgacagtggcgccgtctatggggacgtaaagtctcccagaggcgagcttgaaaaggtaaatgcaacgtccacaacgagcgaagacagtaccagcaagatatacagatacattctcaagcgcggtaggtagcataaatgaatagtacataagcagatcccgatactggaagaactgaaaggagagaaactcaagttgaaacaatcattgaggaagtcaagaaacggcaagaacatcagctccgacgaaagtagaactagcaaaaaatggtgcaagcacaaggggttgtaacggtgaacagagaacaatatgaagggttacaaagggagttgcagcgattgcaggctttgcattatcaagcaatgagggcaaacagatcccagaggcaagaagggaaaacacaacgggctgacggaatccaatcaagccgtgcagtggagaatactcaagaggagaatgcacatgaagaaaacttgcaaagaagaattgctcgaatggaaaacactcaaccaatagaaccacgcaaggaattcctcaaatccaaaattttcaaaaccaaattccccaaacctagaatcttcaagcccgaattcctgaaacccaaattcccaaacaaagaatcctcaaacccaaattccccaaatccaaaatcttcaaacctaaatccctcaaatccaaaatctccaagctttagatccctcaaacaaaagtgcttcaaaaccaaaatcctcaagacaaaacttcaattcattccctcaagtcatttcccaataccaagtattttgcactcaacccaatcaaacaatccaagaacaccaaaaccaaacattctaacaataccaatttcaacagcaaatgccctaccaaaatacttcacaatattttggccaattccaaaatcagataagcaattttccatcaacccaacacctccaattccatccaactcgtgctacagataccaaaaaccctctaagccaaagtttacaaatggcaccatggccagcaaatttcaagttatccaacatcagcaaatacaaaggcgacgctgatccaaacgattatttgagggtgtatgaaacagcagttgtaagccaatacctcctgaaatataaatatcacattagttgcctatattttttgaaatctctcataaactattacatttcttacatctcaaaagacaagagataggcaaacaattcacgctcataaatgtaatgattttatgttttactgtttcatagcaacatgccatttagattaaaaaccaacaatgttagctctgtacatcaacatgtcacgactaaatatatattaaaaaacctgaactacaaacaatgaaacatacatgcacattactacgaataaactaactacaaacaaagaaacatacatacacattactacaaataaactgaaaaaggataatactccctccattccaaatttatctacatatttcataggtacatcaagaccacgaaaagctaataactctctcatattatatttactctagcaacaaactcgatgcatgcaccatccccactattttctagccaatagcaaatcaagatattgcatgtgtggttataaatacttatgtgcatagatgcatgcatcaatgtccatttactccaatgcacaaataatgaataggctcaatgaatgaacacaaatatatagatcatttaggaataatctcaaaaaacactatatgtagatcaatttggaatggagggagtacaaaacaaacctttgattcttatatcttcctctctttctctttcttcaactctactagtttgttaaattccaattcggatgtctgatcggaagcccataactgaatcataagaaactctaatgcccaagatttgcgaatataatgctcaagatcagactttgtcttacccaactcgatttctttatggccaagtttcgctattacctacagtgtaacaagattgttatttaaattataattgcaacaaaaatttaaaatattaagcgtaatacataaaaaaataaatacataagtttaggaaattacatctgatggaatatattcaacttcatgttcgataatgtctctaagttcatccaatagatttcttaatgttttcggtgcagattttattcttttgttgccaatccataaaggccttgtagattcaatactgtttgcatctagaaactctgtcaatgtgtatgctgactttgattcatcaagtggatgtatttgttttggtttgcaatgaatactgacatgagtccaaagaaacagaactttctcaaatttttcgcgcacagacaagaaagcactctgctgaagaatatctaaactgcaacaattaaaaaaaatagagtgttagaagtatggatatgtcaattaaagataagagtcaaatacaaattatagagataagatataatcctagagataaaatagagtactagagatggaatcctagagataaatataatcttgcttgtattgtattcctatatataccccatgagagggtcgatgtaaaccaacagaatacaattagatttttcacatggtatcagagccttagagatcaacgtcgttcgattctcgcgtcgccctagggagatgagatcaatcctataatctccatggggcgccgcatctattagctaccaaattaccgatatattagaatctttcccaatatcagcattagttaaatcctattagccaccacgttcggcaaccagttagtattagattagcttttcaagttttagaaaattgcatggcaatctcttcgtgcaggagttgaagcgcagcggcatgaatgtcgtgttaccacaccattcgcaccgacaccctcccgctcttctatgtcaggacagcagcgacggcagcaccaggacgcccaggaaggaaccatctactactgcatccatctactcaattgagaggagaagcacatggtgcacaggagaataagatcctcacgcccggtgctacaagcatcaaatcaagcgtcaagccaccaagccatctgcgtcgatcatcttcgccaagttcctacgaccggcagcgacgtaagccgcggctgctacctcctctacaccagccatacatttgtcttcgccgacactacattaccggtggtcttcattaacacgtcgtcgccgcatcgtccacaagtatggacacatgcgcgtcctctaacagatacatttgcagtatgcttcatcagtgacatcgaccgtgtcctctacgacggcaacgaccgcatcaccgatgacggcatcgatcacgtcatctacgatgacaacgactgcatcaactcggcatcactattgtgatgaccgctacacggtgcagaaggaccaaccaaagtggtggcctcatcgccaatgacgtcctctgacattcgtaagacgtcttcaacggcatcctctgacatctacaaggtgcaagatgctaacaattgcagtgccatcttaacaccatgtcgtaaatattttttttccgcctttggctattcgcggctatatcaactactatgatcaccacgaccacgactactacatgattggctacatcgatgaacgtctacaacaacaatcatctacgaaaactccagctaaagtgtttgtgtcatcactatcatccataacactcccgctatggctgcgggaggaaatagaggagagaagggacgacacagaaggggacgcaagcaccaggtgtagagtgagtcaaagaagatgaagaaatagatttcaaatccggtcgcaatcgatcgcttcactcccgttacgactaaggggaatgttaggaatatatatatgttagttagagataagagtcaaatacaaattatacagataagatataatcctaaaaacagaatcctagagataaaatagaatcttagagatagaatcttaaagataaatatactcttgcttatattgtactccaactctctatctcctatgtactcttatatatacccgatgagagggttgatgtaatacaacagaatacagcaaataaatttttcacagagacatcactaaaatctaaataattaattagtataaaacatttcattgagattaaaaaacaataaatgattatttcaacttaccctcttatctgaccttttgaaatctggtagcatacatagtgtatctctagcgaatcactagaattagcgaaatttctctcagctactacgcgaagcatatctcccaatcttttccaatccatatttttcttgacatcttagtttaagaagagacaaataatacagacaaatggcaattacaaagttagagaacagaaaattataatgttatcaatatcagcaatttcaattatttgaattttacctgaagtacaaacagtaaaattccagatttttgcatctatggagttattgttcatcttaattgctatgtctgcccctttcaaatttggacagaagaaaccattatcgtgaagtgcttgcaaacctttgacaatttgactgaaagaaaagtaacagaaaacattagcacgcctgaagggagatggaattcagtcaaaaaaaatatcaatgtttttgtgcagctcatccatatcatcaaaatttagtgacacggtgtattttttagtttttgctacaatatgaagtttgtttgattagagttgtcatataaacctactgtttgccattgttctagtgcttgtgtgcaaaagaacctttagctggtcttggtgcacacaactggctagatggatgcactgatctataggcagtagtgtagccgggatttagacttgaggggggccaactgaagctatgtactgagcgacaatgaacgggaaaaaaatatccatcagaattcatgctcatttcgagcacttgatatagatgatacttcaaatcaacatatatttatatgttttgagcataaaaaatgttttagtgtctattacttacatacaatagttgcatatgaggaatcaccagaaaactgcagctattggaacagcctagcagtccaatcgttgttaccgttccttcattagcctgttgcagaattactactatacgtgctagcatgcaaagacaggatgaaataatcatcataagcctgtttgggcctgaacctagctagtagtggaggcctgaatagagccagtacaccaaaatgcttagcctagtgtcctaattaaatgattaattattggcagttcctagggaaaacacattaaatggcaggctacctgtgcatctgcgctaacatcaatttattaaatttggtgagaactgaacaataggttgcaagatgacacaaataacagtaggtggtgcagcgtaatatactcatcaaaacattgaaagtgcagttataccttactgcttcagtaaaaacttccgtgaatcttcccatttcaacagctctgctacccttggcaattaaatcactgaaggttaaatggaacatcggaaaggccacaaacccatactttgagtgatgacggctgccccaagaacaccccaaagatttcattacagagggatgatcaaatgatgaccatttcttgtgcattgcaggcatctcatcagcatcacattgaaaagcaaagatagtggcttttattggttgagagtccgttgagcccaacttgatagtaccatcataacatatgatataagttccccccctaccaatattcttgtgtttcatgtctgtaattatcatctctgatacgccttcaaccttcaataaaagagagataaccagcagtatttcccaatcagtattactagctataaatcatgaatataatagcattttgtattaatatgcaggttcaagaaaagcactccattccaaatgtccaatattagcatgcgttgttatgttttactccctccgttccattttgatcatcgtattgcaaaaaaataataattccattttgatcgtcgcattacggtggggaggagatgaaaatcccgggaaggatgttaatgacacttcctaacgaacactgcatgcatctgattggtcaggctatgcggcatgcaaaactgattaggagccgctgcatgcatcgatttaatacgctcacaactgattggccagccatacagcatgcaaaattgatggcgttacattcacggatacgaaacgctgttttcgatgctgattaagtgctccacatgattgtcttggtattgatgcacaaagcatatatgaagatcaattaggaatggagggagtatttctatatcagagcagtagcaatgatactcaaatcaataaagaagaaaacatgtgtttgtcacatgccggttacaagcaaacaaggaagcaatgttattcatttttctagagaggaacacgcactcattatgttaacattcggctttgttatccattaccgaaaaactttatcacgcagtgagatcgatataaccgcaagtatcaagtcccaggcatcaaaatcggttaattctgaagggcatgttcctaaaccgaaactacacagtggcaagtctgtcaagagacaagtttatgatggcatgtaattaattgggtcttactgattgagattatggacctcaatgcatacctcgctcttgacag

SEQ ID NO: 36225 - DNA, 6404 bp, Oryza sativa
  unsure (1)..(6404): unsure at all n locations
agaagtctccttgcacgacgacgacgccggcggccgcggggaggcgggcggcgaaaaaccggccgtcgaggaggccgaggcgccccgtgcggcgcgggcggtgcagcgctaggtcgagggcgcgcgacgcccgcggcgccgcggaggaggcgaagatgccgccgtcgaaatggcgggggaggggcattctccggcggggtggctccgttgcggcggcgacgctaggtcacgaggcggaggcggaggtggaggcgcaaggcgggagccccgggagacgaagggggtggaaatttcgggcgggtcgcgagtcgcaacaaggtgccgtgctgcagggtcggtcggtcgcacggcacgagccggctcacgttccgggtgcgacctgaatgagcgaacccagccagatcggtcggtcacacgacacgagtcggctcacgttccggggtgcgacctgaatgagcgaacccagccagatggtggtgcggttcgtttcgaacgcgatccatatgtactaggtatatttttcgtgaaaggtaaatccccaaatatcatatggttgatccacgtaagcaaaagaaatataaatatgatagagaaatattgggcttgtttgggaagctttagattcggagaagtagctgtttggtagccagcttctaacaatctagaaaagctctgaaacccagcttctccagtttttagcttcttagtttatttttcagaatctgtaactatatattctcagaagctgtggattgtttggaacagcttctagcaaaagcagctttttaaaaaagatgtccaaacagaacctgtacaagataaaaataacattggacctacatgtcatattctaccttttcctcctactcgccctaaccttcactccatgcgacggagccagtccacgtggtggctggcacgggtacgggcaagggcaacgctgcatgacaggattagacggagaccatggccgcacgggcagaggccggtgtgggggcaccatgcgacaggccaggccgcgtggtggatatttcggacctctcacgttatttctctctcttattcaacaaaaaataaatattctaatgattatggtgttcaacaactaatatccatctttcgagaatatctatttttaaagattgactttcgccgtgtcctgaagataaaaccgcagtcgtagtgtcaatttgtcaattataaaactctgttttacatatgaatttaaagtttgcagtcggtagataatttattgtcataataatattgtttattacatatcaaaacaaatgtgcttgctaactagactttatgataatttcattccctaatacattaatttatataagctaaacaatgctaatatgttcccaacatttgtgagttacgtcaatttcatgtccaccatttacacaaatgatcactatgattgggggcctaaccttattcacctacatatcatgttcaaacccctctatttattatattataaacgggccctcaacctatttaataaaaattggtcaagttataaatgcaccttaatcctctatctagacatggattatttgaaaaacatttacaaataaacccttatcttatatttataaacctcaatagactaaaaataatttattcaaataacatgtaaagacatccaatacagagccagattaaagttgcacgaatgtgcgactatttgcactagtaaaagggtgaaagcaaaatcgtttttaactcaaaagcaacacaaacaaataaaataaaaggtcatcataattgtgataattacaaaatatggtatatcattccagtgcaagatttcctctcccatctatggcatgctacttcaacgacctgactcatttccaacaaaggaaatactgtaaaatagtacattttcataggagaaattataagcgatctaggcacaatttcactatataaacccctctttgaatttgaataaagaatgtcattgtttagcaaaaagaaggcatctaagtgatgtttccactgctacgacgacataccgctttttatcagctttgaagatttttctaccgcttctagctcaataatcagccaaaaataagactatctttcagctggaatttgtttcatatattcaaatataaaggagtcgattcaagtaattcatgtggggcgcgtggtaaaaaccattgctttcggacttccattacatatgtcaaactgcaagttagacgtgtgtggatgcaaattgtgcaccagatatccaaaatatgttattaacatgtgtccaataagaaaatactactgtacttacctaaatctatcatgatgtagatgccaaaaaggggaaacacttttttcacattccaattttgcctttgtatatgttaatcctcatctaagcaggtgaaatgaatgttatacaccacatagcagtaaattacaggctacaacagtgcataaagtataaatgattccattagtttttgccacaagaagttcccctgccatttagtgcaactttccagaccatgttaaaaacgaaatgtcatttgtaccaaagtttccttcatcagcacttttcctaagagcagctgcaagaatggagatcaaattttgttaaacgggagtaaaaaggaaaggaaatggacttttttttaggacatgctaaaaaatcatcttggttaccagtgtatcagaagcaattgtacgcatagtgatcattttgcagcttttggtggataaaactctctcatgtactgattatcctctgcatgcaagaatataatacaagtactgggagggaaaaggtaacactgtcaaaaatattttcagattacttactccgcaaaaatggtgattccttaatccagcctaaatgacgtatttctgcaatgagtttcaccatatatgtagggcactctttcatcagcagcctcacaacggctttcctgtcctccactgtttcctgtatgaaacagtacatgggaagattaagaaaaatctaaactactttaaaataagcaagtggtgggggtgagtgaccaatctaccggactaccaccaaccacatcaccaactcactacttttttgtgaaggtaaaaaaggagtgtggagccaaagagcccacccgtcagctaaaatgtatacggagaaattaacaaaatgagaaatgtagaaagcgatgacgaaacaggtcgatctgaatgtaatataaattctttgcagtaaagggtgccaaacaacatgtccacatataagtattctaagtttacatagaaacaattttaagtccttcatgcataaattcataccgatccaaattaattgaaaaaaattaacaaaattgcaaaaacagctaacgcacctttgctccactgtatcctttgattaaatcgtctcggtgtgcaaccatgtaaactctgaggaagaataaggagttatacaagcttttgtcattgatttctttgtttggctctcttgatttgttcacctccaacttgtcaatgcagcttttgagaccaagagatgctctaagcttaagctgggatatttttgcctcatcgttgttatagtgccaatatatctccctgataaattgcactttgctgttatgttcccataatccagcttcccacaccagatcttcatacctgtacaccattattttgtatcaacttgggtgcaatgctaaaagaatacctaaaattatttttgtaaggaagtgttacttactttactgtttttttcccaagaagttcagcaaaatggtttagttctgcgtgaagtccaaggtttttatggagcttttgaagaagctgccccaaaccattccaatttgcaacctttagctcatcaacagttggtactgctaagaaaagagagattactcacaagttaggtgacttaagtatattgacaaaactactatgttatacaaattctctcctcaataagagacataaatttcatgaaacaccatgttttctgacatttctaatgtaaaaccccatttctataacttgtataaaggatccctggatttgagaccaaaatatttcagaatttctttttgataaacagaagcaaagctgattcatttcattgattaaaaagagtacaaacatcaaaaccaaacaaaaggggaaacaattaacaaaatattttagattaatcctgattcgcatgtgttcaacatgtctgtggatatacctgtgctagaagctttacccttgcctttccggttatttctcgcattaccggttggtgaaatctccaacttgaagtcagttaacaggacacggtagtcccgctgagcgttcaactggtaaaatattttactttcatcaaaattcaatgccttcaaaggtatttgttcatcatcatataggtcattgacatatttgacggccataaacatttctctgcgaaaaaggtaaaagtatcatctaatgctataaaataaaggcaataacccaaatattaattctgcatctgtgtaacacatacatgcttacaagcttaacccatgcatctgcactgtctcgacatgtttgttattattttgatctatataaattaatctacttttgtcgaatgggcaacaagaaaattcgaaaagtaacatgcttgcatgtatcaggatagtcctgtatggttaaaactatagatcaagctaattaaatcaaacatgaatgcattttcctgctatgcaaagactactttttgcctaaatccatttgtgtttctacagaatcccaaccataattagacatatcttcattatgtgaacagttgagatgtttttttcctctctattaattccagaacttttagttattttcaatcaatacagtaatttctagtctatgaacttgttgatctcaagcctctaagaagaatgtaacatttaaactgacacttacacaaaaattttgcatccttggtcagtgaagccaaatgtataagatttgtcattcgtggcatcctccacatcaaatatttcttctgttggaattaaactcagtggtccatcaaagcatggaaaaacaatatatgccagcttcgtccccttttcttcccaaattccaataggttcaatgatgttgctgtgggagcaacttgcaaggatgtcaaaaagtgcatgagcatgttccaatcttctacacactgctacacatttctcttgttgaccttccggatatgacaacatagcattatatgccacactatcaacaactttgctggcataaactgtcaagtttctgcttcggttttgaatttcaatctgcacaaattaaaaccgtaataggataaggtatttcctatttgtcttattgttttatttgcatcaaataatataaaagttgaaattcaccttagagtctccagggattttaattggcattctgaaaaacaaaacatttcttttgtaagataattttcatagcatgaacttaagtaagaaagaactagtaaagggtgagaaagaactaacgatggatcaggaataggtagattagccacaattgactcattcactttcctttttggagccatcagtaactctgcattgaattgattaaaaccaagagttaggtttcatagcaattgtgtttacccaactttttctaaaggagtggacccttggaacataaagccttaaaagctggcccaaacctatctgagcactccatgtaagactaatccgaccacacaaaatgtttatactatgtgggcccaaaccagcatacaaatgtgaaccaaacagaacacaagtgacaacacatatatcagtaggaaagaaaattaattatggagagcacatagcataaatcgaatccatctgctgtttcaagttgcacaacaagaatacaacaaagagagcataaaaatgttttatcacaacaatattattataccacaagcttatcaggttttatagcacaacaatattattattaataggtttatagcataaaaaggcttattgaaacataaagtcatataagcttaggtagctaagttgggagtgggtatttcagcaatgcccaccccattaatcaaaagcaatgagaaactaacacacaaaaatagtgcacaattagtgaattgttatggtgttagtgaccaaaagttagcgagatgcatactggttgtaaatgatggagtatgcattatagtgcaattaactaatagagccaatgagacccaacatctaacaattcgtctgaatcaaaacacttgaaacatgaggcaaatctaacagcttgcccacatttacaattggtacaaattaatgtcctgaaaggaatctgaaatgagtaggtggttagtttgttggataagnnnnnnnnnnnnnnnnnnnnnnnnnnnnnnnnnnnnnnnnnnnnnnnnnnnnnnnnnnnnn

SEQ ID NO: 36226 - DNA, 3477 bp, Oryza sativa
  unsure (1)..(3477): unsure at all n locations
aaaggcttattgaaacataaagtcatataagcttaggtagctaagttgggagtgggtatttcagcaatgcccaccccattaatcaaaagcaatgagaaactaacacacaaaaatagtgcacaattagtgaattgttatggtgttagtgaccaaaagttagcgagatgcatactggttgtaaatgatggagtatgcattatagtgcaattaactaatagagccaatgagacccaacatctaacaattcgtctgaatcaaaacacttgaaacatgaggcaaatctaacagcttgcccacatttacaattggtacaaattaatgtcctgaaaggaatctgaaatgagtaggtggttagtttgttggataagtatgtaaatagctaccaaggaaggagataagtagatttaagatcgatgttgtgttccacacgcatgctcgactagctgctagcttgttgatacagcagcacttgtgcagatttttaattcacgcatgggcagaggcaggcaggcatgtatccttttgaatctcaagatggatagatttatcgtcagttgcctatatcaacctataatggtatctagctttagacagagtaaccacaagtaatttaccttgaacagggagtgcacattacaataaagcttaagtgaaagctaaagagagggaaaattgtacaatttgaaacgaattcggcgataatctagttatgaaatggtaccatgaggagggagctggtaaggaggcttttgttttttgcttgtttctggtggcgcctccttcatacaacagagtagcattcattttttaagacaacagtaaaacatttcaactagagaataaaattaccttatgcaagctagtaggtttccaggaaacattcaactagaaaacactgtactaattacttaagtaattgatcatgaccaagtcaacagcctaaggctaaaccatgcatggtatgcagtctcagcttaaactgaaacttttgttggctagttaattaagcacagacaggagacaagttctcgagtagaaactacaaaggcgatccatacatacgaatacgattccctgaacgcaattcaaatgaaactgaagggaagaaacttgcgagtttctgacctgtcgatctgcttcacgatccgatcgcggaccaggcagcttcttctccgcgtccgggcagggctctaccgatctcgggtggactccggcgacggtgacgacaagttagggttaggggttggggtgctcggaggcaggagggggaagagggggggcggggcggtggcaggtgacggagaaagggcgcggcgaggcggcgcgggatgcgttacggggaggtgaggaggcggggatccgacgacgttagccgccgctgacgcctcgacggaggggaagaaggcggcgcggaggcgaggtgttgatggcggcggacggggtgggaggaggaggaatacagcggcggaggggagggctggccgcggcggcgcgtgttctggtgggccttgccggagtcggaggcgacaccggcggtcgtcaggggcgggtgggggaggcggcgggcagcgtgaggtggggccgtgtgatcaaaagtactcatcacaagtgcccggtcagatctgcaccgtagggttcaatccaacggcccgaatttcgcatgtgatggaatcataatttctttatatcgttttaatctcactcataatttcttaataatctatccacctactattctactactgtctatttattaccatatagtttcacgaacacagtactcatttatcaaatccaatatcctccactcatatatgtcaaaccgaacgggttaaaattgccttcacctccccccaccgcattcctcccgtatgcacccaccccaccccaatgagaattttgattatttaccatctaaaatgcgcgctttgatttatttaccatctgatccatatgtcttactacactttgataccaccttctacactaatactttctacccatagccatcgacaactatggcagcaacgacgagaagagatggcggagcctccgccatcgtcgccaaatgccacggtggtagcagctgcggcaaggggacaaggagaggaaggaggcgccagacctagccaccggcgaccatggcagaagtgccaagaagagatggtggagctatcatcggtggcggcaaggcaacgcgaagaggatagaagtacgggctaggaagagatggagtgatttttgatgagtttaatgtcaccggagcagaggaataagatagatccaatcacctaagtggaagaaaataacagacgatagggttgttgcagtctatcgtatatgtttgttgcactctattttattcaagtgtttcatccttgttttattcgatgttacacatgatgtactatgtggtttcttcgatgtttgaagagtagagtgttgatgttgtgagtaatgtttttcattgtttgatgatttgattgaaatatttttggcgcttcaaagaggactatttctaggataaatttttttaggggtctatttttgaaataagtttttaagaaggaccaaatagtaaaaaaatcagttggtaacntgttatatgctctttctgatttctgaagttgcttacatgctttaatggtgtgcttgtcagtctaatggtcgctttggtttcattggtgagaacttatttctatgtgactatgtgcatgtcagagttgaggaagagatgaagtttgtcgtgccaacttgatctggctggagacgtggaggcataatatatatctgcgtacacctatgtatctgtggagacccgagtcgggcaaggcaccatgcacgcatgcagagatgggatgcggcttgacacgggccggtgttgaggtagacccgaatgcccgtatcagacgtcggcggctacgtacaaaaaattatgtgacgatggaacgtgacgcggacgaactcggattgacggatgaaaatacgagtttacttttgaaatataaatacgtgtttgagtttatttttaagttcgttcgcttttggaaataaaaaaatatcttataagaaatctctttaaaaaaacctcgctcagctaacttgggacacttttggaaatacaaaaggagtcgtataagaaatcaattttaaaaaactcacatgctatcttgagatgagaatcgaactcttaattacaactcattattttacaaaaaaaaaatccaaacgattttccacaatgattttcactcgaactcaaccgtatagaataatagtaagactaaaatggctttcactcgttgcaacgcatgggtatttttttctagtttttataaaaattgaagatgtttttatcggtattttggtacgtcatccgtgtataagttggtttttaagtttgtttgcttttgaaaatacatatccgtatttgagtctgtttttaagatcgttcctttttattaataccaaagaaaa

SEQ ID NO: 36227 - DNA, 991 bp, Oryza sativa
  unsure (1)..(991): unsure at all n locations
nnnnnnnnnnnnnnnnnnnnnnnnnnnnnnnnnnnnnnnnnnnnnnnnnnnnnnntaatccaaaagaaaacatataagaaatctatttaaaaaaacaaactcgcatgctaacttgagacgatcggactcctaactgcaacttatgattttctaaaaatatatatatccaagcgaactcccgtaatgaattttatcttcactaaatcatataacaataatgggattaatatagacttcacccgttataacgcacgggcattttttctagttttatagtaggtaaagatttagactaaaagtgtcccagcgttgcaacacgaagaaaattgaggaaaagttaaaaaatatttatattatataattaatcaaaaatacaaattttactatcttctttatataaagaatatatatatatatatatatatatatatatgtgtgtgtgtgtagaactactatatggcgttacaggcgccacatattacatggcgcctaacacagccgcaccaccactctgtcccatcttcccccacccaccacatatttgagttaaaatttaactcacgacaccccacacctatgccctcccccacgcccataatccaagttaaattttaacttggtgttactcaacttttagtgtatatatataccagtgttgtacatccaccccgtaaccaatcacatatccagatcctattttttcgaagatgagagcggcgagcgggcgtggcggctggcggtgccggcattgggcggatccggcacggcacgactggcggcgcgacgtcgagcgccacctccactgccgagcggcggcgggcgcgacgtcggcggatccggtacggcacggctgcaggcgtggaggtgacggttgacggcgtgtaggaggcgacgaggcggcgcacccggccgccgatctgcgccccacgcgcgaggatccggccatggtagggcgtatctggcgcgatgacggatccggggataatcctgc

SEQ ID NO: 36228 - DNA, 1606 bp, Oryza sativa
ccgctccacgccccacgcacacggcggcgacctccgcggcggcgagttcgaacaccgaaggacatggaggagcagcggcaaacacctccatggcgctccgccgttgatgtccggagcaagtgccgacaaaaatttaacttacgcttatagattgtgaggatgtatttgttgagttaaaatctcgttgtacacaagttaaaatttaactcatacaaactgaattaactctacaacgatgtcctgtagttttgtatcgcgagataatttttaactcagcagcgaccagacttaatcacatatcatctagaattgaacaacaacaagtaattttttaactccaaaaccatgtcatcgcatcccaccacccaattgtacgtaagttaaactttaactcatatcaattgaaaccatgtataatattaactcctcaacgacgtcatcgcacccaccacctaactgtatataagttaaaatttaacttcgctggttttaccccaccacccaactgtatctaagttaaattttaactccgcgggtgggttggatgccttgttggtgggattttgtcggtggtgggctgacctctcctcgtttgtgtctggcgccattttgtttcgtggcgcacaacgtctgtgggtggcgctgtgtagcgccaccgtgtatatatatatatatatatatatatagagagagagagagagagagaaactattctacacccgggttacccccctccttcccaagggttacacccacttccccctccttaccaaggcccaagaaccacctcccacctcggtcaaaggcccctcccaccggtcaaacccgcctaataactcccccaccacccacctcttctcagctctcgtcctaggacggtgcagtaacacgacgaccactgtgcagtaacgttgtgtcttacgtgcagtaacagtgttaaaatatagttgaaatatagttatgacggatctacttttgataagctctttttttctagcatcatggtgcaaacggttttaaaaaaacttacatcacttgggagatattgttatttaaagcttgacttttttgcaatttgtctctccacaagtagtaatactatactattatttgttactacttgtctgttgtacgttactataatcacatcacgatgttactacactgcattttactgtattttttgggtagtgttactgcataacacgtggtaacgtgtaccttccatgcagtaacacttttacttttgtgcagtaacagcatctgagacttttaacctataaatttttgtttcaattattgatttactgtaattcaccataatattattgtcacatcttacacatgcagtagcactatattggtgggaggagaccctttttcttgagaagagggaggaagaacggtttcttgaagagaggggtacgtagatgcattttgaagtttaaccctctacatgcagtaacactatagcatcatggtgggaacgattttaaaaaataacatttatcttgtgagatattgcttttcaaagattggaactttgaactttaaccctccacatgcagtaacagaatgtgtaacttgcagtaacaagggcatatac

SEQ ID NO: 36229 - DNA, 1677 bp, Oryza sativa
gatccccagatagatccaatcacctaagtggaagaaaataacagacgatagggttgttgcagtctatcgtatatgtttgttgcactctattttattcaagtgtttcatccttgttttattcgatgttacacatgatgtactatgtggtttcttcgatgtttgaagagtagagtgttgatgttgtgagtaatgtttttcattgtttgatgatttgattgaaatatttttggcgcttcaaagaggactatttctaggataaatttttttaggggtctatttttgaaataagtttttaagaaggaccaaatagtaaaaaaatcagttggtaacttgttatatgctctttctgatttctgaagttgcttacatgctttaatggtgtgcttgtcagtctaatggtcgctttggtttcattggtgagaacttatttctatgtgactatgtgcatgtcagagttgagaaagagatgaagtttgtcgtgccaacttgatctggctggagacgtggaggcataatatatatctgcgtacacctatgtatctgtggagacccgagtcgggcaaggcaccatgcacgcatgcagagatgggatgcggcttgacacgggccggtgttgaggtagacccgaatgcccgtatcagacgtcggcggctacgtacaaaaaattatgtgacgatggaacgtaacgcggacgaactcggattgacggatgaaaatacgagtttacttttgaaatataaatacgtgtttgagtttatttttaagttcgttcgcttttggaaataaaaaaatatcttataagaaatctctttaaaaaaacctcgctcagctaacttgggacacttttggaaatacaaaaggagtcgtataagaaatcaattttaaaaaactcacatgctatcttgagatgagaatcgaactcttaattacaactcattattttacaaaaaaaaaatccaaacgattttccacaatgattttcactcgaactcaaccgtatagaataatagtaagactaaaatggctttcactcgttgcaacgcatgggtatttttttctagtttttataaaaattgaagatgtttttatcggtattttggtacgtcatccgtgtataagttggtttttaagtttgtttgcttttgaaaatacatatccgtatttgagtctgtttttaagatcgttcatttttattaatacaaaagaaaacatataagaaatctatttaaaaaaacaaactcgcatgctaacttgagacgatcggactcctaactgcaacttatgattttctaaaaatatatatatccaagcgaactcccgtaatgaattttatcttcactaaatcatataacaataatgggattaatatagacttcacccgttataacgcacgggcattttttctagttttatagtaggtaaagatttagactaaaagtgtcccagcgttgcaacacgaagaaaattgaggaaaagttaaaaaatatttatattatataattaatcaaaaatacaaattttactatcttctttatataaagaatatatatatatatatatatatatatatatgtgtgtgtgtgtagaactactatatggcgttacaggcgccacatattacatggcgcctaacacagccgcaccaccactctgtcccatcttcccccacccaccaca

SEQ ID NO: 36230 - DNA, 6092 bp, Oryza sativa
  unsure (1)..(6092): unsure at all n locations
gggtatagaatagttattttataccccgggtgtagagctctaactcctaaatataactccaggagttgagtctggagtggagttgtggatctgcataaacctagctccacaactccagtacattttgtgagagagctccacccaactccactcccagttttggtggagctgaaactgtttggctgagctccagctccagaagggatggagctggagctagagctgtgccaaacaggccctatgttgaaaaaaaagtccataaaaattaagtgaaattctagactgatccgactatatatatatatagtcgactatatatatatatatagtaggtctaacgtctccgtactatttggtatttggttttggagtggccatagttaggacgttgggattggctcattttggtcatgagaccaccacggacgggagcacgcagtcgacagacatatgctgaatcggaaatgcctggacgaataattggagttgcatgtaatgttgtggcgtagttgtacaaatctcgagaccgtgttttcgttagtcattttgattgaattgatctctagtttgatgagcaatgacaacagaaatttaaatgatgcatggttcttgtgggggacatggacatacgtatgtatcattataatccaaatcgagaacgggatgaactatgacaccctgatttttgttttagtgatttataaattatttatagaatttatactaaagtttaactaatttattagtgaagtaattgtgggaaataaaatttcccaaataaaatatgtgggaaaaaaaacatgcgggatggggcatgcgggagggggtatagaatagtcttaccctatataatagaatagggcaagagctcacgaaagggtttactgtagtttcaccacgatattactggcaaatgtgcaggacacctaaaaaacataactttgcctaaggacactctaaaaatgtggtaatttattgtagggcactggacacactaaaatataatatccatctaaggatgagagagaaaccatataaaataacatttttacccatatcttcttctcctttttccggtcttcttccgacgctcctctcacttgtgccccctgctgtgattgtaaaggaaaccatgggacgtgtgcatcaacaccgcatcgcgtgtgagcgcgagcgcgtaggcgtgggtgatatgcacgtcccatgggttcttgtaccgtcgcagtagggggatgcgtgagaggagcattgagagaaaccagagagaagagagaagaagataagggtaaaactgtcattttatgttatctctctcatcaatggggtggatattatattttaatgtgtttaatgttctgcagtaaattaccacactttcagagtgtctccggaaaattcacctctttccgatgtcccataatttttcggagcatcctttaacaaaatttgccatttagattggatatttgaggaacgtagattgaacttggtttccatcagggaactgctcgttcggctcggtggcccataagcccattggcccaaatacctccccctctccccgtgagagggatccctcttctttccccttcccgtcttcgtctccgtcgacggcgacgtgcgtaagacgccgcgccaccgcactccggttcgtgccgcggccgcgcccacgcttcccatcggagccccggccccctccgctcctccggctcctttcccccgatcgaccgccgacccacaagaggagtccgtgccgtgggtgttctggcgcggtgtatctcggtgccggaggaggccttgaagctccggcgtgagagagagagagagagagagagagagagagagagagagagagagagagagagagagggagggaagggaaacccggacgcggcccggcctcgccgccagtcgtggcgggagcggtatcctatcctatccccccttcccctcctctccgtaaaaagcttttaaaaccccaggcggcggtcatcatgcctcgccgcaagaagcatccccggtttcgtggcacccttggaacctacaagtttcgacaggctcttcttggcgaccccgcgaggcacaatcggttcagcgtactcgaagcagaagccaccgacgacgattcgtcgacggagccaagctccaggatgcaagacattgaggacagctgcggcaaccgatcaactcaggacaattcacggagagagctggtgacggtttgtcattacttctctctcttctctgcatcctcatcttgtacttataagattataatttgtctgaatttttcccagctaaccacacgcaaccctctagttctaattgtgaccacgtaattgctggatttctctttcaaatcaagaagctcacgtgtgtgtgcagccgcgtttcactggacttgatgtccaataatgggcggctgatcattacgacaaatcacttgctcatacctacttgattaggcctaattgactgtttgatgtcgaaaaagaaaaagctattaccatttgcaattggttagatcaaccattacaagacaggccaccctgccatcatgccatcagtctttagcattctgtcttttctctgccctaatctagcaaaaagtatattggttgacttagatgttgttttcgtttcggaaattggaactgcagtggtaagtttaaatccaaatacatttgcttgatcgccaagatcataatctatgtaactttatttgttttacatagaagccacatcagcaaagaagggttaaagtaacagggtattgtgattgtaatactagtgatacatatgctaatggatcatttgctttgtgcctgctaatttgattggagacataattccggacaatatgtgcttacatttggaattggattgttttgtgtctgtgtgtgtgtgttgggggggggggggggggcatgtgcttagatgagaaaaaacggtggtaaaaattatggatggggtcatattgtgtgattttagtgaattgctggcttgtgataatgtttttttttcttttccttaatgacaaagttctctacttcttttggtggtatatcatcaaatttagtataatgaaataatgaatattaaataacataaatgctttcaattgccacagatggaggatgtagggaatatgaaccctttgttgaggacattgctcgagatggtcagcgaggaacaaatttctgagattccgcgtcatggcctagaaaaccttcttttggtagctatctataccacagtgaaatttaacatattgatgatgcttatgctttctttattaccacatgtatgctctttcttgagatggaaacgtatgtccaatctttagaacatgtgatgctatttactccttttttagtctttaatctggcaaatatattttaactttcacattgacaatattatccatatatgacttccatctgtataattcttgtttagggtattggtgaaggaatgggtcttcatctcgttgaagagaataactttctctatggagctttcacttttgtcgtgacttgtccatggtacttgacattgatattattttttttcctttcaataaatggttttaagtttgctgaactttatgttgttgtgtcacaggattaaaaaagatacaaaattgctttcacgtatacttctccgtttgtcagaaatctggagccaacctgaatgggagacaaatctattggatttttttaacaatgctcagttcaggacgtctgtgtacaatgttgttgctttttttgagaatgagctcaccatgtgcacagcagaaaattatgatggaatcaatcatgagagaaaattaaactattcaactttgactactcttattccactgttatttcccctactcttggaggtaaaaaaaataacctaaatatcttttcacaaattgagatcctaaagatatactagaagaaataatcatttacaaaattgtttctttcagcttcttcagtatgtgcattcactctggacggatgaagttgcttctaacatatcagaagaacttgaaggagctaaatgtattatatgttctgagaagctatgtggtattgttgaagaaactactgaaattcaggacatgaatgaggaagagttgctggtagatgagataagggagtggctagaaaaaatccgccaaactgggtatgtttttctttcttggacaacatgcgggagaactgcatgccatttcattataagtaggagcaaagaaaacaaagcagcagacagggacaatgctatgcaaaacacacacacccaccacacacaacacccctacacttcttttctattacaagacaagaaaagctgcaatcacgaccatagtcatcatcattctcaggattcctatcatccgatgcaaacgaccattggagcaggttatgagtcctttagctgcagccatacaccactaagctcctttcctgaaccaccgagtttactgagggagcaacatcattgaaaacagtcacatctgtgcttccacaattcccatgcaacaagcgtgattggagaattcttgcccttcttgagatccctaggtaccttcttaactgtggcagaccaccaaccaggaaaacggtgtagccgcggagcccaaaaatccaagccgaggccattgagaatggtgtgccaaccctgccccgggcaaacacacaagagattaggatgagcttaattttctcgtcagtctgaccacataggaggcacgaggccgggttaggaagtccttgcttggcacctattaggaatagccaatcaaagaaaaaaattgccccgtagtggcaaccatgtcttccaaatacaacgccatggtgcaaaccttatagattccataaaaaaatgcctcgtaagcagacttgtatatgtgcttgttccaataagtttccaggtgtgctaatcttgctcttcttcttgtaactcaatatcacccatcaagtcccatagatgcaatactgaagtggacgacaaaccttctgccaagtgaccaaacaataatcctcacttgttttctcctatctcttccataagaagaccctcctcttatcaatatatttgatggcccatttaaggaggtcctgtgagcactacacgaaccatgatgtggcggccaacttgatgagagaagcttcccatcctagaagatgatcaaccatcttatcaatcaaggggaggagctcggccttggtaggcttttggatagagatattcagggatgagatgggaagctaaatcctcctcctaacattggataggtcataggtgtaattgagctcttagagatatttgtttgactccaaaagcatctccaaagacctctagaacaaccctaattaaagaaactatcttgcgctttgttttgggatatgtggatgaatgcatgttatacattatagaaatgatagatgtatatgtttaaagaatgtgaaaatgatatggagataatgatttgacattgcttgcatattgagttctaaaaatacaacaaaattgtaaatggcgtcatgtttgcatgattttaaaatactctagataataattgttagtgggtgatgatgtggcacacttgcatgttaagctttaggagttagtgagcataagtatatagatagtatagatatcataagactgttgcacccttcctgctttagttagcaccattcctccacttaaaactctagtccgatccatagtaccttagcaatgtattcacgaaatataatgtgaagcttcatctcatattctaacacacaataatttaaggatatcaagatgtggtggtaaggcgtaatatccctttccaatgcattttgtaagttatagcttcatttgaacattgtgttataatgttggttcgaggaaaactttgaaagttcaaagtaaagaaatactttgattgtctacgttatgttttttttgtaattttgtgttcacataaatgtttattttactttgtaggtacaatgttataggtatgtgtgcgagtcttgagggagcattttnnnnnnnnnnnnnnnnnnnnnnnnnnnnnnnnnnnnnnnnnnnnnnnnnnnnnnnnn

SEQ ID NO: 36231 - DNA, 1779 bp, Oryza sativa
  unsure (1)..(1779): unsure at all n locations
nnnnnnnnnnnnnnnnnnnnnnnnnnnnnnnnnnnnnnnnnnnnnnnnnnnnnnnnnnnnnnnntatgtggaacaaattagaacacactaagtgtgggcaacacatagatataaatttgagacaaaaatggcatgttatcaagaggtagtgtttgattaactcgatgtgagaaatgctcagtgaaacataaagtgatataagctcaggtagctaagttggagtggttattccagcactatcagttccattaatcaaaagcattgagaaataaatacacaacaatagtgttaatgaattatgctaaattgaccaaaattagctatatgcaaaatagtgttaataaggagggtttattttgcttgtttctggtgtaaaatagttgatcttgtctccttcagacaaccgagaaacatttgaactaaagaaaaaaagaatgcacagacacacatcttactgctgataggattctaggaaagatgcaacttgacatttttcctaacaaggaacctagggtgaattatgtgaaatatgccgagtatcctgatcaatcgttgtttttataattcaaaattttaaagaaaagtttgattcagtatctcagttcataaatacattcttaaagtggtttctgcataaaaaaacatttgctgtgtaaaagaaaaaacttgagagactgatttactattctgctgtactgtacaataaaatagccttttaaagaacatagtattacttaatgggttaatttgatccatgccattgtaaaatatgtcgaattagataataccattactattcacgatatcggctgggtgctactagaattttgtaaaattataaccatgccatcgtcgtcacattttccttccatgttcttcattctctccatgaccaggtggtgttcgtcgactcttcttatctttggtcaacgcctcgccgccagacgggccctcaccctccatgcacctgtcatcgacggtgtcactgctcccgctgccgtagcaggaaatccagcgacggccagatgaggcgccacgattgacgctgctggtcggtcggctgtgtcacaacaagtgcagctagcgtccaacatacttgctacggaagacacacaagtatgttcgtggttgctctcatcatcaccgctggcaaacatacttgcgtctgaatacatgagaagctagcatacgcatgccatggcgagcccgtgtcagattgcattgagggagaagatgaagcctcggcagcccacactgcttcatcttctcacccgccactgcgccacccctccatgctgaccgccgccgcccctgccaccctaccggcgccagcgtgctcgtcgcaacggcggcaaggtttggagatggctatgagcttgtcgcagcgccatcgccattttttcttttttttttcctctctatattttttcaggagctaattggttccttgctgtagtttggggagaagatgacggaaagtgtgacagcgatggtatggttccaaatttacaaaattggagtggcacccaaccgatatcgtgaataataatgatatttttctaatttaacatatttgcaatggcatacatcacattaacccttacttagttgatcgtggccaaaatcaacagcccaagactaaagcatgcatacagcatactccctatgcagtgcagtctcagcctaaactgaacctattattggctagttaagcatagataggagacaagttgttcaacactagtagaaattaaaggctgttcatggaccatacatacg

SEQ ID NO: 36232 - DNA, 11508 bp, Oryza sativa
ccatttctgggataagttttttcagggctctatttgcgaaataagtttttcaaaaggaccaaaatgtgaaaaatccaggttataagactttctagtatagtccacgttaatatagatgttaataaatctaaacacatatataaatatctagatttattaacttctatataaatgtggactatgctagaaagtcttgtaacctgaaacggaggaagtataagttaatttattggtttatatgcttaaacttaagtataatggtggagtcgtactttcactcacatcaacgttctctaatgtataagtcaatttgttgatttatatgcttacttaagtttaatggtggagtcgtactttcacttcatcacttcacaacaacgttctttaacaattcatgaccccgaacactgacaaaatcgtggtgttcctacccttcttctagttcagcctcgccttgcccaccgacgatttcctccaatatctgcttcacttctatgatatcaacatccatcatctcaaccccaactctatcctccaaattgctatcttcattcatctatgtgaggcgtactgcggcatacccccacactttgcgttcttccattatctctaccaactcaagccgcagcaggagaagaagaatcccatggtggtttgatgcagggagtagcatccagatccggtccgaccagaagccggagttctttgatctcccactcagatccaacaacaagggctagcgctccaagtagttttattgctccaacctgctgcccggtctgcccccttacatcggtcatgaaaccgagtagcttactcgacggtacgccgaaggtacacttgtcggggttgagtttcgtcttgaaggcgcaaaagctgttgaaggtttcttccaagtcggtgatgaggtcttctttcattcgggtcttgatgacggcgtcgtctacataggcctccacgttgcgtgagttggttgtgtaggcacctctgcattgttcgttggtattatgactctgacgttcttgagcccgaagggcatggtgatgtagctgtaggcgccgaattgagtgatgaatgaggtcttgaggcagttgtcttctttaagggcaatttgatgacagcccgagtagacgtcgaggaaggagaggagcttgcagccagctgtggagtcgactacctagtcgatgcggggtagacaatattcctgatattagaaatcatctctctgctagatctagtgagccccataaacaatattgccgatattagaaatcgacaattggcgcatcaggtaggggccgctcgatcatttttctttaggaggagatggcaacccgtggagtcacctgcgcgacaaccgccacattttttgccaccaccctcattgcgctaggttccttcatgttgtcaccaacgacgtcggcaaactggtccagatgacccccggtgtgatcggatgcacccaagcactccgctttcctgcaggtgcggcatttcgcttcgactcctcaagcccgcatcatcatgcgtcctgccgtagatcacgccacctcagctaccctttggcatcagcaacttcatcaccatcattgccaaaaccgtcgccgccaagatccccgttaaggacagcagggaaggcgcaccacttccacatctacctcgtgaactcaagtcccgctaggttgggttcctcgacgaattcgtgcgcctcttcacgagaactcttcatgagttcgggccccgctaggttgggttcctcgacgagttccgggagcatcccgacgtcacaccgcccttcacaagacatcttcgttgtgatcctcctggaaacgaaggccgagaagcaggagcgtgaagaggaggaacgccgcatcaagtaacaacaggaagatcttagctggcacatagaagaactgcgccagcgcggccgtttccaaaaaccgtttccaaaaccatttagggagtcaatttgcattggttttaaagttaggggagatgttatatccggttttgttgtttatagggatgtgattcaacaaggcacatgaggtatgcaaatagactaaggctgtgtttgctggccatggtggggaaccttaccctcccacacggaaaacggaatgatccgttagcgcatgattaattaagtattagctattttttttaaaaatggattaatttgatttttttaagcaattttcgtatagaaattttttttacaaaaaaacatactatttagcagtttcaaaagcgtacatgcggaaaaggagaggggttgggaaaaggggcatccgatcacaccctaattcctttctcgtgttcgttcgcttgccgttatgccacgcgtacgagtcccgtgacgtgctggcccgctacatgccggccatggtgcggctgggctgggccttggacagtaaggtggccttgcgtgaaaagatgtggcccccataatggcccaattaccttctccccaccgcggagggattcacgtcatcgtcttcgagacttcgactctcgactctcccggcgacggcgacggcgccgccgccgccgccgccgcgtacgagtcccgtgacgtgctgagcccccccctccggctcgatcggctctcttccccgacccgatccacagggggagtccggcgtgagagagggggaaacccggacgcgacccggcctcgccgccaatcgtggccaggaattagggttgggtccgtgtcgggctcgggactcctgccgtgccgctgtctgacaagtgacaaccccaacaccgtcccggctgcggtctcctatcctcccctctccctctaaaacatgcctcgcaagaagccaacttcgctttcgccgggaacatcccggtttcctccaagccctggaatctacaagtttcgaccggctatcctttgggactccgcgaggcacaacagattcagcgcacgcaacagattcagcgtactagaagccatcagcgacgaggacgacgattcgttgacggagcgagactccaccacttcagacagctgtggcgaggacaattcgcggaaagacccaccgctggtttgccattacttcttctctgcatcaacttatttatctaggatttacaaattgtttgtggatgtggccttattgtgtgattttagtgaatgaattgctagcttgtgataatagtaatgttcttttttttttccttttccttatgccagaattctctacttcttttggtggcatatcatcaattttaatataatgaataataaataatatggatgttttcaattgtcacagatggaggatggagagattgtgaatcccttggtgaggacattgctcgagctgttcagcgaggaacaaatttctgaaatcccactcatggaaacatatattcgcagatgtgtaagtaacaagttttatgctagattgtgatgggtaatggaatcttctaaatcttgttccacaaccgtgatggaaacatatattcaatcttcaaaacctgtgatgttgtttaattatttttttagtttttaagctggtagatatatttaaacttgcacattgacatgttatatccatgtatggatttcatctttaatgtattatgtttgttatgttatccatgtatgactttcatctctaatgtatgtaatgtattatgtttgttctccagggtatcagtgaaggaatgggatctcatcttattgaagagaataactttctctttggagctttcacttctatagtggcttgtccatggtacttgacaatgacatcatttttttctttcataacatggttttaagtttgctaaatattatattttgtcacaggattaaaaaagatacaatactgctttccagcatacttctccgtttatcagaaatatggaaccaatcagaatgggtgacaaatctattggacttttttgaagatgctcagttcaggacatctgtgtacaatgttgttgcatttttcgaggatcagctcacaatgtccacgacagaaaattctaatggaatcgaccataaggagaaattaagctattcaactttgtttgcccttcttccactgttacttcccttactcttaaaggttaaaaaaactaaataccatacttttctaaaattgagattatagcataccggaagaatttagttatttgtagtaatttcatatttattacaactgttcttttttttttgcagcttcttcagtatgtgcattcactttggacggatgaagttgcttctaacgtatcagaaaaacttgaaggagctaaatttattatacaagctgagaagccatttggtattattgaagaaactactgaaatgctagatatgaatgaggaagagttgctggaaaatgagataaggaagtggctaaaaaagatccgccaaactgggtatgttttttgctagcaatattcactgtttatagcattcttaatgagtaggttcaataaatatcatgctgggctatttaatgttaccactttaaaactctagtctgaatgcatattacttggcaatagatccacaaaatctaaagtgaagcttcacttttgattctaatatataataatagtttaaggttacattaagatgtgatgggaagaagtaatatccctttccaatatattttggaagttatagcttcatttgaacattgtgctataatatcggttcagcgaaaacttctatgatttttaaagtaaagagatgttttgcttgtctatgttatgtttattttttttaatttttttgtgtttacataaatattaattttattatattctgtaggtataatgtcataggtatgtgtgtgtgtcttgagggagcattttataaacttttggacaacatttctgtttgtggtgccttactgaaggacctagaagtaatggagttccgtcatttgactatgcttattaaacatacaattgttccgttggtgaaaaattgtcctgctgaactttggccgaagtggatagatatgattttacagccagtgtttcactactgtgatgatacattagatggttcatggtgcagttttttgtacaaggaaacaatgctcgttcctgataaattctgtcatatttctttcacggaagaaaagattgaggaattaggaaaggatcatctttttgaggtgactcgtgaaatatcatatatgcttgctgtaatggcactgcctgaattaaatggtggaatagcaaatgagcatcaatctattgtcagcatagtagaaacatctgcagatttggaatctacttgttcaagctcccttgttgggtaagatggtttaacagtagcttataattatatattttgagatgttatgtagttattctgttgtattttggaagttaaaagacaatgaaattgtttattttgcaggtatctcttataccatgatgatcttagaccttcaatactaaggctaatcaataatattattggctattggaaagatagtgaagcaaggattaaagttgtgtcattttgtcatatgctgatccaacttgctatttctacgcacaatgataaacttatatcttttgttcaagataatttaattccaatggttgtccgatgcttaatatttgagccaatatcaaacaataatgatcttcttcttctttgtgaagatgcataccgctgcatacaaagagaggtaattcattagcttcttgtagtccctccattttggcaggtgccattattcgttatcttggttgatacatgagaattctgtgcttattttatgagcaatgctatataaatataattattattagtattgtgcaatattttgactgctccgattggcacaatggtttttcccttttcttttttggacaaaaatgaacccttttattggactcaagtatttgtttatttcaggaatcagtaagtgaaggtcaacatgatggaaatagtgcagaaatatttgaaaactggttgtcaaagcaaatgatagtggctcattatgaacactcacctcctgatgaactcgaagactttgtgtgcatctgggaggtattttgcctcttttttttttttttttttggggggggggggtctatgttaatccttgtgattttaattttgtatgaaatgttttccttacttgaacaatatttttccccctcaaatcagattgaagaagaatttactgcttatcttcacacctatactgaaatgttgcataaagtggatggaatcggtgatacaatagaggtaaattatttatttatccactcccccataaaaaaaaaattctttcaagtgaagaaatgaaaaagtgagttgcatttataatgttggtgcagtggcagatgtggaatttcagttgggaaattaacagttgttgctacgcaatgctttaaatcacttccagcctattttcttttcttaatatttaagcgactgtttcccacaaaatttgaaaataaactaatgatatccgcgttataaatttatgtacatgtttctttggcacacgagaaatcttaaacttgcgtatgtctgatgtaactatatatttcttatttttgggagggagaattgaagtctgtttacctgtttgcaggatgtttatcttaggtgtcctatcccatttgtgtccaagcatgacaataattgttgtccaatttctaattcatgggccatgtcatctatgctgtcagtaagtatattgatgtacttgcaagtatatctgtgggctgcatactgattatttattttggctctttctgaagcgtaaaataacttcaatgtattgcaagagagagactgaacaaaaattcaagtttctttgtaaacttatcacatttaaaccctacattaaggtatgtgtattatccattatccttagcaaattaagatggtactacacctagcagaaacaccataatgtatacgtatttggacattttacagtgttctggttatgatgagagtgtgcaagagcttgtggatgacgattcagaggtttggtctgcacttcctggatgttgtaggcaggagacacttgaggtaggcattttgtcatgtatgtgctaatgcttaaatgcactctgttgaatattggccaaattactctccgctttcagctcttttgtagaatattagatccctgggagcctcaattccatcctctgatacgtgaggtaatgatgaaaatttacatgttctctttctatttattcttgagtttatcaaattaaatgtgtcttcattgtgtaggatgacaaggaaatgctacgtgaaatagcttacctattaacttcccgggaagatattcattgtgtgcaggtatctttacctttgagtttttacgttctcaggaacatattcattttgtgcaggtatgctttacctttgagttctcatgctcttgagtacttaatgaaactagtgttcttctctgcagtccttccagcctgtctccagcgactttttgctgcatttacaaccttatgcccagaattatattgaggtcaagaacgcaagttctggggtatgctatacaatcatactaatactaatgtcaagcatatttgtgcttttcatcagaaaataaacaattctgcttagatgctattcactgtatatgttgttatcctactagcttgtagctcatgggtatattttttttttgttgttgccggcttctctagaagcattaagatgatcatagcagtggtagcttcaatgttatttgctggcagatagtttgtagttaataattaaaaatcaccatatatgaccatctgctcaagtaccatgttcggttattggttactcccccagtatgacagggtaaaagaacaaataaggttgcatgaagcatttgatacacatttggcctctggtgcattggatgatcatgttcgtcagattagttcttcaaaggtaggaaatatattatgaacttattgtgcgtacaaaaacagggctaccacattttgctcaactgcttattaattgttgtacctatggttctcaggataatttcgtgaagattatgcttgatgatgatactttgcatagtcagtttatagatctggattatgatctcctgaaattgtcacatgaggtgctattttcctgacatattttccttattcacaaattatttcctaagtattttcatgataactttgtgcccttttacagcgacgagctaaacttcttagtaaacaagatcaattatgcttatattacaaacacatgaaatgtgctgtcgtaaatttgcaggtatgtgatctatatgtcctgcttgtccttaatgttcactaaagttacctcaaagttttttttcccctcaaattactagcattcttgttgttacttaatcacggagtgaagttaatttgttaatttgtatcgctctatgtatttaacatgctatagcatcctatctatatgtttcattctcattttttttacttgatactgcaatatcacatgactatgtcgaaagctaaaagctgttccaaatgagttaccagctatatcatttgccaagtaggctatgcatttcacttttgctaacaaaagagtcaatgtaaaatttgtggttgccattttccatatagtttttgaaccaagattcaaggatctagtggatagtttggcatatttttgtttatttttttatttgtacgatgttttctatttttttaattattttggtgtaataacgaaacaaattgtctgttgatgcccattgcttccaggtttaacacttgaaaaacgtgttgaagccaacatgcattaatttatgaagtgacaactatatgagcttggatatggtttcttagctaattgtgattgtataaattttcagcatagagatagacttgaaagtttgatatgtgagctcgagtcagaaggtttcttccgtgtggatgatgattctattgaatgggtacttatggcactaatagtgttttacttttgctttatagtgcatgcaaaatcaataagcgctttatctaattctatgttttattttttatatgcttgcatttgtaggaaaaggaacacttttcagaacttgtggacgaattcaatgagcatatttttgctgggattcaccttccaaaatattatgttattcgtggagttatggtctgatcttttctcatgcctcaccatcgtttgtctgttaactaaaatagtgaaacctgattcaatgtgttaaatatcaggattatcgggaaatgttacatatgaaggatagcacttgggatgatgctttcacagtggtaggatatgccatctctttgaattggtggattttccttgtgaaacaagtccatattatcatttattggtccatattatcatttattggtttgtttcaggttgttggtggagcattctgtagatggatggaagatcgtgatctggtattgaaatatgctcacaatttgcctattggttctattgtatttctttatattttattcatgttcgttcattttgttagttttggatggagacaagatactataggcatcgttactatgacatcattcaagagccagtaaaaatggtattgacccatattacctccatcttctttcttgctccagagaacctggagacaccattctaaatactggcaggttttggtcaatataattgctttgtcaatgaacttattttcatgctaaggaaacatccaaattctagaaaaaatgaaaacattcaaaaagttaaacgaaactaagaaatcatgcagcatggtctaccaggaaacaaggcacatatagtttcctagtcagttctcatattttattttaattcatctaaaatttttatccttgctcagattcctactagctactccctacattcccaaatataaagcatttctagattcaaaatttgtatgtaatataagcatttcccacacttcaattcctgctaaacaatctagaaatgcttatatttgggaacggactcctcactgttcagaaatgctgccaatgaaaatgtcctactagtttctattcacatatagatgctataatattactctgcagcaagtcatacatagtgtttcatacctttgttgggctagatgttaggcagagagtgatctggtattgaaatgtgcctttgctgtgcaaatccttcctgcttgactacttgttgacctttaatttagaggcaatctagcttaaatacgtactactacatgtgtatcctaagttcctaacatcacgtcacattgttttctattagatatggaggactacaggtgatgagaatgagatgacagttggacacactacaaggtagtttgtgttttattactttccttctttattattgttactattgtataataataaagactaccgatccatctgtaagaagttgccaatttccatgtacatcttgattcaggttctgcccttttctattgatctaaccaaacaatctactatatagacatgacatatttgtatgcaaagtcttcaatttatttatattataatttcccgtcgtttgttttcgtgtcgtagcaggattatagatggcaacggagaattcaccgccggaatgaactagacttggctcaagactgctgcaacacgaaatcaaggagtacctgtctgtcaatcttctaggactctagggcgacaatagtaggcatacaaagttatcaaccaaacctccatggttccagtctcgcacaccaagttttgtgatcacctggaattaagcagagctggatgcttttgattaatcaagtccacctgtaccacaaacacacttgcacatgtgtatatatcctaattttcatcatgttaccaggctacattttgacatatacagacacacccacaacgtgcaaaaaagttcaagcaacagacattgccatgatgttttctcttacttctttcgtttttagggtttgcttggactttgccatcacagaaaaatactcactctattcatttataaatggcaccagacactactcatatttaaatttgaactccttgtttttttccaaaaaaataaatcataaacgctaaaaataatgctatattattgaaatgtgttacatcctaaatataagcattaagcttttgcttatcttacgataactatttaaaaactatttctggtctaagtttaaaaagtgttggtcaattgtgccatctataaatggatggagtatttaatattttttagacaaatggtccaacagcctggcttttgtactacatttttacagcggttgtttgatagggtgctaaacttcatattttgggtgactgagactatattttttgcaattttctattaaaaaggtattatttctaaataaatcctcaaagttaaccgacagttctaaatatcctatttcgatccaactgcaatgaatatgcagggtgaggtcttaccagctctacaggtcacaggccatgaatattactggaattataattcatcccagctattccttcatgtcagtagat

SEQ ID NO: 36233 - DNA, 560 bp, Oryza sativa
attaccttggcgatggttgtttcggcacagttgcagggtggttttgagccatccccggtggcatgcttcatcgcagggtaaggcgaaagaccattgccagcaaggcgaaattcttgcataccccattttgtgcgctctgcggtccgtgaattcccaaagtaaaatgttagggtgcgcctcattcccaccagcatgcagtcgctgccacctccctggttgtagtagactggcttttctgagcctgccgacctccagaaccctttacttgtgatacggttgctacggcgactactagggcactttatctccttctgcataaagaagtacttccctttctccctctatgtcagtgctcctatgtccatgatcaccatcatggaacaagagagagaaaaagacaaaaacaaaaccaacaacaaatcggacattaggccatgcaatcaatcaagcctggtagacatagattaatcaattcgagatgtatctggatgtgctaacaatttttatgggagcaagatgatatggcagcataaagtaaaatatacttaccttggacgatg

SEQ ID NO: 36234 - DNA, 1177 bp, Oryza sativa
taatgatttacctggctctgcatacaatggtatgcatcttcacaaagaagataaagagcattgttatctgacttcggctcgagggttaagcattgtacaatctttggaagtatatcatcttgaacaaaatatagaagttcatcattgtgcgtagcaatagcaagttggatcaaactatgacaaaatggtgcagctataatccttgcttcaccatccttccaatagccaaagatataattgattaaccttagtattgaagatctaatgttatcatggcataaaagatacctacatgtgaaataattcaagtgttatttatattctaaaatacaataaaataactgcacaaaatctcaaaatatactattgtcgttgtaagctgcagttgatccatcttacccaacaagcgagcttgaagtagattccaaatctgctgtgctgacaatagatccattttgttctggcagtgccattgcagcaagcaaatatgatgcttcacgagtcaactcagaaagaagtccctttcccgctttctcaaccatttcttttgagaaagattcacagaatttatcaggaaccgacactatatccttatacagaagactgcaccatgaactgtatagtgtctcttcacagtagtgaaacactggtggtagaagcatatctatccactccacccaaagatcaggaggacaactttttaccaatggaacaattgtatatttaatcagcatggtcaaatgacgaaagtccattgattctacatcttttagtaaggtgccacaaacagaaaagctatccaaaagtttacaaaatgctccctcaagactcgcacacatacctataacattgtacctacaaagtaaaataaacatttatgtgaacacaaaattacaaaaaaaacataacgtagacaatcaaagtatttctttactttgaactttcaaagttttcctcgaaccaacattataacacaatgttcaaatgaagctataacttacaaaatgcattggaaagggatattacgccttaccaccacatcttgatatccttaaattattgtgtgttagaatatgagatgaagcttcacattatatttcgtgaatacattgctaaggtactatggatcggactagagttttaagtggaggaatggtgctaactaaagcaggaaggg

SEQ ID NO: 36235 - DNA, 1979 bp, Oryza sativa
gttcttaagtgtagatattctgttcttgtttttgttgtagcaccaataaacatctctaaccaattgcactttagtgcttgattcccacaatccaggttcccacaccaaatcttcatacctgtaccgttgttccatatcaacttggatacagtgctaaaaaaaatacttacactacttctgtaagggagtgttacttactttactgattctttcccgagctcttctgaaagatggctcaattctatgtgcagcttgaggtctttatggagctttttaagaaattgtcccaaaccattccagttcgcagttttaacgtcatcaacagttggtactcctaaaaaaacacttcaagattattcacaagttgggctgctaaagtatgttacacaaattcacttgtgaataactgataactttcataacactccatgttttgtgacaaatctaatgcaaaactccatttctgtactttgttgaaaggaaatcttagattttagggcaaaatatttcagtttttttttggaatataggcaaaacccaactcatttcattgataaataagagtataaacagttaaacaccaaactcaaaagaataggggaaacactgaacaaaacattttagattaatcctggttcacatgcattcaatgtcttggcatatacctgtgctagaaactttgcccttggctctccggttctttctcacattgcccgttggtgaaatttccatcttgatgtcagttaataggacatgataatcccccttagccttcgactgataaaagattttactttcatccaaatccagtgccttcaatggaattttctcctcgtcatacagcacattgatatatctgactgccatacaaatctctctgcaaaaagataaaaacattatctaattttataactcaaagagcaggcaacaacccaaattttaattatgtgtccattaaatacttgcatgtttaaaagctcatgatatgttcaagcaaattaactcattcacctgcatggtcttgacatgtttgatactcctatttgcatattcttggcacttttgactaaaattttcttccataaatgcttggcactatactattcctaatgcactttctcattttaccattctggttgtctagagaataatctgtccatcctgggtgccaaacatttattcaactcaaaatttaaactcatgctaatggctgccaaatgttgcatctagatctgtcgctattaccagaggttgttacaagggatattttgggcattcacttatcaagaagatcaagcttaattatatgtgcactggtcagaagtgccaagtaaatgcaaaagaagcaagtattgtcgtaatctatacacattcatcaattgcagtcagaagggaaggaaagaaaattggggaaagaaacaggcctgcatgtatgagtagagtcatgcatggctaaaaatataaatcaagctaactgaatcagacatgaatgcagattcctgttatgcaaacactacttgtttctaatgaatatatgtgtttctatagtgtctcaacaatcaacatgcctttgttatgtgaatggctcagatggttattttctattgattaatgtcataatttctagctattttcaattaatacagtaatttctagtcaatagtattaatacgggggcttcttgtcacaccctaattccaaaatccacgttagctgagctcttcgaggagcgggcccacatacacaacaccttacttacactttcgtgcttgcttcatgtaaaaagactgaccagcaggtgctatggttggagagccaatgcttataagttgaccctcatccagctaaatttctaatgtggacggtacaaaccccatcaactacagcttggcacacatggcctcaattacatcacaaagaacagggcagtaaacccaccaactacaactacaccttaagccacattagcctcaatttgt

SEQ ID NO: 36236 - DNA, 1234 bp, Oryza sativa
tttggagagccaaatgcttataagttgaccctcatccagctaaatttctaatgtggacggtacaaaccccatcaactacagcttggcacacatggcctcaattagatcacaaagaacagggcagtaaaccctccaactcaacctacaccttaagccacattagcttcaattgtactaacaagctgctaacagctggagtgttaatctccacactagcctccaagtactataaaagttcataattttgtacttggaaaacaattcagtattgatacatgatacttacctaaagatcctgcaaccttggtcactgaaaccaaatgtataagattcagcatttgtagcatcttccacatcaaataaagcttcttttggaattgaagtcacaactccatcagagcaagggaaaacaataaatgccaggttcgtctccatttcttcccagactcccataggctgtatgatgtttctgtgagagcaatttcgaaggatttcataaagagtatgggcgtgttctgatcttcgtcgtactgctagacatttctcttgttgaccctctgaatataacaacatagcattatatgccacgctgccaggaattttgatagcataaacagtcaagtttctgactcggctttgtatctcaatctgcacaaattaaaatcttaattaggatttaagcttttatcttactattttatttgcattaaataatttaaaggttgcatatatgttagattcaccttagagtttccaggaactataactggatagctgaaaacaaaacattgattttgtaagataatttccattacagtaagaaagtactttagtaaggatgataatatccttaattagtaaagggagagaaataactaacaatgaatcatccgaagttaaattagccacagatagcttgttcactttcttttctgtagccattggtaactctgcagttgattaacttgatgtcagactacatatgtggaacaaattagaacacactaagtgtgggcaacacatagatataaatttgagacaaaaatggcatgttatcaagaggtagtgtttgattaactcgatgtgagaaatgctcagtgaaacataaagtgatataagctcaggtagctaagttggagtggttattccagcactatcagttccattaatcaaaagcattgagaaataaatacacaacaatagtgttaatgaattatgctaaattgaccaaaat

SEQ ID NO: 36237 - DNA, 505 bp, Oryza sativa
atgagaagctagcatacgcatgccatggcgagcccgtgtcagattgcattgagggagaagatgaagcctcggcagcccacactgcttcatcttctcacccgccactgcgccacccctccatgctgaccgccgccgcccctgccaccctaccggcgccagcgtgctcgtcgcaacggcggcaaggtttggagatggctatgagcttgtcgcagcgccatcgccattttttcttttttttttcctctctatattttttcaggagctaattggttccttgctgtagtttggggagaagatgacggaaagtgtgacagcgatggtatgggtccaaatttacaaaattggagtggcacccaaccgatatcgtgaataataatgatatttttctaatttaacatatttgcaatggcatacatcacattaacccttacttagttgatcgtggcccaaatcaacagcccaagactaaagcatgcatacagcatactccctatgcagtgcagtc

SEQ ID NO: 36238 - DNA, 652 bp, Oryza sativa
catttgtgatcaccagatcaatagtgtggatatcaacagcatcaatcacagatagagcgctgctgcagagtgaacaagctatggaaattggaacataaaaagcatatagaatatagaggcttagtatatgacatgataaaaagcacagtatattgaagagcggcaattacctctaccataaaggtagttacctccctttcactttatcttgcatcttgggcgaatgtgtcttgtcctagaagctagaacactggtgcacttgactttcccaaaactaattcaacactctatagattccaacataaacagaaaaacatagactccagcttcaacatcatagagtaccaactcaattaaacataatgcatagtctcaagcacaaacataaaattaaattgcataaatagcttgcaggtctttcttgcgatgaggaagcatcccacctgcaatttttattctaaactaagccgagtttcttccttctattagttcttcccataaccatcactgcccttgtcctttgtgatgacattggcagactcatcactcccctcctcgaaacatctatgccctgggaagtcaatgaagtgacttgacgatcgcctgcattgccaatggcaggaacggcgaggacagcttcccttgcattgcc

SEQ ID NO: 36239 - DNA, 517 bp, Oryza sativa
gcattgtcctattgagtattcaccactgcactgcttgattggattccgtcagcccgttgtgtgtaccttcttgcctctgggatctgtgagccctcattgcttgataatgcaaagcctgcaatcgctgcaactccctttgtaacccttcatattgttctctgttcaccgatacaaccccttgtgcttgcaccattttttgctagttctactttcgtcggagctgatgttcttgccgtgccttgacttcctcaatgattgtttcaacttgagtttctctcatttcagttcttccagtatcgggatctgcttatgtactattcatttatgctacctaccgcgcttgagaatgtatctgtatatcttgctggtactgtcttcgctcgttgtggacgttgcatttaccttttcaagctcgcctctgggagactttacgtccccatagacggcgccactgtcgtgaccttagggcacggacaaagttgggggatagacgagaaaaaagtaaattcccactgtc

SEQ ID NO: 36240 - DNA, 485 bp, Oryza sativa
  unsure (1)..(485): unsure at all n locations
nnnnnnnnnnnnnnnnnnnnnnnnnnnnnnnnnnncttcattaacacgtcgtcgccgcatcgtccacaagtatggacacatgcgcgtcctctaacagatacatttgcagtatgcttcatcagtgacatcgaccgtgtcctctacgacggcaacgaccgcatcaccgatgacggcatcgatcacgtcatctacgatgacaacgactgcatcaactcggcatcactattgtgatgaccgctacacggtgcagaaggaccaaccaaagtggtggcctcatcgccaatgacgtcctctgacattcgtaagacgtcttcaacggcatcctctgacatctacaaggtgcaagatgctaacaattgcagtgccatcttaacaccatgtcgtaaatattttttttccgcctttggctattcgcggctatatcaactactatgatcaccacgaccacgactannnnnnnnnnnnnnnnnnnnnnnnnnnnnnnn

SEQ ID NO: 36241 - DNA, 4117 bp, Oryza sativa
attacaaatgggacacccaaaatcaatttttaatgtagaaaactgacagaaaaacaaacactaatatgggaaaaaaagactaacttgtgcagaatagtgggatggcttacaaaactatgaaaatacaaagccaaagaattgaagacaaaatataaagctaataaaacttgcagtaccatgattagtagacagaactttatttaaatttaatttgaattggcaaacgaaactaacaaaattgacaaaatttcagaaatcgtcaaccattgctaatcttgttcaactttatctcaaaactgaaaactgtcaaaactaagtattgttcactcaaaattttgtgatgaggcattctaattactgacaaaactaacaaaaccatatgtactattaatagattacaaaactacaaaataacaaaagaatatttcaaaaattatctactgctagagaaaacaaaaaacataaatcatgcttcgtattcgagcaggtactagtaacaaaggtaacatcccaaggctgaaattttgataatatagctacatatgatcagtgctaacttttcgacacatatgtgccataaggaaataagtatgtttggagttgggtcagaaacatatataattacaatgaatttgcctttaggaggagagcgttgtggtgaacatcacccagttgtgcggcatcatgtgcccattgaacactaggaccacaacgaaaaagagatctgactattagtgcaatctaatagtaaatataaacagagttgaaacaaagaaacatcatcctccataaccacatcaaaccacagaaaaagcaggaaaaatagaaaaaaaatcagatttactgaattttcagaccttggccatcagaaaaaggaattgacataggaatgcacgttcaaaagagatgagctgctgccttgtccattaatggtgaaaataacgttagactcaagaacaaatgggatatatcaatggatgaaattcttctgtgctaataaaatgaaattgatggcaacaaacctgcagctgaatcccatgagctcctttgcaacaaatcccagcaaatatgccatgcagtagaatggcaaaaggggatgcaatatttgtacatttcacttttagttaccaagacgtatatatattcaatcgcaagaacaagaacctcttttacaaacacacaaactacataataattgttgctaattgtgcatcataatgccaataacaaaaacaaattagtttagtacatatagagtattgtgaaaaatctatcaaaaccttcatgcagattttctgaaaatctgctcagtacccacctagcaatctgatttgattatgctgccctgttatgaccgccattcctaatggatggatcatttatgccgccaatatattataactagtataatatgccttgaagcacgaaagatcaaaataattccaatgattacattttagggctattagttggaaaacaaaattcagaaccatatatctctggaaacaatgtaaacaacatatatagtagagttgaattaaaaatgcactttagtttggttggtttacccctgcaaatggtgataaaattgacgagcacttgaaaattgatggaaacaaacataaaaggattgtagtttctgaacatatataacacaaaacttaaatgattcatataagataatttttaaaatatctgagaattactaaacccctcctaaataaaattactactgggaaacataactacatagagaactaagaaactaaattttggcacgcctgcacacactgctagtctgatacgaaacatatgccatcaaaaaacataacagttctgctagtccaacagaaagagaaggggagagagaagcaacaaaactaatgaatattgtaactactaatttcctctgaaatatattaacaaagctatgctttattattacaaagcaaaaatacatgacaaattcttagttcaaatccttaattttcatcagaacttttagcaatatcttcttagttcaaacatatggtttgagctataaaccatcacactgctgccagaattcttaattcgaaaatatatagtatgagcaggaaggaagcaatttaaacttcttatttcatgctcagacaagttaaagcaaattaattttatcaattcagacaaattgagcacgtaattagtgagctcaaaaaatagtttcttctaattagtgagcatgtaacaactaacagaaacaagcaagattttcttctagttttcttgcaattagaaaatgacatgacatgcatcctctaaaacacaaaagaatggtgaaaaaagaatgctaacatgtcatgttcaaacgagcccaagaaacgagaatccagttaaaataaaacaaaaccttaccgccaacttgcatcctcccctccggccggcgggatcctttggtggggacgccagggacagagcggagagtgcaaaggaagagagagagagaggtggtgagagatagatggcgcacgacagcaactcatattctcccctctagccagctggatccgccggcagggagactagggatagagcagagaggaagaggagaagaatgacccacagcctcacatctagcagatcttcttcccctcatgtagctggacccactggcagggaggccggggacactggagcgacaatgatggcagcaacgtgcgtgaggaagccaacgactcaggaaggagtcgaggacgacaactggacatggtgacatgtgtgacgaagtaaggggaagcatggcccgggcagctgggcgtctcttcttaattgggcagagctttgggccaattgtctcctagtgggccagatgaagacgcaattccggccaacaagtcaaaataaaacagccggtagctgcctagaaaatcccataaaaatgttttttttctgttttcttttgagggggtaaattttcaactctgttgagctagatgttaaatggtttgctcgagacgatggatacaaagtgttactcttacttagttacaccctctgtaaaaaaaaactatcttttggggttgaatctgaacatatgctcgaccagattcgtccccagaagttgtttctttctttttggatggagggagtacgtattatgaccactctaatttaagcataaacatctatatttttccaccttctctcttttattgaagaaaactgaggatttacggttcgcaagagcattctcaagaggcgagatatgtctttatactaccagacttgagagctatgtagaaaaaaaaagtgatcttgaaatttgtcacatcccattcatacaatatctaagcaaaaaattgatgctaatagcttcatcacttagattccaattggttatgttgtggaactagaaagggttaaaactctggttttgagcagaacatgcaaaatcgaaatgcacagtgaaagtaaaagttgacaaagatagaagagaaaaactttaaattctcatgtaaaaatagtggacattttttcttgcagcttgttctacattgtgtattttgtgatagctacaagattgtccaacgttcaatctgtaacatttcttctaatatgcataacttgatagctttgcttgccttcctttaaatccatataagtgaaattgacctatttaactgaaatgtctttgatattatgtccatacatatatactttatagctttgcttgcttgccatgtgcatccatgtgtgcataaaccgctgctctttcttgagttcatggatcactttgatttgtacacaaataccgctatctagcctgccgtgcccaaattcttctttttctgaacaaactggcacaagagacaatgccaactctcgatttggtggaaacttgacacacacgatccggctttcgatcaacacaatccgaaccctgcaattgtagcaccatatctccactagttatcaaccgtgcactgctcggttgacctcgccaagaagactaatccctgcatgcgaatcgaagaacacaagcaagaacaatatagattgcaacacaattgcatatgaatgattaagcactcgaatttggggttctactaaccgaactagcagcgaaactgcaatgaca

SEQ ID NO: 36242 - DNA, 1742 bp, Oryza sativa
cagtcgggtggcgtcccggaggaggcaacaacggcggcaccctccccttcgccggatccggcgggaggggaggcagcgggcgacggcgggcagcggcacgctcccctacggccgatctggcacgagtggaggcggcgggcgacggcgggctccctcccctccgccggatctggcaggaggggaggcggcgagcgacggcgggcagcagtgcgctcccctctgcccgatctggcgggaggggaggcggcaggcaacggcgggcgccctcccctccgcccgatccggcgggaggggaggcggcaggcggaggtgccctcccctccgccggatccggcagaaggggaggcggcgtgcgacggtgggtggcggtgccatcccctccgccggatctggcgagaggggaggcggcggccggcggcgcaagagggcccgccggtgacgaagcagatgaagccttgggccagcctctcttcctccctcttctcttgtagattttttagatgttttggtggatttgtgaatgattttattggagtatgttcgcgatgtcaatcgattttggtgacgatgaatgattatttgtgatgtcaatcgattttggtgatagatttgtgatgatctgtggatgatttggggatttggggatttcaatattatttgggcgcatggcgacggtggtgctcagtgaggtcggctccattcgagccggctctctttttttttttgctcgagctaagctaaaggtgctggtttaataattgtcataggtgccagttttaattattagtgctgaccaataggtgtcggttgggaaaccagcacttatagccggttcccaaccggcacctatgcccctttttgtagtagtgtatatatttgatattatttctctatataattaacagccctattatacataggtttgattgagcacatgtacatgtatactaagataactgtgaaattgttatttgggcttgggttgcatgcaccaaactagtttgtgcatcaaattaaacgaatattttgcaagtttgtatactaggttgcaccttcctgttaaatttgtgtaccattagtataatttaattactctattttatatgtatggataatcttgccctctaagtaatttgtatgtatctatctatgtatatctatctatctacctacctacctatctatctatctatctatctatctatctatctatctatctatctatctatctatctatatctatattaattcaacactttctacaaatctatctatctatctatctacctacctatatatctatctatctatgtatatctatattaattcaacactttctacaagctctcgtgttaaccagataaatctggacattgaccaagtaaaccgtgttatcttagccgtagattattaattttcatttaataccgtggcctcatggcttgcaatacccatatatccaacctgtctccaacgtagtacgtattcaattttttcatacgtacatactattttggtgggaaatccgtttttacatttttttttaatttgttgtgacaccataagtattcccatgatagttttcggcactaacactggtagagaaaccatctttggtcggtcgacccatatccacaatagtcccggttccattaaaaaccgggactaaaaatgatttttagtcccggttaataagaggaagatctttagtcccggttgttgttaccaaccgggactaaaaa

SEQ ID NO: 36243 - DNA, 22550 bp, Oryza sativa
caaccgggactaaaaattgatttttagtcccggttatttgaaccgggactaaagatagcgatctttagtcccagattcgtagtcccggttggaaaaccgggactacagggggttacgaaccgggactaaaaagcatttctccaccagtgtaacttctgacatgcgctaactgcttcgtctgatttgagagattaattccaagaaactataaaatacactattatttggaaggtttaattgcacctattatttgcaatatgtaatttgatatttaattatcgtgtgttatgcccatcgtatataaccatgtcgctgcagtaacatgtaccatgtaatatccaaactgctggcaaatatcgaaagaatcttccaaacagggagcgcaagatgcatctcgagaggagtatgtatgctgatcacactcaaactttgtcaacgacaggacacttgggaactgctccaacgtccttcatctaacgctgttgtgacggatcggagattatggttcagatttatgattgtgacaaaactcactatatttccgcttggtcagaccccaaagatgcagattttctaagtagaaatgtgataaattgtgtgggacattatatatagtagaaatgtgataaattctgatccgctggtgtgattttgtaatcgtataatcaattcatctgatgattctccaatccgggccattggtctgatcttcataaattggagttgagctgccgacggctagttgtattttgatggacagttgctcgggtgctattttttcctaatataaagactctctggcttaacgtgctatttttctccatatttttttaccttcaactatttttctctatataagattgatttctgtacttgctaaacaagtgtataactcaattattatctaatacaagttttataattacttcatctaaaacctaaaattaggacttcaaaccgactataactcaatatttattaatgagtgcagtaaattcgagaattattaaatcatgaaaagctctatttgatgctccaaactaactacaacctgtcatttctaaaatttcaaatttctgaattaatttgaaataccacaaataatttaaacaaaaaattaatgttttgacttgggcacgactacacatcaatatgtactaattttcaatagtaaaattaaaactattttgtccttaataataacaacagtggtaaatgaattctatatgtataacatgtaattataagagagaatctatgctataccactgagtttgttggagttcaacgatttaccatcgactttgtctctttctataatatactggcgactttatcaattgttctacaatacgtcattggactggaccatcttttcaaaaatacccaaaatgcccttagagacatgcaagattaacaattgatttatctcattagaagtttaaaaaaaatatgaaatttttttatgtggcctccttacacaacatggaagtttgtgtacaagcttcaagttttttcagtatattatgtttttagaagaaaatattgttatgtggtatatgagagagaatttgcttatacaagacataatatagcacaaaaatatcttatgtagtgtatgaaagatgatttatattaaaaacaacaataaataagtattttatatatcatataacagataagttatattttttaaaaaaatagaaatgtaaaaaacttaaaacttctatacaaatttccatgttgtgtaaggaggcgatataaaagttttcatattttttctgaaagttcaaattagataaatcaattgttaaccgtatatgtccataagtgtattttgggtatttttgaaaagaaggtctagcccgatggcgtattgtagaacaattgatgaagttgctggtatattatagaaagcgacaatgtctatggcaaatcgttgaacttgaacaaactcggtagtatatatagaatatattatctcttattaataacgcaatattcaattgttacattttgtaatatcagtattgataacacgtgcaacgttaacatattgatttgcgactagtttacatattccttcggtaatacatatgttttattctttccacatgtaacgccatcaatagaagcaggctcaactaatggcacatcctcaatattaataatgttatggtggaatataacaaaatgaccatccaatagatagcattacttgtacttttccgttgctttggtgtcaccagatcactatgtgttactcatgccatatgtcaagttctcccttagtacgttgtcaagatactttatatagctatctacaactctacacatgattgtttgatgatactctttgtgcacaaaaaaaaaaaccttctcatgaagataaagaaaaacatcccccaaagtgatggatcttgcctgatgatacatgttatttgtataccaagcataaacaaaaagaatagaaatgttagccccagaagctatttcactacttttatcctttccagcaacgttacaattgtagatggttttattcttgccatatcttttgttgcctagacggtattaccttaatgtgatcttccttttgttttatgggccccacttcctttccaggccattccactttacatttgcatttcagtttctgaaagctaataccactagcatccagtctgctcatgtgtaagtatgcatgtgtacaaagcattgctctgccaaaaagtaggatttacctaatgtcatgggcttagtttgttagtgttgtttgaatgtatatttcttttaagtagtgtaaaggaatatatagagggttctaaggatagcacgcaaactattgatagacagcttaagcaaattcttttctctttttgctaagtagccaagtcatgcatagctagttagcaagatccacaccgttggtattgtgtagctattacaaaaattttgtaatatactactttggttgaagcaaaagattccttacattggtatagaaaacatttgtggaggcgtctgataaaccttttatataggtgtttccccaaccgcctgcaatcaatggcatgtgaaaatcagctatttacaagggtggaaagtcagccgcatgtggagaaaccttgatacaagtggtttacttaagataaccatgcatggaacatcttttcatgggcagctcacttaaaagaaccacccgtgcaaacacttttcaaggtggacgactcgccaaacctcatgcgaaaattgtttgtcatgggcagttcagttaagtgaaccacctttgtttttatttgaacagatgcagaaattatttatttctttattcatcagtacccagatgtttcattacacattgtattgactcatctcataattcatatcattatcccaccacatatatcaaacagagaaattggatgcaatcctctatttacaacacatcacaatccaatgacatgattatttacatcacaatgcaaccacattatcatgtttcaaaatcaaataacatcaatagtttgagtgtcatgcacataggtaggcatccctacctcccaacaataaagtgactcatgcgaggcaacgttggtctcatagtcaaaatatttatccctcttgttgcaaatcctatggtggatgaaccggcacatgtcattttgtatgacagcaatatgcctatcattgagtgctccactggttggatctacgggccgctgcaatgaaacaacaacaaaaagagctataacattacagtcacaatagagaacaatataatcaatagccattgttcaattaaaaatggttgcatacttgtcttggttcatcatgtacctcactccaacccaacaaactcacaaacatattgcccacaacgatcagtaccactaggttgcttgtggcatttcgtaaagtaatgcatgtaattcattatcatacttgttcctctgatcataaatattgaagaagaatagttagaaatgttgtcatatacttgtccgttatttcatttgggtgcaaggcacaacacatgatatttggtttggtgtatttggacccagcttgctcaatccatagaggggggctagttaggacatatttcatgcacaagaatggaaaataaattaaaatggactgaaagccccctcccaattggaaaaaatgtatcagtctgtataaaggctggctttttaaaaatgtgcaatgtttggagcagtcatcaacgcctatcaatttctctctctcctagatccattccccttccctcattcatcatctcttccatcacattgaaatgttgcgcacttaggccaaggccttttaaatccccaagtaagatcatgactcaactaggcctgttagaccagtctctttcatcaacactgtaccactcctttagactagctcatttacctgctatcattactttagattatgctctaccttgtttgaaatagacagctctttactaggccttgttgcggaactatttgctcatttttacgtaatgaatgccgtagcttcaaaaattcaatgatttgttgatgcatgctcactctttttatgtgggtagacctagtatgcacaatagtatttggtgtatgctacttccctatcatcattaaaaaaggttatcctatacttgttatgattggaatgcttaaatttatatatgttggtcccaacctatcttagtaaggcaggccgtatgtgaaaaattcttttcacaggctagcctactttacatagctgcctgagtaaatggtttattacatgcggttggaccggccgcgtgtgcaaatatccattttatagacgctcacaggcggtcttgttggccaacatgtgaaaaccaccttttgctgcctatggaaatggaatatgtagtagtgactaagctctacaattcatgagcccaatattcaaatgcatagaagcccaacaatcaattgccacaaactgtcttcatcaaaatttatagcgtcacagctcttgcatccatgtaggacaacctgtcatctttttagaaccccttgttgccgtagtccaccaatataatgctgaacttcatgccctacctctaagacaacaatatgagaagattgcacataccagctatatcttcaaaataacattttacatattacaccgttatttttcacctcatgataagcatgagagagggaatatgtggacatgatctaagtcattaataacgacccaccattaaagtttgagaatgcaaatctcagtttaatttgaaatgaaaattcagccatgagtggcatgtattaatagtattgaattttttgtatcactttcctcaatttgacgttggtgtccactaattttaggagtacacacatgtttgtgttcaatgggttcaattaactctcatcattcattcttgtaaaattgaatgtctagaaaatctaacattcaatggattatccgtaaagttgtgtcaggatcctgatacatgggtgtctgataatccctccattgtgctccagcagatgccatgctcatatggtaagtcttaattttctagtttaagtacctaaccattaatttccatattctaaatgttcatatagttgtgtcaaattactaacatttgtaatgatggcctaacttaatctgtcatatttttagtggatttccaaaggtgttctaggaagtcgtgtcaaattactgacattgcaacaatgatggatcaacttaattagattatattatatttttttatggattctaaaaggtgttctctagcaagtatagccacatgccatatttaaaaataaaatactactttcgtttatatttttaaaacttaattatctgtcttatttaaagtttatttccccagattatttaatctgcagtgcttttctcatacagtttgaaattaattaaggtacttatggctaaaatccgaaactctgcgcacaatcaatcatgtgataattccttgtttgtaaagtttgtgcatatagatgcatgttgtgttcataaaaactatatatagacttacttcataaatctatctacgatgaattttaaggagatcatgtctacagttaaattgacaatgttatatataggacggcgctatgtagcgctagaagctacatagcgtgactcaggataattcccacgaccggttttccctcgttcccccttcattcctggccccatggctcgtctcagtaaaaaaaatattcccacaattgttttttcagttccaatagtggaccgtgtttttatccagacactcgtggtgtgactcctcccttacagagatgtgagattgacgagtgggcttaacctttagaatgttaattaagaagttaatgaaataaattaaaagtgagagatatacttaacacgttaacagggcccatccattacagaaacctaattaaaatctttaacgaatatttttctctccatttcatgaaagcagttggcccatgggaaaacttgtctttaataaacattatatctccatttctttcttatataataaatatgccacaagtgaccagcaaccaattatcaattttttgcagcacactccagcagaaatgcattcttgcagtaccctccaacaaggagcacaaacattaggtgtcttatagcaaaatttgcctttagatgtaatgtgggaatttctagtttttctgattaatgagagaatttatatcttgtttatgttttagattaatatgtatggattctagtagacctttccatctgtatatataaagatgcagcccaagttttacagttctgtcaaaaagatctatactactggaccattttttatggtgtgatctctatagtacctaaccttaaccaaatgaatgcttactatagggtgaaaagattagattggtacacaatatgtataatatgtctgtagccttttttacccaatacaaattttcaacaataactatatatgacaattagtgcaaggtaagaataataacaaaataaaatattactaatgaaaatggtaagaataaaaaaagagactaggacaaactgttgcaaattttctatcaatattacgaaatattattatcttaatacccaaaaaacattaaatagataaactttaatttagggacaacaatgcaaaaattagaaggaaaattcctttttttttcatgtctacccctccatgttaggattcttcacaacacaaaccttgtggtcccaccccaattaaactcatattctccaacacaagccccctatctttttactaggaaacaaaccccaaaaagctatctaacaatccaaataaggacacaaataaacatgcttgcaagcaacattcacacacctttaatttcagcctcaataagcatccacagttttcctagtcagcatggttgttcacatctggtcatagttatctctagcccccataaaagaccaaataggaagtgaggtagagtgaaattaaccggttgtatgagcttccaagaatggaaaagcacagaactgaacaaaacatggcattgggattctcatcccatcaacacaaacctcaatgctatctcaccagccatatcttggagatagagggagtgtgtgagggccagaaacttgcaaagggagaaagtgaggttgaatctccgtcacgtcactcacagttgcccatccatctgataaaggggtgtcccctgggctctataaatattgtccctctttgcctccatcaacatcactgcagtgcctttgagctttcgttctctagagtgtctagggtgaatcttgagcgagtgagcgagcgatctctgtgttgtgtagtttgtgagctagggtgatggctaacaccggacttagcatccccatggtgaatggtgccacaatccacctcctccctggtttccggttccgtccaactgacgatgagctagtcatcaaatacctctacccccgtgcttttcatgtgccactgccctgtgcgatcatcaccgatgttgacatccatcatcacaacccctgggacatcgtcccaggttaattttgatatgcacttctttgcttctatgaaaattattaccacatccgtctgcatatatctctgatttgactgattaattgcatgtgtgtcctgacgatatttattctcttgttttgtttatcatttttttcgtttgttcgttggcaacgatctgatgatgaagtggcggagagggagaaagggaagcacttcttcacaagaaaggaggtcaagtaccctggtagccgccgtagcaaccgtgttgctggtaatggcttctggagagcagcaggctcggaggtgcccatctattacaaaccagaaggtgctgctaacgacatgctagttgggatgaggcggactctagtgttccactacggaaagtcacgatctgcagagcgcactgaatgggccatgcatgagtttcagcttgctggtgctggtctccttcctcaccctatgatgaggcatgcaaccagcaatggttcagagccaccctgtggctgccttgaagcgacaatcgctaaggtgagatgctacgtccaaaaattttactgttccatttatcatgattccatctaaatgcctgttgaattaaattgctcaattatttggataggttggattatgagttttagctttagggaatggggaaaatatgatgacttagtatacgtgatgatatactataactcttgtgttgatttattaaataagggaagggtagttgttttcgatcttaggactaagggtacgtgacgcttgatatagggttcatttattgttgccatgcaagatgcgcgggatctagaagtgattcaaattttgtcgtgacaaggaatctagaggtggtgggcctgctgatttgaatttgtcatagcctcacatggttttccttatgtattactaggatgtaatgatgattaattgattttgccgtgaagcgagatctagcggttacaagatctactagtgattcaaatatattgagaaaaaaaggggtttgctgtctacttgcattttcagtagggaacctctttattgaacaccacgtgtcatgatacacttgatactgggatatttggatttgtacatctggttttaatttgatcattgccacaagatttatataagtgacatgtcaacagtttacttctcaaattagttgcaacattcaaactggacatgaagttatcacacatctttctaattcagtccccatatgatttgtcacagtaagaggcttataaactagtttactataatggtcaattcatctattctctttgttgtatatgttgtatataccatggttgcaccttaagtagatccactaacagacaaaatggtgtctattttacagaaaagtgatggtctctctgcaactcttcgtgccaagcgtgattctgcccctcttatgagaatcatggtagaacccgatagctcatgggtgatctgctgcatctacaagaagaggcagcgtgccccgcctgttgttatccctcctgtcattggcgatgtaggggaagctatcatccctcatgctattggcgatgcaagggaaggccaacttcacttcattgacttcctggggcagccagctcgcaatgatccatcctcgccccatagctgcaccattgacccctcctctttggaggaagggagtgatgagtctgccggtgatggtgaagataaggatggtgatggcatgaatgaagcaaattgatcgagtgtgaaggaagtgaactgagtctcaagaataaaaactgcaagtatggcgctccattccatggaagacctgcatgcatcctatatatgtgcttttatgttcaagttggagaactatgtgtgttgtctttaagttggagtactctaagctattcgatctggagattatgctgtttttaataaaagtttgaagtgtatctgtcctgtttaattagtttcaagaaagccaagcgtgtttgggttctaggatgaacaaagtcgtccaagatgcaagaagttctagagaggtagctacatttctggaaattgttgcatcttcctttcttcaatatatatatattgtcctatttcataatgtcattctagccagctatctatattctatatatccatttccgttgccatactttattcactatgttgcatcgagtgagctgcattgctctgtactacatgttacttgatatgtgttgttcataaacacacacattaataatgatcagattgtgaaaaatcaattctacggtccttgaggaggtaccatgagataccaaaaatttagtgtaaaatttggtatctcatggtacctcatagtatctatgtaccaagaggtaccaaatttacaatagaaaaagtggtacctcatggtacctccttaaggaccgtaaaattgctcattgtgaaatgcatgtccagaattcacttaccaagtgttcggaaacaaattcacttaccacgtatctgggcttgaggtgatagttggacatgggaggtaacagagttgtcatccatatcatgtatttatttatagtgaagcaagcattgattcatgctgtgcaaattagtcgcagtgagagcattttctatatattttgtggcctatgtgaattaggagtaatatatattaagttggaacacctatgtgttataccgaatttgaatgatatatcaatatagatgaacgaataataataaaaattaatgacaagtgtgaattttgtggcatagcttcagcgttaagtccctaaatttagaggtaagttagtgtactagtaccgtcacttcttaaggtgctccaagtttttctctgaccgtacattagactaaggtccaactgtggacacagtctcttacattccaaaagtaataaggacagggataatattcattattaggaacacaattaataaggtaagtggagtaatttataaaatgatattaaatatttatgctgtactaatttacaaatacaccatggtaattatatgtttaccctgaatgcaaatttttaatggcatttcaatcacgatcaaatggaaaatgcaaaatttcaaatctgatatgagaatacaaaaatatatagacattgcgaaaaactaatgtgcaactcttaatttaaatatagagtgaaaagtttgcgatgtgctgctgtttgaaatatatttacgtgtgatttcacacattaaatttaagcattaatgggcatccagatcttcatatcaatatagataggctaccaaagttatagtccttaatttcctgcgtgcatgattaaggttgggaagggtaaataataggtgctaatatttccttattctgttgtgatatatcaattgaaaggagcaaatatttttttattggaaaatgtatacaataaccaagtgctagaccaattgtaagttggagtacggtaaaactgctctgaacccaatggttggtggcttggtgcagctagtggtggtagcagaggttaaatgcttggaaaggttgatgatggcttggttgaagatggagttggccgctgatctaggtgaacagcacagcagtgaccaaccctagacgagggaaagatggatgttcgtcgggcactaggtgaggtttggagaggcggtgatagcggcaccagccaggctgagtaaggatgcgacacatttatgacagccccactaggaggagaggtgccggcaaagctggttgatcaatttgatgaagctgcacacatgcacttttgaaggagaggtagggccttaggggtgcctacatgcgcagttggatcttgacgtcactagaccaccggcttccactagccgcttcacggtgcacaaaccatgttgcctagcaccctgccaccacacacatggtctggagcactgcaattgttggtacctggcggctactgcttgaaacccaaggtcacactatccagtgcatgcactcacatccgcttccctctgccacctaggcatactttacagtcaacgccctactaggctcaccaccacgcatctccttaatataatgtggaacaatggaaaagatgaataaactaacatacattgtttgaggacatggatgccgccgtctccttctctgcttcttttggtgccgttgtagatgtgcatgtcctgaatgtgagtatacctacttgataccataggtgaaactggcgataaacgagcggatgatgccataggtgccactcgcactgccctagaaccacactatgggtcctctctagcatttgcttaggatcagtggtggtatggtttatgaaggagtttgaggaagtggagagttcttcgcctgtccacaggctgagctctccttattttattgcactcatagacttgggggtgatcccaatcaggacattatgctgctcccgatcatggtgaaccaacaagcatgacagaaaaggatggacaatgcgccccttgtgacttggtcttggttgttaatcaagaggatcaaccaacaagaaaaacaatatcctacataacataggcatggcatcaaggagacagcaaccctggccccatcgatcttcgcgatggccacagcatgctgtggaggaagcaccgggaaggagggagagcaaggaggtggtgctcgattaaaggttaaaaaggatggaggagagtgacagatctagtcagttagggcttctataagtttttatactcctcagtttataggtatatatatgtatatgtatttttccttcttagtgaaatgaagtgcaactctcatgcgttttctaaaaagataattacagttataggcttgattatttaaaattgtggatggttattttcaatcacatggggggacaagtgctaaaacggtgtcactagtatacggatcactgccctgagcgccgatggcaataaataaattgtagaagcaacaattaagtaagtatcaaatagttaactgcatatctttgggtggcaaataattaattttatagttaatccacgcagagatatggtccactcattattcacaacaattaattttgttactttctgtcatctttgtgatggatttagaactcatcatacatgcattactggtaatttggaaagatctatttgaaaattttgatggttcaaagaatatatgcataaacttagccttagccttgcagcggccggctccaactttacgtagatggtgctctcatatagctcaaaataaaattgggaatacagaaaggcatagtctagcttttgaactcacattttcctgcaccccctatctttattctagaaacttaataaggccaaaataaaaaaaagcttgccagttgccaacaaggttcacacacttttaatcccagccttagtaggcgcccatagttttcctagtcagcactattgtgctcatctcattgctgttatcttctcccaaataaacacaaaaaagaaagcgagagagagagagcttctcaaaaggaattgaaaagcacaaaacaacagaatatataactgacattgggattctcaccccctcatcaaccctggccatctttatttcttcctctttttggactttgtgtgttactgcatggattcatgtgttgcaacaccctggatgctatctcaccatctgcagcctggagatagagaaagaggaagtgatcgtagagttgagtctctgtcacaacattcacagttgcacatacaggtggcaataatcatgagttggaaacacccctcttgggtaaataaataagagctcctccctccctccaccttcatcacaatagcatcattcaatctttaattcatttgagagttgagagtgagcggaatatatttgtattctacgattgaggagaatggccagccctggagtttgcatcaacttggtgaatggtacatcgacgcgcctccccaccaatgctgatctagtagtccactacctgcaccgtcgcgccattcaggaaccggtgccctgtgacttcatcaccaacgtcgacattctccagcacaacccctgggacatcgtccctggtaaatatttttttgacccacacaggcttactcccattagatatattaatccaaaactttgccagcttcttcagttaatttgatcaatctgtagtataacctcaatagatagtttgcagttgttttgatagttaatttattgtctgctgggttgatgatgatggagcagcggaggagaagacaaatgggaagtacttcttcatccatgaggagaacgaacgccttggcaaccaccacagcaaccgtgctgctggtgatgggttctggaggccagtaggctcagaggtgccgatatatcacaaacgtagtggtggcgctgatgaagcactggtggggatgaagcgcaccttggtattccactacgggaattcttcgtccgcaaagcgcaccgaatgggtgatgcaggagttccgacttgctggtgctacccttataccttgccctgtgacgaggccagccaccggtgatggctccatgcttccctgccaccgcacaggaacgaccatcgccacggtaagacactacacatccgaacatcaccgtgcctatatattggatataacatagaatcgatctacttttataatctaattggttaagtatttacatgcaagcatagaactgtgtcattcaacttggggaatatggacatgatgaattacaaacttataattataagaacaatatttttctatgttgacgttgatggtgcaacaaggtctaggatggacctagctagtggtgattcaaattttgttatgatgtcagacctacaggtgctggaaccaaaaggtgatttgactttttggatagcgattctatatatttcagtaagatctaattacaataaataagatttttccatgaatcaagatctaataattaaaggaccaataagagattcaattttgccgatgtgcagaaaggggtacgttgtcggcttgcacttttatcagtgaaactctttattaaacattacgtggttatcctagtagtcccaggatgtgtagagatctaactgtcatgggatctataagatattcaattttgtcaagacgcgagaagtgttatgtcgtcgccgtgtgttttcattagtgaaactctttttttaacaccacaagtggctatcccctttgtcccgggttgtttagagacataacagttatgggatcaataagatacttgactttatcgagatgcaaaaagaggtatgcagccggcttgcgcttttataagtgaaactctttgttgagctccatgcatgatcattatccccttagtgtcgggaagggatgttcagatcatgttttgatcctggtctgtaccttttcatggaaagtgacatctctacagtttattggtgaaaccggatggtagattgatgacactcctttgcccatatatggaagaaaattggacatagaagataccaattccttctaattcagtcactagatgattagcacaaatctggaatacaactatgtctttgctattaatagatttcatctatctctctttgttgtacatgctatatataccatggttcctccttaagcagcatctagtaacatattatatgtcgaccgttttgcaggaaaacaatggaagtccatcagctggacaaactcatggcccacttgagaaaaccatggtcgaacctgatagttctttgcggatatgtcgcatctacaagaagaggcaacgaacaccacagttcatcatccctccatccattggcgatgcaagggaactcatcctcgcccttcctacaattggcaatacaagggaagtcgccctcgcccttcctgccattgacttcctggggcagccatctttcgaggaagggagtgatgtgtctgccgatgtcatcacggatgacaaggatggttatggccatggcatgaactaaataaaggaagccactcagctgtgtccagtaaaaattgcaagcggagtgtttcctcggtgcgagaaagacctatgacctgtttatgtgttttaatttgaagttcatgcttgatactatgtattctatttaattaagtcggagtactctatgctgttcaaactggagtctatgtttttctgtttaagttgtagacaatatatcatttaattagtttggggaaagtaaagtgtgcctatgttctagcttctaggatgagacgcattcgccccagattcaagatcaatgggaggtagttacctggtagaggtaactgttgtaactgcccttcttcaatatattgtgcttttgtgtttttttcttccatgggcatagcttgttcactctgctgcatgtgatcgattcacatatgcgtgtggtatacgtgtgtcgacaagtcacatagcacatgtttgggctcgaattgattgttggacatgggatgttattacagagttaccgtctgaatcacatgtagtgatataatagatatagttaatcttgggcaaatcattcgcggtgagaggattattacatcttttgtgtctgagctgctgctgtattattaatattactgattacactcggagtatgggttacatgtagagaatgagatgacgatatatatggagatggatacaaaaaataattgataacaaaagttaattttttgtatgcctaggcctagcatattttttgtgtatgcgtaggccacagttttgaactacttcttgaatggcgtcgatcttttacatggagaaaaaggataaaagtggatggacgaaactaccagtgtggccctcaatgggaagggaggaggaccatgtttgtgcgctgtcccgcacacagatgaactcatgtcagccactgttcccaagccctctcattctacatctcatgcactcaaatcagccacctttgctgacttccctcatactatggtggctacaggggaggaatgtgagtttataatcaatgttatgtaggattgcacaagaccaaacaaacctactggaggggggtgaatggtagagaaaaccaaaaacccaaaatcttttgcgggataaaagatttacctcaaatggagtagatgacaaagacctgtcgccgctagtcgaaccgccctcctgccatcaatcagaccaccgaagcctcgccggtcagaccacccaatcacctgcggttagaacaccgctatcggttagaacgcgtacatctgtggttagaccatcaagacctagaaacaccggtagatgacatactcgaagatgtacattgaaactttcgactttattgcatcaactagtgtttacaaagtgcaccaacagcacccctcaccaaaatctcgaactaaactcgaaaccttaactttctctcaactcgagtctctctaaaaccaataccgggaggcctcaccctccctctctatttatacatgagttagactgtgcaaagcccacgaatctaacataacttaagatgcctaacccatgtaggaaaccttctcttgcaagtatccaacttatccctttccttatctcaatcaatctttccgaaattcggactcccttccaaattcgactcctctttccatacgattacaatccctcttgtataccatatggattcttcatcgccacgtgcattgctctctagccttttagtgtcccgcatgatctcttgatccatggacatcaacttctcctaagtcgactccgatctatcaccggcaatactctcccgaggcctcaagcaacacctgcacatgcaacaacgaagaaaccatattccaagcacaagttcgtccctacttgactcacattagtataacaacagtatccatacgcatagaaaccatctagaagccaaatccccaagggaacatctaattcaacaggacaacccgaaaccgaacacgataagaatcctgccggtcagaccatcaggtcggatggtctgaccgctgcaacacctgcagtctggccggcggcacccggctggtctgaccgccagggtcaaccaaaaaccttcacttcacaaaatcaaccgtctacaaaatctccaaaataacatcagcaaaccaccaaaattttcaccgcaaaatctaaatcaactcattggttttacatgttataaagatgtgcttagcctaacatcatcaccttaatataatgtgaaagagaagattaaactgactaacattgtttaaatctatggatgcgacctccttctccttctctgcttcttttggtgtcgatgtagatatatgagtcatgagtatgagatttcttgcttgatcccctaggcaatgctagcgatcgacaagtgggtgatggtttcactctgagtgccactttcagtgccctagaactgcactacaagcctcatccagcattagctaaggaacgatgatattaggctttatcaaggaattaggggaagtggagaggtcttcacttgaccacaaggcgggctcctgttgtttttatatcgctgacgaactcaggggtaatcccaatcaggacgttaggatgcctctgatcacaactagttaacattcgtgagtggaacaaggtggatcatgccccctgtataccttggtctcagttgctatccaagatgatcaaccaccatggaaaacaaggacctacttaacatatggaaatcggcatggcatcgacgatactacatctctggcaccatcaatcatcaccattggcatagcatggtgtagaggaagcactaataaggagcaccacaacaaaaaatacttcgtagagacatttttctaacactagaggcagttttaaaatgcctctagaatcctgtagaggaattttgagaatatcttcaacacacttaccatctccacctcatgtcatttgagaaataagtcaatttatcaagatgaggcattttgattcagatcatttgatttacgttttgaaaactttcaaaccttaccagagaggggccacttatgctggacgttggcttcaagaaatctcctttagcattacttcaacccgggctttgaccatgtctcccgaacaatttcagtacatattgtgcaagacgattcttgcattaaatcaaaatttgaaaaagtgcctctacagaggttaaaacgccataacaaaattcctttacatatgaggcaaatattaaagtgcagaaaagatgcctctacaacattaatttaacaaaatatgctaaaagtgcctctaaaaagtatctttatactatagaactcttggtttaagtggcaaaataaaaactgtctccacaaaagtgcctctacgtaatgattttgctctagtgagaaggaggagcggtgctcggagggaggaatggaagagagtggcagattttggcagtttgggcttctaactttttattatattcctctatttataggtactagtcaggttcctgtggttcgcaatggattagtatgggttattcactattttatgggtcctgtaattcggaatggttggaatgggatcaaagtaacaattttttgaaccaatcgcttgatatcttttacatgggagaagggggttaattagttacatttaaggagtagagataggctttaacatttaagattgtggttagttattttcattctcggtggggatcaaaaagttgataaaatagctcgcacgagggagggtataccctgatcacctctgacaataaatagtagaagaaataattaattaacatatgttgagttcaaaacagttaatcacatatgtttgggtggcaaataattaattttatttttaattcaataggaagatattttgttcactacaattaaattcattacctcttgctatctttatgatgaaattggagctcttcataaaatttctaactgtttttggaaaataagatgtatttgaaaataagatgattgaaagaaaacatgtataacataaacatagactttagctgccactacacctatgttacgtatagatggtgcgctcatgtagcaccaaaaaaaaatttaggaattcagtgaggcaaggactggattttaaactcacattttccagcagccaccccccccacccccaatctttaatgctgcaaattaacaagcctaaaaaaactgtatcaactatcccaataaggccacaaattaaaaggcttgccaacaaggttcacacacatttaatatcatccttataggcacacacagttctcctagatcagcactattgtgttcttctcatcactgttatattgtccataataacactccaagaaggagatagagtagtccacctcaccagttgaaaaacacaaaaaacaaatcagaagatataactgacgttgggatcctcattcctccatcaaccccagccatctttaccttcttcctcttggattttgtgtgttactgcatggatgcatgccttgcaacaccctggatgctatctgacccatctgcagcctggcgatagagagacaaaaaacagtgaagtggagtccccctcacggcactctcagttgcccatacaggtggcaatatggtgagttggcaaacaaccctcttggttctataaatacagctcctcccagcctccatctccatccccacgggaccattcaatcttacattcgttttagtgagtctagcgagagcaagcgagcgtgcgagcgaaatctgtttgtaggttgcaagctaggacgatggctggtcctggagtttgcatcaacttgctgaacggtaccacgatgcacctctccgttgggtgtgtgttccgccccaccgagggtgagcttgttgtcaactacctgtaccgccgtgccatgcaggagccgctgccttgcgacttcatcaccgatgtggacatccagtgccacaacccttgggaaatcgttcccggtaaatatattttgactcgcactgtgtcactcccaaatctttggcagcatctttgattagtttcatcaatcagtagtatctcctcagctagatcgtttgtagggattttgacagttaatttcttgtatgattatgtttgagtgtcaacttttctattgttatgttggtgatgctggagcagcaggggagaagaagaatgggaagcacttcttcacccgcaaggagaacagccaccctagggactatgaaagcaaccatgccgctggtgatgggttctggagattggcaggcacagaggtcccaatatacaacaaacccagcggtggtgccgatgaaaaactagtggggatgaaacgcaccctggtgttccactttaggaagtcttcatccacagagcgcaccggatgggtgatgccgacttgccggtgccagccttgtgccttgccttgtgatgaggccggccaccggtgatgtctccatgcctccctgtggttgcaccgaaacaaccaccaccaaggtgagacgctgcatccaaacatcactatgtcattgtattggatatgatatagattccccctcaaaaaaaaaaggatatgatatagatttgtttctgtatttttaatatgattggtaaattatttgtataaaaccgtaggactgtgaggttcaagttggggaatagggaaacatgaggaattactatcttataattatatagagtatttgtgcatgtcgccattgaggggtgccaataggtttgggttgattgattgatgccatgcaaggtgcgtgggatctagtggtgattcaaatttttgtatatagtgatctatgagatggtggaatctagggttgatttcaatttttcgcatagtgattctatataattcaatctagtaggatgtgtcacccagcaaggtctaatggtttcacttacagaatccataagagattctaatttgtcgagatgcaaaaaagggtatgttgtcggcttgcatttttattagtgaaactcattattgaacaccatgtgtttttatccccttagtcctgagacgtttggagatctaacaagtacggattctattgaatgttcaaatttgtcgggatgcaaaaagggctatgttgtcagtttgtgtttttattaatgaaattctttgctgaacactatgcatgcttgtccccttagtctcggtaagggatgtttagatcatgatttgatcttgtactcctggtcgctacttttccttaaaaaagtggcatcactacagttattggtgaatcgaatgggggtgacactcctttgcccatattaggtactccctccatttcaagttataagatgttttgactttggtcaaagtcaaactattacaagtttgactaagtttttaaaaaatatagtaatatttataataccaaattagtttcattaaatcaataattgaatatattttcataataaatttgtcttgggttgaaaatgtttttttttcaaacttagtcaaacttaaagcaagttaattttgaccaaagtcaaaacatcttatgacctgaaacggagggagtagaaaattggacatagagaagttaccaaattcttctaattcagtcagtacatgagtagcacaaaactggcatgca

SEQ ID NO: 36244 - DNA, 4100 bp, Oryza sativa
tgttgacagatggcacgtcattgatgcccaaatctgtagaagtgagactcatggagagacataggtgtgccgtcgaggagacaacagtagtatggcctagtagctcatcaacatggccaacacaaggaacaaggaataagagggagtcagtggtcaatatgggttcaagaggaacagaagagagtgacatacttgagcagttttctaactttttatacatctctatttatagctgcacgagtagcataactgtacaagggaggagagcactaaatagtagaagcgatatttaattaatatctattgagtataaaatagttaaccacatatcaaaggggaagttctcatggatcccatgttcgcaaaaattaaatttgttacttgctatcaccttgtgatggaattggagctcaacatacatgtataactagtcatttggaaataaaatgtattcaaagattaaaacgatgcaaacaaaaacatgcgtaacatcaacttagactttgtgtggcccggctcctatggtatgtaaactaacattttccaacataagctccatatctttaaaccagaaaattaacaagccccaaaaagctctactaaccatccaaataaggacaaaaattaatatgcttgcaaacaaggtttaccagccagcgcctttaattccagccttaataggcacccacagttttcctagtcagcagtattgtgcagaactccactttgttatcatctccccaacagcacaccaaaccagaagcgagagagattggaactctcaccaattgtatgttctcccaaggaatggaaaagaagaaaaaatcggaacaaaacagacactggaatccccatcccttcatcacaaaccacatctttctagttattcctcttttggattttctgtattactacatccatccaagagatgcaaatccctgaattctagctcgccatctgcagctcggagggtgtttagcatgcagagaaagggaatgaaattgaatatatctccttcacggtactcatagcggcccatacagatgcaattaactagtgagttggcgacaccccctctatagcttggttttataaatgcagctcctctcatcctccatctccatcaccacagggcttccgctcactagagtgagcgagcgagtgaaatctgtttgtagcttgcgagctaggacaatggccggtcctcaggtatgcatcaactaagtgagcagtacgagtattcaccatcccactaggtgtgtgttccaacccactacggtgagcttgtcatcaactacctttaccaatgcgccattcagatgtctctgccctatgacttcatcactgacatcgacatccttcaccataatcccttggacattgtcccaagtgaatatattttgacttgtgttgcctttgttgtcccattgaaattattaagccaaatctttgcaatctttggtttaatttcatcaatctatagcctcacctatgatatattaggtgttttgacggttaatttcttgtctaattctgtgtgtgtcatattttccttatgttgggtttggtgatggagcacggcaggagaagaagaacgggaagcacttcttcacccgtaaggagaaaaagcaccatggcgacaactgtaggaaccatgccgccggcgttgggttttggaggttagcaagcacagaggcactggtatacaagaattcggtgatggctctgataaagtgatagtgggtatgaagcacaccctggtgttccactacaggaagtcttcatttgccgagagcatggaatgggcaatgcaagagttccaactagctggttcctacctcttgccttgctttgtgatgcggtttgccaccagtgatggcacagaacaaccttttggctgcactagagtgaccattgccaacatgagacactgcatcctaacaccatattgttgttttattggataatattgatttgatttgcatattgaatatgttcatattatttaagcaatcataggtttgtaggttcaacttgaggataagaaatatgatgaattattatcttataattataagaagagtattagtatatgcttccattgtcatgttccactagtatggcttgcatgattgattgatggcatgcaattcggatagaatcttagacgttggatctagaggtggtagaatcttgaggtgatttggcttattctgatagtgattccatgtgttttactgagatctaattacaatgaaggatctcattagtattgtcgcgaagtgatctaactgttgtgacatctataagagatttgcatttgtcgaaatgcagaaagggtgggtggtcggcttgcgtttttatcatggaaactctttattgaacaccacatgtgattatccccttattcccaagatgtttggagatctaatagttatgggacctataatatattcgagaatgtcaatatggaaaggggtatgttgttggtgtgcatttatatccgtgaaactcattgttaagcaccatgtgtggttatccccttataaccgggatgcttggtgatctaacatttatgtgatgtataagatatttgtcgagatgcaaacaggggtatgttgtcggcatgcgattttattagtgaaactccccttagtctcgggaagggatgtttgaatcatagtttgatcctggtcactacctttttcatgaaaggttatctctataatttattggtcaaaccgactaggggacgatactcccttgcccatatcaggaagataattggacatacagaccataccaaatccatctaactcagtcactaggtcataagcattaaactggcctggaactatttcttgactactattgcacttcatctatctctccctgtgttgtatatgttatatataccatggttgcaccttaagcagcatcaactaacagactgttttgcagaaaaatgatggttgaaactaataattattgggtgatctgtccgatctacaagaagaggcagtgtttgctgcattccatcatgcctcatccattggtaatggaagggaagtggtcctcattgttcctgccattggcaatgcatgcttgcctaatagctagacaatttccccttctttcgaggagggtagcagagagtctgtcaatgtaacggacaatgtcaaggatggtggtggccattgcagtatctaatcaaaggaagcgactcaggtgagacaagaataaagtgttggtatgtgggtgcccccttggccattgcaagtaaggcttgagagctatttatgtgtttttactttttaagttcatgcttgagactatgcagtctgtttaagttggtactcaatgctgttcagctgatgttttgttgaagttggagtctacatatatactgcttaattagtttcagaaaagttattaagtgtgcatatgtgttttgagatgaaacatattcgccctagatgaaaactagaagtgaaagggaggtatgtagctatctttctggtaaagataaatgttgttaatccccatccccccccctcccctcctccctctttcccttcttcaataaattttgcttcttatgatgtgatacaccatctctctaaatgatgtatatgcttatttatttccactgtcataactcttgttcgctctattgcattactttgtatgtgattgatgctgctgataaccagactattttgttgatcacataagtgacatgtatgtcaacaagtcacttaaccaaatcttggcttaagtgattgttggacatgggatattattatatatttaccatccgtatatcatatctctagtgaaatatagatgtagttgatctcgagcgaaatcatcggcatgcagtgagagaattatttcattattcgtggttgagatgtgctgcacaattattaatattactcagttataacattaggagtatgtgttatgtatagacaatgagatactatcatatttagagtgagtactgagttggcaatgcttgcattctggacatgttttcatggagaaaaaaaatacagataagaggaagaatctgctgccatgtgtacgtatgcaaa

SEQ ID NO: 36245 - DNA, 2455 bp, Oryza sativa
  unsure (1)..(2455): unsure at all n locations
nnnnnnnnnnnnnnnnnnnnnnnnnnnnnnnnnnnnnnnnnnnnnnnnnnnnagaaaaaaaatacagataagaggaagaatctgctgccatgtgtacgtatgcaaaaaggtctagcagattaattttatcaaattttgccatgttagaagtacaaaattagtacaaaagatatatatagcatggctatgcagattcaaactgagatcatatagatttccccccagtactgttgttgtaaaacatcttcatattatagcacatgaacataaaaacacctatatatgtatatattgctcactgttaatgagggaaagtttactatttgccaaccaataaatgcattaataattatttgctactacatgcacagatatggctgctgattatttggcatctagctgatcactactcccagtaaaatgacaatttaaccaaactatctgcacattacccaccccactacctaatcatgctaaccttaacttttcgcacagaaaatcgactcctttccccactaactagttgctcttgtctggcaagaagaaaggatttgcagagtggtgcttaacccttcctgtgtctgctccacatcaaatttttttctaattttatgagtatagctagtgctgcgaaaaactatatgcaaccaaagctattttacttttatatcataccatgattaaattcatgttgtgcttttggccatgactagatgtggatagcatttatcgttgcgtattgcattgcctttaaacttggcctaggggttggcgaaatcctaggtttcctgcagtgacagaatccctgtcattgtaaaaatcccagcacacatacatccctactgacatcttgtgcaaggaaatgtatcttaatctcctgcacaagaccactgtgacatgtgtaggggtaaagtcgacatgaattacggtgtcccgtgattatcagtgggtaaagtttggagaaaattatatacaaaaaatgtttcattaggggcacctatggtggcgtgaagctagctttaaactcgatcacatttccagcacaaggccccccaacgtgtgactagcaaacaagaaaaggaaaagtcttaccaaccatccaaatgataatttaattacaagcttgcaaacaaggctcattcaccctttaattccagccttaataggcgcccacagttttcctaatgattactcttgtgcatgtctcgtcactgctgtctcctcccccacaaagcaacaaacaggaagtgaggtagagtgagattaaccggttgggtgaactctcaagggatggaaaagcacaaaaaatcagaagagaaactgacattggggtcatcatctatcccctccccatctcaaattcttcttcttttgggctttgtgtgttagtgcatgcatgcactcatacacaatggacgatagctctatagctgttgcttggagatatatgatagagttgtgtcggagtaagagacaaggattgatacggcacccacagctgcccatccaagtgtcagtgatgagttggagatgcccccctagctgggtgctataaatacagccctttcttggcatccatctccatcaccacagaggctttgagtattcattcatttgagtgaccctatagtgtaactcgagcgagtgagcgagtgatatttgtgtgtaggctgtagctagcgagctaggacgatatggccagggttgtactttccactcccatagtgaatggtgcaacgatgcacctccccgctgtgggcatgtcacaccccaccgagggtgagcttgtcttccactacctctatcgtcgtgccgttaacatgccgctgccctctgaattcatttgtgatgtcaacgttcttcctcataacccatgggacatcgtcccaggtaagtatattttgacttatgctgccatatcatcttgctcccataaaaattgttagcacatccagatacatctcgaattgattaatctatgtctaccaggcttgattgattgcatggcctaatgtccgatttgttgttggttttgtttttgtctttttctctctcttgttccatgatggtgatcatggacataggagcactgacatagagggagaaagggaagtacttctttatgcagaaggagataaagtgccctagtagtcgccgtagcaaccgtatcacaagtaaagggttctggaggtcggcaggctcagaaaagccagtctactacaaccagggaggtggcagcgactgcatgctggtgggaatgaggcgcaccctaacattttactttgggaattcacggaccgcagagcgcacaaaatggggtatgcaagaatttcgccttgctggcaatggtctttcgccttaccctgcgatgaagcatgccaccggggatggctcaaaannnnnnnnnnnnnnnnnnnnnnnnnnnnnnnnnnnnnnnnnnnnnnnnnnnnnnnnn

SEQ ID NO: 36246 - DNA, 5099 bp, Oryza sativa
ttcgtttcatctgcaaattgaatctaataagtttgttattttcgagcaagtgtactattgtgaggtttagctttgggaaatagggagggggatttaataaatatgatgagccgtcttctagatataactctcatgtcgattttattcatggaaaggaaaaggtagagattgtctttgatgccgcttagggtacatgctattagatctgtagttatggactgctgcgatgcaaggaacgtgggatctatacatgattcaaattttgtcgagacgtagggatttatagttggtaaaatctagatatgtatatgtgtcagtggggagttccatgcatatgtgtcagtgggatcgagtcgatgtattataaattttgtcataaggttagatctggttacgagatctataatcgacttgaatttgacaagaagacaaaagtggtttgttgtcagcttgcgagcaatgaacctatttaatgaacaccatgtgttgttaactcgtttctcccatgatttttggagttttatatcagataatgtatcaaccatttattggtcaaattttctgtgatgttcaaactgaacaatggagaatactcattttccgacatcaggaagaaaactgataacaaataagttaccatgtctttcaaattcagtagctatgttattagcatccgtatataacatatatacaaaatattcctttccaactaatagtacttcatcaattttcccttaggtatacatcttacatataccatgctttgtgcgttcagcagcatccattaacaggcaattcggtgactgttttgcagagaaatgatggtctctctgcagttcttcgtaatgtgctcgccgtcaccccccttgtggaaaccgttgtcgaacctgatggatcatggctgatctgccgcatctacaggacaaggcagcgtgcattgcctgttatcactcctcctgccatagaaaatgcaagggaaatcattatccctcctgccaatggcaatgcaagggaggctcaagtccgctttattgacttcctgcagcagggatcgcacattgagtcatcctccccctgtagttgtatagttggcccctctttggcagagggaagtgatgaatctgctggtagtgttgaccaaaaggattgagcgcaatggagggagcaactaatcgataaaagcatgtcaactagtaaggaataaaaattgtgagtgaggtgacctagtgcaagtatgacctgcaagttatataagtactgttggagactgtgttctgtttaagttggggaactgtatgttctgtttaagttggattgtaagctttgttcaatagtttcaaggaattaaagcgtgtttgggttctaggaggaaaacaaatggtcattccagatgaagaagtctgagtaagcaacttttctaaaaaccgtttggtctgtccttcttcaatatattgtgttctgtattatctcatgcctttgtgtgagactactagctatctattaatatctatatgcttatcttccaccgtatatatagcttcttcagtattcctgttccgttgctgctctgtgcttgacgttgtcgatatccaccatatgagatatgtccacaagtgtaggcgtgtgtgtgtcttttgtgtgtgtgtgttgtttgtgtgtgtgtgtgtgtgcgtgtgcgtgtgtgtatgtgtgtgttgtgtgtgtgtgtgtgtgtgtgtgtgtgtgtgtgtgtgtgtgtgtgtgggcttaaagtgattgtatacacaagggaggtacagagtttccatccatatcatatctaaacttgttgaagtgaggattattacatcttttgttgtagcaccttgcgcgtgctgcaggatcactcgcaggcgacatctccatcattgcaggcgatagattcacccgcctgcaaaaaacatttcagcgaataaaaaaaagacaccacccacgggcgctgccatgggcctccccttccgggctctcctatgtccaccgacgcccgtcgtcgtcaccgttccatcggggaaggcaaggaggcgcggtggatctggagattggcgacgacgtacggcgaggggttggccggcgatgacgctgaggcgggatccgatgccggagagtgccatgatgctagattgcgtcggatggaactgcaagttggcgtccaggcgctgggcctctgcagtggcggagaggaagtcctccgcctcgttgacgacaatcaggcagagcaggtcgggcgagccgccgagtcacgcggcgaggaggcggacgagcaccacccactggttggcgtcacaccgccgctgaggtcgacgacgtggatgacgccccgcttggcatccatcaccttggtgatggacaggttggacacggcagcggcgagccggatgatcgggcacatcgcgtggaacccttggcgcgtggtggagatggttgccgacggtgtggcctgcatgagatggagggaacggcacaccccgacacatggtaggatgaaccgcagtgcaagcacctcggcgaacggaggacaccagccgctgcatcgaccttcccccgccgccgccgccgacgaggtcaacgacgctacgcagcccatcgttgacttgcatctggcatgtcccatcggccaagaaggcggcgatggaccgcagaaacctcaccatgagaacgtcccgttccccgtcactagcaaggtactccgccggtccacctagggaaaatgagtctagctggatcccagtctctgccgccatggctgccaaggaggaccccaccatcggtgcttccccatgttcgtggcggccggtgaatcctccagcactatggccatcggtggcgctggtagccactctccccttctctctgcttcgtcggcgccagacatatgtcactcgtcgtggccagcgacggaggcgacgatgaggggagctagtggtggaggcggcgaggaggggagccagtggcggaggcggcgaggaggagagccggcggcggatccatcggtgtcgtcgtcatcgctcatcgcggctggcgacagaggcggcaaggaggggagccggtggcggttccgtcggcgctgtcgttgtcgctcgtcttggccagcaccggaggcggtggggaggggagccggcgctgttgtcgtcacggtcggcgggggaggcggcaaggaggggagccggcggaggatttgtgcgagtggataaatgtgagagagagagagaggggagggggagggaaatgagtggtggagaggatagagatggcggaggagatgataaggatgagacttagatattttttttgtggcatgatttttgcaaacggacaacataaggttccgcctgcaaaaatcatagttttctaggcggacctcttaagtggttcgcctggaaaaattgatcttcacaggcgaacggcgagcttcactccggtctacattttcgtaggcggccatttagctccgagggtcatatctgtttggaaaaaaaccaagtctgcgaaaatgctttttctagtagtggatataattaatattccctccggttttttttatgttggtaaactcatctttgaactaacgaccaacgtcgttaaaaaaggaagggagtattactgatctatacaattgatgagttgtagataatcatatatattgctagacatgaatgagttaaaattgatgtcaagctttaattttgtgctactcgatccaaggcatgttaatcagtgtgtgcacgtacctgctcaaaagttttctgcagctatagccactaatctatttggaactgcttgtctgcattcactattaggatgtctttaatggaaaaaataggaaggaaacaaagaatattattgtgacatgcatacatataggtatatacgtgcaaactatagctgagattctatcgaatttattttcatattacaagtacgtatgtcttgatagatagcatagctgaatgcaggtttgaaagccttcaaagatgtaatgtgtatggagcgaggttgttatctctggatctagatttagatatcaccttccatgccattctcatttctcttaattaaattcagtatgttctagcatgctgttttcatcgaaattgaggctcatcatacatgtgtataactagttattttgcaaataaggtctatgttaaaaattctgatgatgcaaagaaagaaattaagaaataacttcaacataggctccatttaaacctaggatgaatggtggccttggtgttttagagatttgtagctgcaaagtaagggtctcgttaaacatctgcacatgttttacaacttgcattggctcatgtaccatgtgtaaaattcatttgggaaacttttatataacagcgtaccagatatgtcctcaccccatcgcactttctgatggaaacacgttcttcaatttggcattatctttattagaggccgggatagacaaattcttggtgcacatatgtcctcaccccatcgcacttttggaatgataagtactagtgaagagcaatttccttcccatggccttttaagctagcctctatgcagctgaccatcactagtttaaaattatcatcatgtgatcgaatacctatatatgtattaaggctagttacaattaattattacgaacaagcatgcaataaacaactccctccatgacaaaccaaacactagagacaacacattgtattatggtaaatgctgaccttgattgtgctatttgcaactgagaaattgtagaagagaacagttatttttccgtgtcctttctgtgttgcatgccattggattcatatggagttcatgtcatcagaacaccctcgcactcacttgatcactgataaacctttagtctgaagattcccagacgatgaacagtgatctgacgaaactgaaaatctgaagaaagaacagagagcgagctagagcaagtttgttcgttccttaatgccttgcagtttttcaggtttacttctccttttcacctcccatccaggtgtttgacatatatagatcttgaatgaacggaacactggatcgagtgatcctgccatcccaccatatttcttccagcctggcca

SEQ ID NO: 36247 - DNA, 1947 bp, Oryza sativa
  unsure (1)..(1947): unsure at all n locations
nnnnnnnnnnnnnnnnnnnnnnnnnnnnnnnnnnncttttaagctagcctctatgcagctgaccatcactagtttaaaattatcatcatgtgatcgaatacctatatatgtattaaggctagttacaattaattattacgaacaagcatgcaataaacaactccctccatgacaaaccaaacactagagacaacacattgtattatggtaaatgctgaccttgattgtgctatttgcaactgagaaattgtagaagagaacagttatttttccgtgtcctttctgtgttgcatgccattggattcatatggagttcatgtcatcagaacaccctcgcactcacttgatcactgataaacctttagtctgaagattcccagacgatgaacagtgatctgacgaaactgaaaatctgaagaaagaacagagagcgagctagagcaagtttgttcgttccttaatgccttgcagtttttcaggtttacttctccttttcacctcccatccaggtgtttgacatatatagatcttgaatgaacggaacactggatcgagtgatcctgccatcccacaatatttcttccagcctggccactacttataactgagaaaaactgaaatactccctccgtttcaaaatatttgacaccgttgactttttagtatgtgtttgaccattcgtcttattcaaaaaatttaaataattatttattcttttcatatcatttgattcattgttaaatatactttcatgtatacatatagttttatatatttcataattttttttaataagacgaacggtcaaacatatgctaaaaagttaacggtgtcaaacattttgaaacggagggagtaatagctagtgaggctgaccgaatcctagactaactcagttagcctttttcgatcaccaacacctaatgggatgaacgaggccaaactcagctggaagcaacccaagccgagcagagcaagcattgtagagcgtattcacatcactaaatccataaaaaaaaacataaaatcacaatcactaagacatggtgaagagattcaccatccaacaatattcaggaatcaaaatcgaccaaaaaatttactaaatcacaatcactaaaaaaatcacggttcatgccatgttgtcctcttcgattccatccccaccggatcccgcacctgcacaaacaacaagaagagaagggtaagaagaaaggaaagtgaagaattgggcaaatccaaaatgcaagtgaagaatcccaagttagcaaatccaaatcaaaccgggcaatgccggcggtggaatgagcgcggaatgcgtccatctccacgtacagtagcaccaccctgacctcgatgcccccgccgtccctgtcaccataacggccgctctccgccagtgccagcgcgcccgtccactccacctacaccccatggagtgttgacatctgctctttgccagtgccgacttatttgcagcggctgatacacccacccccgtgctcacggcggcgtatgtggccacccccaggcgcgcagcagcaggtccacacgccccgatgctcgcggtggtggatccagacccgtggtcgtggcaatgttagtcggggcaacggaggaggaggagacggtgacaaggtggaggacgtggaggacgagaagaatgggaggaggaggaggaagaaggggctcagatggggctcgactaaataatgtcggctggctcggttggccgatttttattttttattttttaattataggtgtgagtttttttaagaaccagcacctataaaattagtataggtgtcggtttgtctggaaaaactgaataccggtttttacgtagaaccggtacctataggttgttacagatgccgatttttttnnnnnnnnnnnnnnnnnnnnnnnnnnnnnnnnnnnnnnnnnnnnnnnnnnnnnnnnnnn

SEQ ID NO: 36248 - DNA, 15139 bp, Oryza sativa
atgttcataggattaataaatatgctatcaattccaatatagaattcaagcaaacaatccaacttcaattcctgtatatattcattacaatcaggttctgagttcttcatttagatctttgtaattggttcttggcagacatggaaggaaaaaaaatatcatttttgtaagggatatgatggcatagtcaaaggatttcaatgatggggatctgattaggctcagacaataagaaaaatcacagtttcaatcattaaccattggtagattctctgtaacttagacaccttttgtagttcttttttcttattttggaaataaatttatttaaataaaataaaatgatgattttccctgctatttcctggtaaaaaaaacttaggttcctttggcattgctccagccactaggttcttcagagcatctggaacctcatgagatgctctggaaaagctagtggcatttgatatagctccaaaaattaaggaatccggagagacgaatgtagagctggcgttgaattctaattaattttgaaagggacgtgtgatggcatagtcaaaggatttcctttttgccagcatggatgctgaggtcaacgggattccaatgttaagaagtcacactgattgcgacaatagtaccttttaggacatggcccatggtattggatgcaagttgatgcaactggtcataatccaaaaaacaacttttttgtgaactaggtacataattttaatatcttggagggccaatttggttactcataataacaatacattggtctattacataaaacaatttatgtgttggtctttattataaaaacattgtcgtattcgtaggtggatacccctattacaataggaataaccatttgtggagggacataagtgtaaattaaatatgcatgtctcgagccaacaatgttccgagctacaaacggcaataaaaagtaatatttacagttgcgatatactatatcatgcatctcacaccatttcaattactctagccttaaatggatccattgtacatttcccgaatagttctatattaaccttcaaaaattacaagtacttctctctatgatgcacaacatgaaaacaatttccctaaaaaacagcatccaaatcataaattaagcaataaacttataattgaaactaaagaatcaaaatcaagcatgtgggcaaagggcttatagggcccattgctgcacacatattttgagaagacgtttgaagtgacaaggagtgatggagggcaccactgttttctatggaaagtacttgacatttaactttttctataatcttcgagattcaaatttctttatgattttatattagagttggtctataaaatcgaataaatttacgagattatgatagaacatctcaagacaaatcaactcatgccgttttcaaaatgtttctatgttttccgactatgtatctttagaaatcaacatattaaaagttcaaaagtttattagatcttgtccaaaatgcaagtatttatgattggatagtagaatattgcatcgttttcttgttggcttgtagcaaaatttgaattttgaaattaattttagagttgatttggaagttttttttctcatagtttattttggagcattggattttgaatcattgagaacacagatataaaagttttactcagattattttggttgtttcattcacgggttattagtctaatgacgagaggaataagaccaagttccattttgcgttctgtggatcttaacttgtagcaataaaaagtttatgcaattgtgaaacatgtaaattaataaccttgtactaatagcggaaaaagcgcctagactggtgtagattgaataaaagactacacaagcaatcggttgaatcaatcagttcagcacataattggacgaaaaccaaagttgttcgactgggtaaagatattttctattaggaataaagcctagtatgaagcagtattattgattttgaagtaaaataaatttacttaacccaatcctaaaaataaaataattctttttttgggatggtggtcgaaccagaaccagaaagtatcactgatggtcatccaaaggttcaaccacctgtcagagtttaataactatgcatgcctcctatctaacggtaaccgatagtagataagaaaaggttagacgagtcaataataataattaaaagcgccaaaaaatatgttcaatatataacatcaacctccttccaaactgggggacagcaacgcaaagatttactatttgctatcctcccgaaatacacatgcccaaatatcacttttccaaattttcatttgttagcgtagcggataagggaaacaagactgaattaacctgtcgcccctcctttcccgccatctcctcccctcatgcatgcatccaccactatttatccccctcctccccctcctctacaccttgtctccgcctcgcgggagaccacacattaattcctcgcgccccatccatccattcccctgccatgggctgctcgacctccaagctcgagccgaaggaccagctggacgcctcggcgccgtcccaccaccgccgccgcggctttgccagcgacctctttggccgcgccaccaggaagaaccaccacaatggtggcaagagcgggtgcgaaagtggcgacgccgccgtccccatggccggccggcagcatgaggaggagcagccgcggcaagggaagaagggcggccgtggcaagcgcgaggtgcaagcggggtcgccaagcttccggtactactgtgagaatgccgccgccgccgccttcggcgaacatcgaggtcaagcaccaacaacgcaaatatgatctgtggatgaactcctggaacttttatcaatggtacgtttggttctttggttaatatcgtccaatttaaggttgatttgggatcaatctagaatattgttcatgctgcaaaaaataataactctatcctgcgattaattttttgatcgctgataagattgttgctgattatttacagcagtgcgggcctacaaaagaacaaattatacccctaaggaatgagagatgaatcagatgggttattaatcaggagctgcaagcaaattaggcgttaaatccacgacctttttcgcctgttcgttgcttttcctcggctgttatatctccagggatcaaagacgaagaaaaaaaataacttctgatgatatataagtcaagcagattcccaatcatggagagcataacgcactagtccctggagaattcatcgtagcagttgtaccaaatgcagtttgtacatgtaataccaacacgatgaatacaaattaattccagatcgatctcaaacgaaccccaccagcgcaaaaaaaaaaaaaggatatctatatatagttttaaaagaacaatgtgtactgtcatagcacatagcaaagatcgtagatagatgatttcaacggaaagaaaggcagtagataagttcatttcatgcacatatagagcataaaagcaggaaaaaccagtctatgcgtgccatttcagaaaggaaaattgtctggaaacagagaagcaggcaaaaccaatcgatttaaagtagggtactcttttgactttgtttaaagttaaactaatttaaatttaactaagtttgtacataaatataataatacttacaacatcaaattagttacattaaatttattattaaataatatattttcacatatttttgtcttgggttgaaaacattactttttttttctaaatttgaaatagtttaactttaatcgaactcaaaaataaattataatatgaaacacagagattacattatagcacattgtgcctttttttctcgaacgtgctttttttccccgaacgtgcaggagtgttccgaatcactactgctatacattaaagacaggattaggccatgtttttttctccaacaaaaattggataaacttctggataaaagtggcacgttttttaaactgctaaacggtgcgtttcgtgcgaaaacgttctatatgaaagttgttctacaatatacgattaatccatttttcaagtttgtactcaatatataataattaaaactcaattaatcacacgttattaccacctcgttttgcgtcaaacacttaatctttatcctcatcttcatcttcaaacaccacctaagccaactaatttccctaccctaatacgaatgagcatcctggccggtgacgatgcagtttgaccgaagatacgagcatttcgcttcgctctttccaaatctcccctgcgatgaggatcaccgtaccaccgagtcaagcagttttgtttgtgaaccttcttctcatgtgaaaacaaaaccatgagtaggatgcagccacttctctgttttcatgaagttgagcatattggcaaggaatggaatgtgatcttcattcagctccttgttgcaggatagcagagctagcctaatttcgtttgtaaggcagaagattttgacaagagttgcttcagataacaagttatacatagcattgctcacatgttccaaactattccgataagacaatatttcgtcaagctgtggaactacatcagcaaacttaacaaggcacctccactccgagtcatggagaagtgtttctcgaggagcttctgaatccagcattggtcattacccattgcacttcttcagtccattgaccaaattcttgcttgaatcaacatatccaaattccagtacacctcagtaatagcatagcagcactagaagaagtgactgaacttgtttcaatctgataattttgtttgaatcaaacaagaacgccttgttccctctcacagcatcttctgacattgacctgaaacattcaccaatgtatggcatcgcttcagcaaactcaaacttagacaaaatttcttgtactatgcaacaatttcgtccaaataaaactcttgggcaatcattagcaacatctagaaaggaaagttgagcctgaaacaaactgcaccattctgcacttgacagaaaagattccgatggtgaccagctggtgtcgtaaatcaattgccacgcatgatgcagcaccaaaaacttttgtggcaatccaacaccctatgaacttatattattgtcaactcattctaagagaagtgcatatgcattcacagcagttaaaggagatgatgcagcagtaaaaccagcaaccggaggaagcataaaaggcacatcggtaccttgcatattggtcttgatgcataacgaaaactgatattgatcttgtgtctgatctctaggtagattttcaactgagacgcaatcgtctccaagctcaacataactttgagctctccatgtatttttacccaacaatgcggccttgcttagtcatcttagcaggaaggaaaactggctttcacagcagtaagagcatatataccctgtaaagtaaaaagatcttcatggcaacatacttacgaagactctccaaaacatcatttttcttccagaacagttccaacactgtctgcatatacagggtggaaagaccattctagaggcagctgagaagtaagtagtcttagtttccgttgagaggttttccttgtagaacatttccgtacactcgggcatgtacttctctgaatgtaaggaagaaggcgatttcaggacttttgtgcttgagattgagttcctttttcacagcatctatcttatcagtttccagaggtaatatattacttgtggctgacttcagaattcagacagccatatcttggctacatccattcaagaacattatccaatactcgacagccatatccgtatatatggcgatttctggattccagaaacacacttctgaaactaatgcctgcaaactaattgaactggaataaagtgagcaactaggtcaatcaagtctaaacataaaagttttctctaaaaagaaagtctcaacataaaagcagcacttgaaaacttaaatctttataataacagaaatgtagaacttatggaaaaatatcatgatcaagagaaaacaacaagatagtaaaatcacgagttaagctgataatcatatgatgcacctttctcctcaaaataaccactatcgctattactccttttagagtattcccaaacttacaaacggattcgacattctcttgagtaaatcctttctcattgttgaacactaggagtgtcccaaaagctccgctatgggtaaagtccttcgatgtgattacaaactccaaagttggtgaggctccagaaggatattcattgatagtaagcaatcagagcattagaaataagaaatgtacaagagtaaaatgcaccacaaaagtaataagtcaacaagaaatgtaattactgaatttgtctaaatgagaataaaaaaagaatggaaggtactaaataaaaccatctattacttctccaataaaatgttctaaaaggaagcaattaaactcaaagtttctaaccttagcagaacataattgttttacaagttatcttacattgttcaaatcacaaaattgttcttaatgggtgctatattcacctttatttgttaaattcaaacaaaagaattatggcaaatgtgattgacaagagaatcaggacacaagaaccactgaaatttatcacacacacaaacagagagttactgttcagtagatatggaggatgcagttttaccagttctatggtcacaaacatttcggttagaaaacattggcattcagcacaagtaaagattcaattcaggtatgcatacatgagttcacatgctagatacacttgaggattagtattgtcacttcagaagtaataccagtagaactggacttgaagttattaatctgaagattatatttatctttaaacccaacaagatcaaccaattcgagctctagttcataagaaaggatggccttgacaaagaacttgaaattaaggaatggctacttaccgatacatgatgccactcaccagtctgaacaaaacatgatacgatcagcaagagacctgtaccgaagaactgtcttcatcaattgctcatctttcacacagttgataagttgacttcgagaaagaacattttctcacatacctaatcagcttctctagtgagcatattatatcaagagaaaaaagaaatccatatgagacagtttaattcaccaagaaagtgtgttcccatctcgataaagtttacaccgttaattagacaatacgtactaaaaaaaactgatgggttatggtcaagaaggaaagaaagcctcacatttggaagcagcagtataacagcttggtactaatagcaacatatcatatcagaacttcagaagacgcctaagaagtcgcatttatgtcctccagatgcaaagcatcatgatcttacttgggatctacaacctacaaatggaattcacacgagtcaggatcaattgcacttacaacacaagaacaatccaaatgccaacgaaatgatgagatattgcaatgtctttgccagtttcctgtcttctgcactctacacatttttctctatctcaaccatggagtgcttacttgcaaaaaaaaaaaggaaaataaaatagagttcttgggtcaaaatcatgtcccccgtatgttgtctgtgaaatccctattattgtaactaggaagatagcccacgcattcgcgcgggcatgtgtcgtagactatgttttaacatctacaatatatgatttctccataaattgttttcattagcaatggttttataattttctaacctagctattagttgtctttataacatatcatatttaattaatccctacaagcaattatttataatattcttcatcatctaaaaagtaggtagacatattttttgttagaaaacatgtatagcaaattaagtgtaaattcaaaagtaagatgtttttttaattggatgtaggttgtcattgtttattgacggataaattgggtgggatatgaggctccactaaatgtatgggtttatatagcctaatattatcatttagtttgacagagaatccatatgtgaatgttccatctagagtgtgcgtgagactccatgcaacctagagtgaataatattggatgaagaaatatagttgtgcaatatattattttggaagatgatgtattatgaatacacgcttgtcttttaatatgatatagatatagtggctggaaataatgggttcatcagtttaaaaaggcctaggaggatttatggggtaacatgtggagactttatatcaaaaagaaaccattatctaaaattgattagatgaaatataaaataaaattataagtgtagcttaaaattatggtctttttaatatttgtttctctctttagtttattagctgaaaatagggaggagactggagagaaacgaatagcatagaacttgaataagatatgagaaaaggttcacagtgcaatagtgttatgtgcatgtgattggagagggaggtggagggtacattattttttttcaatctatgtaaacaatctaagtgagaacctatgatttgttgttttctcatgctaagaatctttaagacatgacatgtggtagcttaagtttttttataaagagaaaggtgatctaatagttaaaaataatagggcatcaaattaagtggaaaccgatggatagatatatactttattttttctttgaatttcagttttttcaaagttttaaaatatcatacgtggtggcttaaaagtgctatagagcacatttaatcgatctttactatgtaaaacgattcaagaatatataatatgcgttgtcatgtttttcaatatttcgttgttatttggtaaggagatgttgtttttattgaggtagatttaatgcgttcatatgtttgaattatttatgtctttaaatccaattgttaaaattatagctccactgatttaaataaaaattgatgaaattataagtccaccaatttaattaaaaactgatggttagatttgttttcttcataatattttttataattagaatttttatttataaaataggaaggtatgagaaagaattattgaagatggagaaagtgtatgtatggatacttacgtgcgtggggtggtgggaagggtgggctagtggggagagaagagttgtgccggtgggagacaagcgatggatgtggattgtggtttcttttaagaaaaaaaaaagataaatctaatagttgaaaatagatggtttaccgatttattataattccacgtggtggtttaatagtgtttataggcgtaccacgtggcagtatagaagtgtttgtatacttttagcatataattttttttatttttaaatggtaattaggatgacatggcacgccctagaaattattcttttccgtagaagtttatcacggttgaatcattaagttttttaaagacaccatggatctaaatttggatgtgttcgcaaatttgatgattatttagggtgcttgttgtttagccagtaaaagataaatctcgtagagctttgcaagatgaaaacgcgtgcacaccctcgtttgtagcagacctaatgctaattgcattgataatccctagcaagaataggttagcctatttggataaccaaattaaagcaagaagcacgcacattgaaaacctattcaatgttttgatttctctgcatcgttgtggtttattatataacttagtaacttaagtttttatatggggttgctagctataaaataggaaattcacgtacgtaccatagagggaggagtacatatatgtagagagaggagatttcttttattgaaaatagatccttgagatatatctaatggttagaaataatagattcaccggcttataagttataacggatggtcagatttttttttaattttttcctcataatttttaagattttttataatttattagagtgccacatgatggcttaggagagtatgtaagatgtcacatgacgacttgagtacgttcgtatgaagtttatggacttgtgcgtagaatacaactcgaaatagcatatattttttacaactaatggctgaaattattaatttagtttttatctcatgagagtgaaaaaaaaaaagaaaaaagaaaagaagggaaggggggacacgtacgtacgaagtatgtatgtacatgcacgtacatgtacgggatggatcgacatataacgtggcgctttctaaatataaatttatttggtattttttttaatctaacggttaaaaaaatggttccaccagattaaataaaaatcaatggttagatatttttttttttgaatttttctaatttattagagcgccacttgacggcctaagagcatttatagagatgacatgtgacggcttaaaagcgtttgtaggtagtttaatggacttaataattgtagaaaatcttattttgtcgttgatttttttttcattggtgttagaggtacatatcacatatgtatttcctgcttttatttttttccgtaagtacgtgtgtactttttttttcttgttgggaacagtataggtaaactttgtttgtgtttaacgtacggacgtgcggatatatatcatgatgtgtacgtatacaggagttcttttaataacaaatctaatctaacagtctaaaatatcggggccatcaatttaagtgaaaatcgacgataagatcatatagtgccatgtggcaacctaggagcgtttgtaggtgtgccacgtggcggcttaagagcgtttttaggaagtttaatggacttttagtatataatagaagatagatagatagatagataatagatagatgctctgttggactggtttatcaatctccataatatgaccatacgaattgctatctttcagtttcttatgattgctattcctagaacttggtccagcttgatcatcctgatcctcaaactcctaaacacttgactttcttagaaatagaagacttactaaccttcccttagtcctcaactccccatatttttccaaggttgttgcaactgcaatctgctccggctatattgcatttttcactttcttcgcaccgtgagaggcttgtgtcttgaatccctcccacctgactaaattgcaggaccagtaaggtgtggatctgaagattgagctttgttcatggacacgagggggaactggctgatagcaactgcagataataagatgctagcaaagctagaacagttggcctagtgactggtgattttggtaccatcttcttgaaaatatgagctatagccttcgatgcctcttcaaatcttgtgatcaatctagtcttgttcagcacatctttgtataaactgacccctctaccataaaatcaaaaatctactaccgggatcctgccaaagacccttagaagacatacccattcaggatccattaagaaagatccatttggtgcagagtctcatcttggccttcagccctctaactaaccacatgacttaataggcaagatgcacttgaggattaaatatgtagagagaataggagggaacaccacactccccaatgagggggggtgaccatatattatagcctttccaatatacaagatcctcaattagaggagtatacaaggaagctaacgatacaaaagaatcctatacatatatggctatacattcctaataccctctcacgaacgcaaagactggacctgaaatcagtgaacaactgcataggcagtcccttggtaatgatattggcgaactgatgggacgacggtacatggagcacatggacctgtccgagagccaccttctcccgaacaaagtgaatgttgatctcgttgtgcttcgtacaacggtgatgcaccggattggccgtcatatagatagagctgacgttgtcgcagtaaacaacgatcgcagagacgatgggggcatgaagctcctggaaaagttgtcgcagccagcagcattcggtgatggcgtgagcaacagcgcggtacttggcctccgcactagaataggagacagtcgtctgacgcttggaagaccaagaaatcagattgtcgccgaggaagacgtagtagccggaggtggagcgccaggagtcgggacagccagcccaatcggcatcagagtaagccgttagagacttgacaaaaccggtgccgatgtggagtccggcggggagagagcctttgacgtagcgtagaatgcgcttgaccaaggcgaggtggggctaccgtggatcatgcatgaacaggcagacttgctgaacagcgtaggctagctccgggtgagtgagagtgaggtactgtagagcgcctgtgaggctcctatactcggtcggatccttgacgggagcgccgtcagaggcagagagcttggcccgagcatcaaccggggtggcggtaggatggaattcaaacatgcatgcttgctgaagaagatcgacggtgtactatcgctgggacaggaagaggccatcggatgagtgattgacggagatgccgaggaagaagtgcaagtcgacgaggttggtcatggcaaactcggagtgcagccaagtggtgatgaggcgcagtagatccatagaggaagccatgaggatgatgtcatcgacgtagtgcaggaggtaggcgatatggtcttgatccttgtagacaaagagagacgtgtcggacatcaaggcgacgaatctgagcagacggatgtaggtggcgaaccgctggtaccatgcacaaggatcctgcttcaagccgtagagcgaacgctggagtagacagacgacgtcgggcgtggccaggttgacgaagctggatggctgctggcagtacatcgtctcgtccaacgtgccatgaaggaaggcgttcttgacatcgagctggtggataggccataaacatgaggtcgcgatgctgaggacgacttggatcgtggacggcttgacgacggggctgaaggtctcgtcgtagtcgatgccatgttgttgggagttgccgcggaccacccaacgagccttgtgctgagcgagggagctgtcagagtgaaatttctacttgaagatccacttgcccgtgacaacgttagcacccggggggcagggcaccaggcaccaagtgccattgtcagtcaaggccttgtactcgtccgccatggcagcatgccagttggagtcagcgagcgtgctgcagtagttggtcggaactggggagatggcggagtgcgaagccgtcaggatgaggcggtcgatgggcctgagggagccggtctaggagtacgtgaccatggggcttggcgggaggggcggcaactggaggaggtgctggcgcgacgtcggggcgcggtgatggcgtggcctgtcgtcgctggtagacgtgcgggaagggctcgaccagctttgccatagtcggtagaagaggtccagcggccggccgtgtcgagaacgtggggcccccagcggctgaccgagccgacccagcagcaagctgggctgcacgtgacggagaggcaccaggagatgtagccgcctagattgccacctggtagggaataagcagctgctcgacctcatccgagggagcggccaccaaagacgaccgcaccgggtcatctgtggcgcggggcagggagagccgcggttgctcgacacctgtgatggatagagcgaccatggtgcgagtagtcacttcctgtagcagaaaatcaaacgaagagacatcgaccggatgacgagcaaacagaaaacgagtctcatcaaagacgacatggtgagaaatgatgatgcggcgagtggagaggtcaaagcagcggtagcctttgtgcgaggtgggatagcctaagaagacgcaagcgacggagcaaggggcgagcttgtgagtggcggtagcactaaggttgggatagcaaagacatccaaacacacataatagggagtagtcggggattttgttgtggagtagctggaatgggatggagttctgcactgatgaggaagggtgtcagttgaggagatatgtggtagtggctaaaccttcggcccaataagtaggaggcatggagacctgaaggagaagagtgcggatagaattgttgatgatgcgaagcacacgctcggctttgccattttgcggggacgtgtatgggcaggagaggcagagcaggcagccgcggctagcaagaaaggatgtggtgctacggttgacgaactcagtgccattgtcggcctgtatgaatttcagatggcgaccaaactgtgcgtgtgcatatgcaacaaagtccacaatgtgttgatgaacatcagacttatgacgaagaggatatgtccaacaaaaatgactgaagtcatctagaataaccaagtaaaatttgtagccagagatactcaaaacaggagaaatccatacatcgcagtgaactaattcaaaaggagaacaagtactggaacttgatcgagtaaaagggagacgtgtatgtttgcctaattgacatgcatgacaaagggaactatctggctttgacgagggtatggaagagatgcgctgtagggcgaggacggctgcagatccggggtgaccgaggcggccatgccaaatggtggtggaggtggcctggaagcagtgagcgacgatgggtggtgcggctgccgggagggtgtagagatcgccacgactattgcaacaaagaatcacgcgtcgggtctggaggtcctttacagaaaaaccaaactcatcaaattcaatagaataatggttgtcacgagtgaattagcgatccgcaagaagattgcgaaccaaggaaggagcaacaaggacatgtttgagatcaaattttgtggtgcctataggtagaaaggaagaaccacgacatgtacccggaatagtgtgaccattgccgacagtaatataggtgtgagagttgggcaagcgagtaacgagtataccatggatgacatgtggaggtcgcgccggtgtcgaggacccaagaattagggctgtgaaccgtcatttggttgagggcagccaccagtcaagcctgatcccaggccggttgtccagcagtggtggctggcgacaagtacgggccggcgaa

SEQ ID NO: 36249 - DNA, 990 bp, Oryza sativa
cggtaggcaatgatggagagatcgccttggataatggagtggaactcatggtgaaggaagattgcacgtggttccttgttcacttgaaagaggtcggcgatggcgagccagagggcacgagccgtctgatccagctccatggcgaggtcgagggtgtcgtcggcgaccgagccaaacagccagctgcggatgcagaaatcagcttgctcccatgaggtgtcaggatctgcaggaggtgcggagtcgaggtggtcgaggagaccgaacttgccacacatcgagcggaataaggtcttccacttgttgaagttggggttgcgaagctcaagggagatcgggacatgagtcttgacggagatggtcgtgtatgggttgatgaagatagtcgcgatggcgttggtggaggccggcgctatagaggtgccggtcgcggtggaggtggcagaggacgtcgacatggcgatgaggagggcggcgaccagcagacgacggcactggtgtagcacacaaaggaaagttcagagatgcggaaggaaggaggagaacttggaattgataccatgtagagagaataggagggaacaccacactccccaatgaggggggtgaccatatattatagagatatttaaccatttaccacatttagatgtggcaaataactttttgccactgaacccacatgtcatagacacatgtggacccacatgtcattgagataggggtggcaaatagttatttgccaaatctaaaagtggcaaatagttaaaagcccctatattatagcctttccaatatacaagatcctcaattagaggagtatacaatgaatctaaggatacaaaagaatcctatacatatatggccgttttattgacaaattgacccttttggaaaacttatttcgaaactaacccctgccaaaaacttcaaccaaaaataggccgtcgcctcagcgccaaacacattggcgctgacgttggccgtgtc

SEQ ID NO: 36250 - DNA, 318 bp, Oryza sativa
cgttcaactggtaaaatattttactttcatcaaaattcaatgccttcaaaggtatttgttcatcatcatataggtcattgacatatttgacggccataaacatttctctgcgaaaaaggtaaaagtatcatctaatgctataaaataaaggcaataacccaaatattaattctgcatctgtgtaacacatacatgcttacaagcttaacccatgcatctgcactgtctcgacatgtttgttattattttgatctatataaattaatctacttttgtcgaatgggcaacaagaaaattcgaaaagtaacatgcttgcat

SEQ ID NO: 36251 - DNA, 636 bp, Oryza sativa
aaaaattaaaaaaaattaccataccatagacaagcaaaacatctctttactttaaaaatcatagaagttttcgctgaaccgatattatagcacaatgttcaaatgaagctataacttccaaaatatattggaaagggatattacttcttcccatcacatcttaatgtaaccttaaactattattatatattagaatcaaaagtgaagcttcactttagattttgtggatctattgccaagtaatatgcattcagactagagttttaaagtggtaacattaaatagcccagcatgatatttattgaacctactcattaagaatgctataaacagtgaatattgctagcaaaaaacatacccagtttggcggatcttttttagccacttccttatctcattttccagcaactcttcctcattcatatctagcatttcagtagtttcttcaataataccaaatggcttctcagcttgtataataaatttagctccttcaagtttttctgatacgttagaagcaacttcatccgtccaaagtgaatgcacatactgaagaagctgcaaaaaaaaaagaacagttgtaataaatatgaaattactacaaataactaaattcttccgggtatgctataatct

SEQ ID NO: 36252 - DNA, 247 bp, Oryza sativa
ccctgggaagtcaatgaagtgacttgacgatcgcctgcattgccaatggcaggaacggcgaggacagcttcccttgcattgccaatggacggagggatgatgacctgcggtgcacgctgcctcttcttgtaaatgcgacatatcatccaagaattatcaggttcgaccatggtttccaccagaggggcatgagtatgggcagcagacggactgccattgtttttctgcaaaacagttcgcatatagt

SEQ ID NO: 36253 - DNA, 866 bp, Oryza sativa
accgactcatcattccaatccaattcatgcttgatgcgagacattaactcctcaaaggtaggcttcgcaaaaaacactaattgtctaactgtcattccctcaaattggcttccatgtgactttcatctaccacacaaccaccataatgaagccggaccaatctattcatcacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaagccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacggaggaagaactggctggggcggcctcggccgggctctaagtagccaacgtcagcgccaacttacttggcgctgaggttgggc

SEQ ID NO: 36254 - DNA, 1637 bp, Oryza sativa
tgagccatctttcagaagagctcgggaaagaatcagtaaagtaagtaacactcccttacagaagtagtgtaagtattttttttagcactgtatccaagttgatatggaacaacggtacaggtatgaagatttggtgtgggaacctggattgtgggaatcaagcactaaagtgcaattggttagagatgtttattggtgctacaacaaaaacaagaacagaatatctacacttaagaacaaaacagcccttggactcaaaagctttattgacaagttggaggtgaacaagtctagagcaccagacaaacaaatcaatgacgacaacttgtatgagtctctgttttttcttagagtttacatggttgcccacaaagacgatactattaaaggttacagtggcacaatggtgagctagctgttgttgaaattttgttgattttgcaattaatttgaattagtatgaaattgtgcattaaaaggacttacaatatgttttatgtctgaactctaaagtacaaatacttatatcctgatgagctttatgttctactttcttttcttttttacaatttgccatacattgtgtcatacaggaaatgatgcatgacaagaaagccattgtaaggttgcttatgatagaacgccctgaatacatggtgacactcatttcagcaatacggaagttaggctggattaggcaatctccattttgcgcagtaagaaatctgaaaatattttttactgtgttacttgttcaacctagtacttattatattatattcatgcgtgcagtggataaccagtacatgatagagttttacaccccaaatcctgcaaagtgcttggtatgcatacaatttcttcttatactcttatcaagctgattctttagcttatgctcctaaaaaaatcattccctttctttactctcatctaattatctaacaaaatttgatctccattcttgcagctatctcttagaaggattgggatcccatgcagtttgaacagggactgcaagtttagcagtcttaggtattcactaccatcagatcaaaggtttcaatggcccggatttagtagcagtactgtttgttagcacttgctacagtatgtgctacaggattcatctgctacagtacctgatgaacagtatttttgtgtgatctgagtccttgttatttgatccaacaatgattgtatgacttgctgaggaaaaaaaattggtagatggcaaagtttcaacatgcatcttgcagtagctacatggaggttgtacttcttagttactccctccgtttcataatgtaatactgtccacattcatatagatgttaataaatataaacacatatatatctagattcaataatatgtatatgaactggacaatgctagaaagtcttacattatgaaacggaggaagtacatattttacaccaaaggaacacctgcggcagctgattgggtgttggtaccaggatatttggcgccgaggcgctgtgctccttctcaaacttgtagcgtgtgttccatctcattgaccattttaagaagctcttttgattagagactgttttcacatgtgcaacttgacgatggagtattggagtagcatgcttggctttaagggttgg

SEQ ID NO: 36255 - DNA, 1147 bp, Oryza sativa
  unsure (1)..(1147): unsure at all n locations
nnnnnnnnnnnnnnnnnnnnnnnnnnnnnnnnnnnnnnnnnnnnnnnnnntgccccagccgcgccgcctcgtggccgtccgatcggctttgggccgatccgggccgtcggttcccgtggaccggcggtggaccgcctcggtggtcccggtccacggtggaccggcgcccttgtgccgctgaccggtggggcccgcttgccggcgccgcccctcccccttgatgacgtcagcgaggtccattttctttgtaaaaataaataataattgcgcaataattcgataataattatagaaatccattaaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcgcacatttccccttgagcatgttgatcctaatttataaatgttttaccgtttgcaaataaatatgcatgttttgctaattacatgggatcagggtttacctatctgctcgcttgtgccatgtttacttgatatctgtcctttgtcaaccttgggtgataaatcgactagcttgtgttacttatgtgacctagctagaactttatgcttagccatgcttaattaccactagctcagtcgatgggataattgcagtattagacattctagtatcttgttgagctgcgtgctcgagacatctggccatgttacatggtcataattatccaactaaaatgcgactgaatggtgggctgtgggtgcatggttttgcgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggg

SEQ ID NO: 36256 - DNA, 7158 bp, Oryza sativa
ataattatccaactaaaatgcgactgaatggtgggctgtgggtgcatggttttgcgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttagggaagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtcccatcttaataaatcgacccaatgcactgtagtataggtgggttggttgggcctgttcaacgtggtgtagcgttgatcagtggagatctaatttactttaattacccaaccgttttactgtttgctaaataaaatgttttccaaccgcctttatgcaaatagccacaaacccctccttgtattcctttgcacgtctgcatcattggtgtggcttgctgagtacggtggttgtactcagtcttgctattattcccccttttcagaagtgtagtgcttctgagctgaagatgaagttagaagaccaaggctcagaccccagttgagttttgcctgtggagtggagctgaagccccgctaggatcgcctttttccgctgctgctgcttttgtttcgatgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacatcccccctcccccctccggccagatctggaggggaaggagggagggaggggagccgccgccggccgccccgcgccgtccgccccttccgccggcggggagagtgaggggagaggagaggtgaaggggaggggaggggaggggaggggagagaagaggaatttgccacaaaatgtgtcatgccacacctcactttgccacaaaatgtgtcatgcctcacaaagtgaggctagcaatttgttagccacaagtgtgctaagtttggcaagaatttgagtctatgatgcataggttcaatgactagcaaagtgaggcatcatacaattgtggcaaccaaccaaacaatatactaaaaaattgtgacatgcctaaggtttgacatggcaacctttgagagccaaccaaacagccccttagaaaaatttcagccgcatgtgccacatatatataccatgctaattttcgcaggcgcacctcatgtggtccgcctgtgaaatttgatgtccgcctgttttcgcaggcgaaccacttaagcggtcatttagctctaagcgtcatgtccgcctgcgaaaataagacccccacgtcggaaaaaaaatgcgttttctagtagtgaaaaaaaacaatgtcattgtaattacatataagttacgttacaattataatatatttacgctatgattgtatattatatttacatctgataatattttagaagaaaatttgacgataaatgcataattgctttacagttgatgaatctagaactgtttacgctcacaattttctcagtgtttggatccaaactatacgatgaaaaggtagtttcattggaacgtaatttcataatgcatcgagaataccttgtggatatgcaggttattactggtcacgtgggcgaacgaactcatcacaagaattggcactaatcaagctcatgttccctctgaaactactaaggaaaaacttgtgacaacaagtttatacctgacaattactgcttagtggatgaggtgagaagcaccaaagattttgatttctcctttaatataacttattttgtttggttaaaaaaattgtatattccccaaaatttctccccactattattcaagcttgaagccttgaatgttgttcactaaagaaaagacatgcctacagcatgtgcttgtatgtactgttgtataatctattgcgtgctttggttttgaaggtaactgctacattgagagaggctggtcttccatcatcaaatctgaagggcctctttagatcccatcctggggggcagagcagcagaaagctttggataatattaaggcatatatgagttcccctccggttttaattcctccacagaagggagtgtctttcaagttgtatttatcagccgatgagaagtcaattagctcagttttgattcaggagttagaaggcaaggagagggctattttctatttaagccgtaggctcttggatgcagaaacaaggtattctccagtggaaaaattatgcttgtgtttgtatttctcttgcacaaagttgaggcattacttactatccaatgaatgcactgttgtatgcaaagccgatgtgatcaaatacatgctatcggctccggttttaaaagagagagttggaaagtggatatatgctttgacagaatttgatctcaggtaatccaaggcagtcaaggggcaagctatagccgattttattatggagcatcgtgataattcaatcggctcgattgaaattgtgccctggactttattctttgttgggtcagtttgcgagccaaaaaaaatggttaatcaacggagtgacaatggtttgatccataacactcggcgtgatgagatctctctcaaggcagtatcagagggatttaaacgaaaagagtggtgaaatatttgagagtgacaccatataaggtatcttgggaactctcttactttgggaactgttagagaatcgtaagtggcaattacaccctagtggtgtgattatgaatcatggatggttttccattgctcatggcagccactataaattccagaaatcatcatgatgttcctcggaacttgacagaaattgttctgtacgtgggtcagaagcatacggagtcaagtacagaaaggtgtagtcagtaaggtatatgacagagaacctctttttaacggatcatctttaccgaagttatgaaagcgaagttgttatgatcaaagggctgaaactctcgacagcatcaaagtcagtttccatcagacgctcagattccagtacttttgggaaagtagctgcggggcctatagtccgtcaacccagaaagagtcagcaaaggatgatcgaagaagtgagaagccatatcaggagaaggaccttttaagtttgatctgttaagtgatcactgtatgtttcagagaatgtcaaccatgccatccgttcaggcatacaacaccgaagccaggcctgaagcaggacagttatgctagcagtagaactaatggggaatgtcagtcaatagtcagtatgctcatgagctaaatgagaatttctttgtgtggaatcgcctatcatcagctaagggttaagctccatgtctcgccgggacgaaagtgcatcgtcattgcttcattttgattgatcgatgaagttttcagttttcaaagtcagggctctttgcaaatcagaggagtgttgttatttttcaaggacagcagtttaattgttcccagtcaggcggaagtatgactactctctgtaagggggttaggtcgcagagatgagttttggcttacctcgtcgctgtttcccttaaagattcaacccagtgcagccatccgggtagtattcaacatatttttttttctaaaaaattgatgcatggaaatgaagtgctaattaagttaccaaaaagtaggattgcagtcatcactttaaatccaaaattcgtaatgacttgcataaacatagttaaaaattaaatgtcaatatataattaattttgctggaagcctttcatgtttccaggaataacccgtaaacatttaatagagcttgaaaatcatcattaagctctaacctgattcttgggagtagcatgcgcctgagccaaaatttctaaggccgtgtttagtttcaaaatatttcttcaaacttccaacttttccatcacatcaaaactttcctacacataaacttccaacttttccgtcacatcgttttaatttcaaccaaacttctaattttagcgtgaactaaacacaacgtcatgttcacttgtatacatatccgcagacaatactacaatcacaccagaaattgcatatctacataattgccctcagattcaaactgtatctaccatcgctagctggtgagctcacatttctaacatgtcaatctacgttcagtcatgcaaataatctactccctccatccccaaaatgtttgacaccgttgacttttttaaaaacgtttgaccgttcgtcttattcaaaaaatttaagtaattattaattttttcctatcatttgatttattgttaaatatacttttatgtatacatatagttttacacatttcaaaaaaaatttgaataagacgaacggtcaaacatgttttaaaaaatcaacggcgtcaaatatttaggaaaggagggaatacgtcactattaagaaacaggaataaatttatgagtgacataaatgagtgcagtttggaaggaggacatgccatagaactggacgcacaatatttcatcaaataggtattgggcgtttagattttgtttaaagtccaaagctgaattcaccacagaaaaaatataaagatcccaatgttagttctgtcaagggtgttcaattcttcggttccacattgcagaagcttagagataataaaaggtatatggttgttaagctgacctagggaagattttacctgaaagttccatacaatgcacgggtcgtttatctcaaaatgcttgcccattgccatatgtctgaatatgaaaaaaaaaaaaagaagcattgtgacagttgttacctcgtcagcgtccagtcaccttagccataaaccaaaaaatcagacaactccattacattaggcatggtcagagagtgagaataggctgcggtggaagcttgatagcaagataaaaatgttagttctactaatataatatggatagagatcaattgcatttaagacattgtcagttccagcatcactttgaaattttgtgaaaatccatgtcgctgaacaatgacaatatagacacatatccaccgttcaggatatagtaggaggcgttccggccacacttctctagctccttcactacggccgtcagcatgaattcttggttgcatcatgtgcatgccaatctggtggagcccggtgccaccgaagcagcatcatgtgtatgtcaggttcgcccatggtcgtcatacatgagtaacttagcaaagttcagatctacattttgaaattcagaaaagcaattcacactaactgctctacatcattctcacacaagtaaccccacaactcccaaggaaaacaagaaagtacctgaccttttagctttaaggctatgtgaactcaagaactctgctgcatctgctacgccatgcctcttactgagcctagcattgcttctggacatcctgcatatggattaacgatttactatacttgaaatcagcaatacaatgttcagaagcatatggacgggatgacctggttggctggtttcacatttggacatcaggataccatcaccatccgtgtttgctcacacatttgcaccaacgaaagaaaataccaagcatacatccattgaaaaaaatacaaagaccatgaattactgcagaggagtgctgactggaaaaaaaatcaagcaaaaaattaaagatatatttgagaaatacgcatatgatatattccaatgaagcagcacaccttcaaacttccagatctcctccacttcaaacttccaggtacacagaggtagtacctgcactggaacctctagaggtagtaccactctcctttctcaatgaacaaagtttgataaacaaataaaatttctgttaaaattatgtccggtgaatttaacattggccaaataaatttgtccgtgttgcacatgctgacagctgctgaccttatgttccaagaggaatttgaataaaatccaacgcaatttggtaaacatataatagagttaaacaattatatataactaaactttaaaatacagctagacaattcgatggcggcagaggggaggtgccaagcagcgaggtcttccccgatgatcggctgtgtgtggcggggcgactgatgagcagagaggaggagatattagggatgggggagagattaaaggggaaaggggtgggggaggagggatctgtacctttggaggggtagcacagttggtgtgctagcgacgacgaccgagctcattttaggcgtagggggcggcgacttccctggtgatagggcaccgcggttgaggcgtggcggcggaaggcgaaggaggaggtgtggcagcagaaggaggaggaggcgcggcggcggaaggaggaggaggtggtggggcggcggaaggcggaggaggagacgcggtggcggaaggaggaggaggaggcgcggcgacagaaggcggaggaggaggcacgacggcagaaggcaaaggaggaggcgcgggcggtctgggcgacggttttttttttttggcgatttggtgaagagaaggattgagaagcgctaatcgcagtgttaatcccaccaaacaactcgtgccttttatattagtctagatataacaccattttaagtgtttatgatttattctttttttggaaaaaaaaacaaggagttcaagtttaaatatgagtactgtctggtgccatttataattgaatagagggaatatttttctgtgatggcaaagtccaagcaaaccctaaaaatgaaagaagtaagagaaaacatcattgcaatgtctgttgcttgcacttttttgcaagttgtgggtgtgtctgtttctgtcaaaatgtagcctggtaccatgatgaaaat

SEQ ID NO: 36257 - DNA, 6280 bp, Oryza sativa
gcggccggtctggcgacggtttttttttttggcgatttggtgaagagaaggattgagaagcgctaatcgcagtgttaatcccaccaaacaactcgtgccttttatattagtctagatatacaccattttaagtgtttaagaattattcttttttgggaaaaaaaacaaggagttcaagtttaaatatgagtactgtctggtgccatttataattgaatagagggaatatttttctgtgatggcaaagtccaagcaaaccctaaaaatgaaagaagtaagagaaaacatcattgcaatgtctgttgcttgcacttttttgcaagttgtgggtgtgtctgtttctgtcaaaatgtagcctggtaccatgatgaaaattaggatatatacatgtgtgcaagtgtgtttgtggtacaggtggacttgattaatcaaaagcattcaggtctgcttaattccaggtgatcacaaaacttggtgtgcgaaactggaaccatggtagtttggttgataactttcattaattttgacaatttgaccctttacaaaaactaattttacaaatgaaccgccgccaaacttatttcaaaagtgaccctttttctcagcgccaagtcgtgtagtgctgaacttagacacctcagcgccacatcacctggcgctgaataccgtgccaccatggaaggctgagtcagtgtgccaacgcacactcagcaccgagctatttggcgctgaggtgtctaaattcagcgtcacaggatttggcgctgaacaaaaaggttatttttgaaataagttttgatgatggttcatttgtaaaattagtttttgcaaagggtcaaattgtcaaaattaatggataactttgtatgcctactattgtcgccctagaggcctagaagattgacagacaggtactccttgatttcgtgttgcagcagtcttgagccaagtctagttcatcccggcagtgaattccccgttgccatctataatccttctacgacacgaaaacaaggggaaaatataatataaataaatcaaagacttggcatacgaatatatcatgtctatataatagattgtttggttagctcaatagaaaagagcagaacctgaatcaagatgtacatggaaatcagcaagttattacagatggatcggcagtctttattatacaaatgctgtgtttagttcacgctaaaattggaagtttggttgaaattggaacgatgtgacggaaaagttggaagtttatgtgtgtaggaaagttttgatgtgatggaaaagttggaagtttgaagaaatattttggaactaaacacagcgaaaagtaacaataataaagaaggaaaataataaatcacaaactaccttgtagtgtgtccaactgtcatctcatcacctgtagtcctccatatctaattgcaaagaatgtgacgtgatgttaggatacacatgtatgtatttaagctagattaaaggtcaatgacatgtcaagcaggaaggatttgcacagcgaaggcacatttcaataccatatcacgctctgcctaacatctagcccaacaaaggtaggagtatgaaacactatgtatgactttactgcagagtaatattatagcatctatatgtgaatcaaaactagtagcatatattcattggcagcatttctgaacagtgaggagtccgtttccaaatataagcatttctagattgtttagcaggaataaaggtttgagaaatgcttatattgcatacaaaatatgaattctagaatgcttatatttgggaatgtaacgattagctagtaggaatctaggcagggatcggaattttagatgaaaataaaatgagaactgagcaggaaagtgtatatgccttgtttcctggtagaccatgctacatgatttcttagtttcgtttaactttttgtatgtcttttttttctctagaatttggatgtttccttagcatgaaaataagaagttcattgacaaagcaattagattgaccaaaacctgccagtatttagaatggtgtctccaggttctctggagcaaggaagagaatggagctaatatgcatcaataccagagtaagtttactaaccatttttactggctcttgaatgatgtcgtagtaacaatggctatagtatcttgtctccatccaaaactgacaaaatgaacgaacatgaataaaacataaataaatataatagaaccaataggcaaattgtgagaagtgcgcatttcaataccagatcacgatcttccatccatctacagaatgctccatcaacaacctgaaacaaaccaataaatgacaatataaggacttgtttcacaaggaaaatctactagttcaaggagatgacttatcctaccacagagaaagcatcatcccaagtgctatccttcatatttaacatttcccgataatcctgatatttaacacattgaatcaggtttcactattttagttaacagacaaacgatggtgaggcatgagaaaagatcagaccataattccacgaataacataatattttggaaggtgaatcccagcaaagacatgctcattgaattcgtccacaagttctgaaaagtgttcgttttcctataaatgcaagcacacaaaaaataaaacatagaattaggtaaagcatttattgattttgcatgcactataaagcaaaagtaaaacactatttagtgccataagtacccattcaatagaatcatcatccacactgaagaaaccttctgcctcaagctcacatatcaaactttcaagtctatctctatgctgaaaatttatacaatcacaattagctagtaatgagaccatatccaagcttatatatttgccacttcagatagggtgctatagcatgttaaatacatatagtgatacaaattaccttcactccgtgattaagtaacatcaagaatgtagtaatttgagggaaaaaaaacttgagataattttagtgaacattaaggacaagcaagacagaacagatagatcacatacctgtaaatttatgacagcacttttcatgtgtttgcaatataagcataattgatcttgcttactgagaagtttagctcgtcgctgtaagagggcactaacatgtaagggacagttctcatgaaaatacttttgaaataatttgtgaaaaatgaaaatacgtcaagaaaatagtacctcatatgacaatttcaggagatcgtaatccagatctgtaaactgactacgcaaaatatcatcatcaagaataatcttaatgaaatcatcctgaaaatcattggtacaacaaataacaaacagttgagcagaatgtgtagtcctgtttttgcacgtacagtaagtttatgatatttccctacctttgaagaactagtccgacggacaaaatcatctaatgcaccagaagccaaatgtatatcaaatgcttcatgcaacctagtttgttcttttaccctgtcatactggtggagaaacaacactttcaggacaagaacggtggccaaactgaaacatcaagagcaagactaaactagtggctcattatttcaactttacatactatattttaataaagtatgttcttacaaaaccatggtcataccaaaagtaaattgaagaatcaatccaatggtttcggctaaaaaactaacatgtttgaatactgaaacatgtttgggtcttatataactgaagagggtatgttgtttgtaaaatggtaacaagggcatgcaaccaccaaattttgaaaaatttcaatgctttgaagtggggagttaacaagaatatacagtgaggagtcaaaccacttgcaaatgccttaatgctaacaaagaatatcaaatatgttcagatatctgccatgtaaagtgaggagttaacctagcgtctggttcaaattccatttgaaccattgtgtttcatacaagtttaacaaaacaagtcgtgaatgttttagagacatgataaagttctgtttattagctagcaaccacaaagatcagtatgcagctattaccaaattaggtaaaggcaacaatatcttacttgctagcagctccatttttttttagcaattgtacatatgactcagctacaaagtacaaaccttatgttgtgcattgctatctaacaaatccatacatgatttgctacttgctaagtaaacaagaactgaacatgctacttgaccatatggtgatttatggtgattttaaattatttgctacaaactatttcatagcaaataacatcgaagctactgctatgatcgtcttaatgcttctagagaagccagcaacaacaacaataaaatgcctagcagctaggagctagtagcataacaatatatgcaagggagtgaatagcatctaggcagaattgttaattttgcgatgaaaagcacaaatatgcttgacattagtattaataggattgtatagcataccccagaccttgcgttcttgacctcaatgtaattctgtgcataaggttgtagatgcagcaaaaagtcgcttgagacaggctggaaggactgcagagaagaacactagtttcaatgagtactcaagaacatgataactcaaaggtgaagcatagctgcacgaaatgaatatattcctgagaagatgaaaactgtaaagtatacctgaacatgatgaatatcttcccgagaagttaataggcaagctatttcacgtagcatttccttgtcatcctgcataatgagctcacatttaatttattaatttaaggaatatagaaaaaaacatgtaattttttgtaagttacctgacgtatcagaggatggaactgaggctcccaggaatctaatattctacagaagagctgaaagaggagtaatttggccaatattcaaaagagtgcatttaagcattagcatacatgttaaaatcctacctcaagtgtctcctgcctacaaaatccaggaagtgcagaccaaacctctgaatcgtcctccacaagttcttgcacgctctcatcataaccagaacactgcacaacatccaaatacatacacatcatggtgtttctgctaggtgtagtaccatcttaacttgctaagggtacaggacaatacacgtaccttaatatagggtttaaatgtgataagtttacaaaaaaacttgtatttttgttcagtctctctcttgcaatacactgaagttactttacgcttcagaaagagccaaaataaataatcagaatgtgcacgcatatactcacacacccacccacagatatacttgcaagcacatcaatatacttactgacagcatagttgacatggcccatgcatgagaaattgcacaacaatcagtatcatgcttggacacaaatttaataggagaactaagataacaatcctgcaaacaggtaaaaagattattaaattaaaaaaaggtaaacaaactatcatattgtacttcaatactctctttgtcagtaacacatacagagcaagtactaaacatatctcacaaaaataaaaatgtatatatatttacttcagacatatgcaactttcagattttacataataaatttctaatgcggaagtgaactatgattagtttattttcagacagagaaaacatgtgcataaattaaatttctaatgcggaagtgaactatgattagtttattttcagacatagagaaaacatgtgcataaattaaatttctaatgcgcaagtgaactatgattagtttattttcaaaattagtgcaatgcagtggcttttgtgcaacacagtggtttgaacattaagaaaatgaataattcaaaccattggagtatcttattttctgatgctagcatcttttatcacagtacgcagtgccgtatattgacaggtgcaacctgtgcatatgttcaggccccccaaaaaaaataggacccccaaatccacaattagtattatttatctatgcctaattagcaacaaattacagggaaacagataaaaaaataagccccaaaagaatacaaggcctaatcccatccctaatgcttatactatttgatactttgttttgttatcagctacaactttgccaactcctctttttttcctaataacaattactgatttctaaagtgtgaagttcgtccactctccgttgttcgcagaagcaacatggcagcaacactataatcaatcagcaatttcatatagtagcaatttcgtaataaaagagttataaaatctcgcagcaagcgtgcaag

SEQ ID NO: 36258 - DNA, 1074 bp, Oryza sativa
taatgcggggcaacaagtatcagtttcccaactcaaatacatgtgtaccaggtcaaaaaaaattacacatgtgccactgtgccaacattataaccacaactcacttatgcatttctttaattgaaagaacattttttacgtataaataattacctccattgtatcaccaatttcatccactttgtgcaacatatcaacataggtatgaagataagctataaattcttcttcaatctgattggagaatatatatatatatatatatatatattggtcaagtaaggaaaaaattcattcaaaatcatgagcatcaaggtagaaaaccaaaaatagaagaacaagaagaaatacctcccagatccacaccatgtcttgaagttcatcagaagatgtgtatttataacgagccactatcatttgctttgacagccaatcttcaaatatttctgcagtgtttccattgcgttcaccttcctgtgctgatccctaaaataaaaaaaaatgcttgagttgagtaaatgagttccttggcctaaaagaacaaatgtgccaatataagcactataaatattgcccaatactaataattatattaatatgacattgcttacaaaaggcatagaactcacatatatcaacccagataacaaataatggcagctgccaaaatggagggagtacaagaattgcatgctaatgaattacctggctctgcatacaatggtatgcatcttcacaaagaagataaagagcattgttatctgacttcggctcgagggttaagcattgtacaatctttggaagtatatcatcttgaacaaaatatagaagttcatcattgtgcgtagcaatagcaagttggatcaaactatgacaaaatggtgcagctataatccttgcttcaccatccttccaatagccaaagatataattgattaaccttagtattgaagatctaatgttatcatggcataaaagatacctacatgtgaaataattcaagtgttatttatattctaaaatacaataaaataactgcacaaaatctcaaaatatactattgtcgttgtaagc

SEQ ID NO: 36259 - DNA, 241 bp, Oryza sativa
  unsure (1)..(241): unsure at all n locations
gttccccgacgctgtgtcacctgtaaccggaaattaaatggaatcattagtaattgcaaaaaaattaacaaatgaatacgaagactcgttagtaattccctgacgctgtgtcacctgtgaccgactgaccccggataggaagacccaggatcatggcgacgtcctccagagtgaccgtcagnnnnnnnnnnnnnnnnnnnnnnnnnnnnnnnnnnnnnnnnnnnnnnnnnnnnnnnnnnnn

SEQ ID NO: 36260 - DNA, 1640 bp, Oryza sativa
cccgccggcgtcgtggtcgagacgggccgggctgcgagatatccggctgtgacactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatgacattgaaatgaaataatatacaacattaatgctagaaactaaccactctgtcacgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgacccaactggaagcctcatccacattcaaacctgtgtcacatacgttagcttccaacatgttagcaagaaattgaaatgttatgaaacataacatgcatgaacttacctgtagcaaccaaacacagcctgctaggttcgcgtccccgccttgccttcggcaagcatcacagagttgtcggtacaaccaggctagggcagccgacccccagctgaaggtacccgcctcgtcccagtccacgagcaacggc

SEQ ID NO: 36261 - DNA, 1539 bp, Oryza sativa
  unsure (1)..(1539): unsure at all n locations
ccttcttgtccttcttcttcctcgtgtgttgttctttaacgacaagtcgggcacgaagaactctccatcataacttggccaatgcgatggatctaggtaaggttcaaacctaggggagtacgagtcctgcacagccttattggaagcttcataacacattcggggggccacctccacatccaaacctcgcaacttacaaacggttatcatgtgagagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctntgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggccttctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacaagttgatgaaccactcccagttggatgtattctccttctctaccagagcaaacgccaagggaacaagatgtaacccggcgtcgacccctattgccatgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcaggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgctcaactgcctcgacaatcgctgctggagataaagttggttcagctcgcacaaatgcctgtaacctgtttccaataaaccttgaagtaagttgcaaatgtttgccggttacttccgcactacagcatgtgtggtcttcgcccaccctagtcacccgccacctatctcctccactcttccttg

SEQ ID NO: 36262 - DNA, 248 bp, Oryza sativa
ggacctcagcgccagccataatggcgctgaccgtgggacaggcgctgaggtgggacttggccgtttcggccatggcccagcccagcaagccttctggatggcttgcgggctgggacctcagcgccagccaaaatggcgctgaccttggaaactcagcgccagccaacctggcgctgaggtgggacttgcccgtttcggccttggcccagcccagcaagccttctggatggttgcgggctaggacctca

SEQ ID NO: 36263 - DNA, 213 bp, Oryza sativa
gtattgccattgatatatttttttcagacacacaatgttgccaaggaattgatgaagtatcactcacaaactcttggatatattattggcggtaatggccggagaggtgaagcagatcagcttgcaaagggagtcaatttattagttgctacaccaggcaggcttttggaccatctgcagaataccaagggattcatatatagacggctaaag

SEQ ID NO: 36264 - DNA, 751 bp, Oryza sativa
ttagtctagcactcgagattgttgagaaatgagaatgaaatcgtgtgccaattcattgctggtatcctgaatcctgatgtttgcaattgacagcgttctacaaaatgtataaagacgggtgggctatttatgtcagactaccactccattgtcttcatcttgtcgttcagctgcatccttcttggccttggcctcgtgcaacgcgttcaccagcctcgcgaggcaggcgccggcgtcgtcccgggggttcttggccgtgaggtgctcgccgacgtcggccggcaccaggtccacctccggcagcagcctctcgacggcggcgaacatctcgtggtcgtcgacgtcgaggtggatcttggccatggacttgaacgtctcgaagtcgcagtaggacatctcgatcttcttgtccatcctccccgtcctgatcagcgccgggtccaggtcctcgacgtggttcgtcgtcagcacgatcagccgctcctccccgaacgccgaccacagcccgtcgatgaagtttagcagcccggacagcgtcaccttgctgtcgccgccgacgccgccgccgccgccgccgcgatcgatcagttgctggagcagtcgacgtcctcgatgacgatgatggacttgctggtggtctggatgagcagcttgcggaggtcggtgttggtgtgcaccgacgtgagctccatgtcgtagacgtcgtagccgaggtagttggccatgggtaccgagctcgaattcgccctat

SEQ ID NO: 36265 - DNA, 13306 bp, Oryza sativa
cactccacttcttgtgtgccgagcttcgttcggttcatgtctgaataattagtggcaactttagccttctaaagcttgcatgcctgcaggtcgaaactagccccgctgctgctcaccatgacacacaagagagagcgtggaataaagttcgtaacatgatactgtaacgcgacgaagaataataggcatggaaaattacgtactataaaccacgtctgtaataaaaaattgaaaactactgttagataaaaataaacgtttgagatttccccacgtcaccaagagtaaaaatattactgcaatatgaaagtaaaatttttacttttataccgtggacaaatcttatacatccatatattttaatcaaatgatagtttttaggttttcattacatgtggtttacaacacatatttttctaaataagctagtcttatatttgcacagggggtccggtctaaggggaaaaaggctcagaattgtttgtcgtcttatagcattcaattcgacaaagaaccataaaaaatgcagccacatcaaaacttgcctgataaaagaattttcatcaacgaaaaactaatttacaagtaaagtccgtgggtgaaaatggagtgtccagatgagatgggacaaaatgaaaagagagaaaaaaaagttgacgttagcaccctaagcccagaaaaggccgaattgcagatccacgaaaggcgccataacccagcccatccatatgctatgggccatgatctcagcctatccaaataaggcccaagtaaaataatctgtccgtaccagcccacgaatagcccacgaactatccaaaggcagtagagcccttcgcctcccggccgcctcgacgcatcgacgacgccggcgaccaggagatcccgcggccatgccgccgccgccgccgccgcatcccctcccctcaccatgccgccgacgccgctgcatcttgctcctcctgctctccaggctgctgctctcttcagcaagcaggtcggtccccttcctctgccacgatccacgctgcctcaccgtgctgtttctcaacctccccgtgtgtgtgtgttttgccctgcagcttggaggaggggagggtcctcaccgtcggcgaggagctgatgggtgagacgatgccgctgcgccacggaagccggctgtacaggctcgacgggacgcggccgtccgcgtggtacgaagtcaagatctcctacccggcctccgtacgaactgactgacccccattggttcagaaaactagggaaatgaggcctccttgtttcaccattgatgcttcttcttgttcttgaaggcatttttgtgcttttagataccgtcgagcttctcgatccggcttgtggacgatcctcactctgtggaggatttggggagcatgaacaggaggttgctcaacacggagaagataattttcaaggctcagagcagcaggccagtatgtgttcataattcttcagctatatttgttgcttgcccgcagaattggactggcatacataatttatagtggctgtgtgatattgattttaggtttatgttcttgtcacggtggagcctgaaggggtagttgcaaagccaaatgtgccggagagagagcttgcgatgttcaacattggtacgatagtatggttctttatgttatgttttttccttcaatgataatgaaatcagatcgatcgaagcaagacagaaattttagaaactctaatgaagtacttttgttgttgggttatggtagcattaggtgtatattctcagagttggttagtcctgtgaatatcgtgatcccataggatgaattttgaatagaggcttaagcaacctcatgcatttcaacctttgatgtagtgctcaatttttgtcacttccctgttcgtctaggaagtagaggatagcctgagggtgtgaagatcaaatgatcaattctaataggcttgatgcaacagttgtaatttcaccttctttttacaataattttgcaaacttcacaatagccaaatatctcattggtgtggagaaagtagatgatatgcagccaggatatataaatgaaagaaattaaggcacttgtagtagccatggctaaccaaaggcaagggttcattcactaacctagcagatggcttcagctccttagttttgtttttagttttcaccttttgaattttgacatggaacctctgtgtccttatgctgtttgcatagacttatttgatgctagtgtacacttttttaatgaaattggtgtgtggaattttggcttttctagttagtttggtgcttttctgctaatagctactgtcatttaagaaagggggaagtaagaaccaacttgttcttatgttcagcaattataagaaattcgttagagtcattccttggagttgggactagagtccaatgttgtgattatggtttggagtttagacatattacctaatctataactcttgtcacgtcctaattgcatatgtagttatccaaatttctgcctcattgataagcatttgtaccccttttttttcatcttgtgacaaagatgcctgaacttcagttggagaatggtattttgtctactgtagagcattttttttgtggatttgaaatccataactacggttgagaaggaaccttgagaaagcttgatctaagataaaatacttatttatcattgatgcttttttagttacttgtcctttagtatttggattgcatctacttttgttttacagtcattttgtgttatttctatctgactgacctaaagcttttaaatattactttgatttgattctgcttcaaggatttgtgtttatgctttgacaaagcacctagtcaatcagaaatatctagaacatcttctggtcgtacaccaagaccttggttgtaggtttctactgaactttcagtgtctaatgccgaaactgaaaatgttattctcgcccatccaaggtcatgagattaatatcaatctgtaaaactttagtctctggttggccagttaactgcatgaccattgatttctgttgataaattatttacttcacattttatgtataatttactttggaaactgtatgctctaagaaatatgtctgattaggtagttttgctgcccttccttgcttctggatattatcgcctatgctccttaacctttcatccggttcaagcattgaaataacacctttgatcagagcggtgttttgtttgtaattatttcttttgtgcagtttgcgacgaacttatgcttgggatcccacattttgcctggtgggttggaattggatctctgttctgtattgcgctggcatctgtggctccctattttctccctctgcacaagctacttaactacgaagccacagaactgagtgatgactttgcggctaagctctcatgatagatggaagtgtgctgaatgatagaaatgtttcattttgcagagtaggctattgtacaggcacctagctcttttttcctttccatcagatgcagctgtgtacaagtatttactgtaccttgcaatacaatggtagattcattcatttcgatcttgtaagattggttccgtgatgggctctagtttactttgttttttcccggaaaaggctatacatactaactttttctctctaaattcttagtagcgccgatgtgtcatgttacgagtgtatttagatttatttattttttataactttcacctatctaaatcaaatggttgagatgattacttgttttctccaactgaatgaactgctaaaaggacagttttatgccgttttctcgaatgtgcttgttgaccggacaataaaaacatattctgtggaacaaacagtagcgaatttatatcagcatactgatatgatacccacaagagatactgagttttcaggtgatcaaaacaaggacagattggaagactccttttaaagcattgatgccaacgtttcttacaacgacatcaaagaagagacaactgaattattgccagcacacttacaagctacagtgtagcactaaaacgagaaaaggaacatcgtctgacctgagactctcagaggtgagagggaaggccacgaaaaacattggaggatctatctcccgttctccgtgagctcctgacgcgaagcactaaaatatatgagactggaacttgaaccacatcaaagttttcattccggcacggcatccgccaactgcaaaccacccttacaatgacgtggtgtgtccccgcgtgtaaccgtgaggttgtgttctatctagtatttggttgttatagtttaaaatagaggaagtaaaaaatatataactttgaaagaaagtaagttgcacttgctcgactcggattagctcggctagttagttcattgacaaaaaatagtcttaaatgataacaagccataaagagactaatttcaaaggatgttaaatgaaaaggtgaatatgtagagaagcgttcaagctaagtatgtgtacagtcctcatctccttcttggcgtttagattaagatttatgcataaacatttgttaaagatcctcttctactaaacatcggtaagcatcctcttctcctagtagatggcaagattattaaatattgtgagaaacacattaagaaaaatacttttgataagcacatcattaaacatctactactatgttggagatgaccatcagccaagcaagcatcttcctggcgactcgcctgctcaattctccgtcgctttcggtgcagtttgccattgatacacacagttacggccagccagggctctctgtcatgtcgtcattaacgtctgatcgagccgtgtaaccacaccttggtctgagtttatttatatttatatattttaatcagcatgtgttttgagtactacagtactatgctaccacttccacaattaaagctgcatatgcgtacacatctttctgtttccgaaaaatagatggacagttggaaaccctgtgtttggaatgttcgacggatttgattgatatctacgtgtaaccaacacatcacctccgtatattcggttaacagttactagtaataactatacatactgtctccgtaaatattacaaagttataaatacatttaaccattaatttttaaaatttcgtatggtttaataaaatgtaagtttgaaagtatttattgtggtgagtctaaaaatataattcttgtgattgttgagttttatgagcttacaagaactgatagtcaaagattaaaattttggatttagaataaatttaaaatgataagtaattttaaaaggagggagtagctaaaaagatcctagcttttgaagttaataactgatatatatatatatatatatatatatatatatatatatatatatatatatatatccaagataatattgatggagtttattttctcttgcaaatgttccagccttgttcccgaggcacatgtgcacatactccctccgttccatattataatgtattttggatggatacgacacatcctattactacgaatttgatcatactctctatctagatttgtagtaaacgtgtcatattcacccaaaatactttataattgggacgaagggagtacatcactatacatgtccacgtgatggtgtattgggttggtcaatatcacacctctggatagtagcgttcatcgctggaaatccatttatcaacgtcaagaaaaaccatccaatcctccatgctgaatattgttgatgtgtgtgtgttatgaaaacagcctgtaaccactagcttgcttgttccaggatagcactgaatcaattgtttctgatctcttgcattcaagtcctgttttaatttattccaaaaaaagaaatgttattttttttacccttattaatgttaattagcgtccacaagccctagtaggcagtagcgccttatactatccagtttaaaatgttggcttgaaactacagatataccttatagcaagttcaatagtatatcccactgctagctccaattcagctatagccaatctaatagccaattcatacaatagttgcttactatactattcatatatggtcccatctgtcatacacacactgtgtcttggagtccgtgctacagctggttacagatctgtagcttgctgctcttctctctcatcttctatctcattaaaatatgtttatagctggctaatagtgtgctattgtacctgctcttataaactagtactcccttcaactcaaaatgggcctgttcagcataccggctgcaaacaggtgaggctgcggctgcgaacagtgagtgcgcgcgcccgacagctgaacatgcccactattacaatttctatcgtctaaattttgttctagaacatagtattttctcactgtattttcttacctcaaccaatcacgataattctcatttactctctttacatgctacctcatttgaagtaatcacaatcattcaaatataatcctgttcttctctatgctccctgcgaaaagctttataatacatgtattttgtgatggagggatagtaaatacatctcgtattaacgccacagctgcaatgtcccatggtgtgtggcatggtgtcaaaatcaaatgtaagaccgaccatggacataaccatgatgcgtcaagatcagcttttgaagcaccgttagtacagtgataggacagaggttagagcatccttctccaagcaacaaactataaattaactttcatgttgggagaattaatcaatggttctagcaataaactctcaagttgcagtattgcaccaaagttcaaccagaaattagatagaccagattattaattactagtttgcagcccatcacgatcgaattgaagccagtggattgatcggtgaaaggcagggatccattgttttgaggctaatttgaacatagctagctggctttgcccgttttgctgctgcatatatataatattaggtgaaaccccgcgcattgctgcgggaatttggtatgataacaataaaaaaataacgtgtaagatagctagttaacatcaaattaagtaaattaatgtagtttatgataatttaaatttaaacagtatgtagaatagtgattcaaacgtaaaaagtaaggtggtatgactttatagaaaaagaaaagtagggaaatggtttggaccatagattaatcatctaaaggctaaaaacaattgatgtaatatgacttaattagagggaaaaaggagaaatataatttggaccatagattaatcatttaagcactaagtaaggatgaactacataggtatataggatatcataaaacataataaaaatatacattgaaacattatgtgaattatattagatgataatttaacatgtttgtatttgaaaagctcttacattataaaaactataaagatatagcatgtttgcatgatgtttaaatggtgacgattgttagtggatgatgatgtggcatcttgttaattagtggattggtggatgatgatgtggcattttgttagtggatgatgatgtagcatctttgcatgttaagcttaaggagttagtgggggataattttatagtaagataggatacatcacgagttgcacgatgcacacattcgtgcgagtctgaaacataagaccatctgctaattaaaagcttagccggacgaacgggtgggaggagcagtgccattaacgactaaaaatttgcaatcacgttttaatatccctaatattatacaatatacgcttaatatcctgtttgacatagctccaaatcttatattctttgctagattatattgtaaattaatttataacggtttgaaattttatactttctataaagtatgaataaaatgatcattattaaaatactatcaatctaatcacaaatttagatccatgaatttttgtagttatgaatgttcaattataagaaatcttgaatatagagctatactaaaataatcttaatttactgaatcaatacatagcattaagcgaaatgatgtaaagtaaactaacagtcaaagcttgattttggcggtcaaaataagccatatatttctagatggagggagtaggtggcatagtgttaatagccagctttagacgaaaatgttcataacatttttattttatcccttttaattgggtaaaaaaattgggtggtcgatatcatgttttaaaaacggagggattgggaacccctcccctccacacagaaaacggagcgatagattaacacgtgattaattaaatattagctataaaaaaatttaaaatggattaatatgatttcttaaagcaactttcctatataaactttttgtaaaatgtgtaccgtttagcagtttgaaaagtgtgcacatgcaaaacgagggagatgggttgggaacccatgggaaataacacaacattattaacttcaaaaacaaaacctatacaacattgttttccaaccagagaaagtatataggcatatggtgtaataactattttctccgttccctaaaaaccaacatagtactaaatatgacacatcctactattacgaatataaagatatatatgtctagatttatttgtgctagaatgtgttatatccaattcgttctttttttatgagaccaatggagtacttatggagattagaaactagtactagatttggcaatggcaagtagtacaaaagggtagaagaagatgaataatacttatgcttcggtgatgtcctgttccggtttctgcttcagttggacacgagttgctgtgtacagtaatgttcttgatggcagggttcatgcatcaagccatcaacccaaaatgaaagtaagctcatgcatctctccgttggcgtcgacagtatccaaatcaaatcaccagtagatatatgcaatatatgcaatgcaatgcacgcgtgttggagtatggtttaggtcaaatccagcagtgcggatatagtaaccggccttatatgttcggttgctagtgcaccggccatttatgtactgcaaacgcgacaaacctgatcagcatcagatcaactgttcagctatagtttcaacaaccgaacacggattcaattctcaaaggggtctagttagaacaagatacagaggaaggatcccatggcttgaaatatatttgttaatgcgatgtgtatgtatgcagtactgcagagccagcaccgtcgtaaaactcgggtgactagtaacattttctggtggccgactaatttttatacgcatcgacagctaatggtaatggaaacgatagcggcagagctcaggcggccacctaatctacccgggagctatctccgccgctatatatattcttttctataaataaatgattcttgtgggttttttactatggtgtaagaaatttttgacagagtattgtttccatgaggatggtaatgattctgatttagttgtatataaaatttaatgtttctaatttcgatcaatttcatataattgaattaccaaatataaaaaagttctaaccaatcaagaaccgttttcgtaattatcatttccgacatttccataccatactcacaggatagatcctgatcctgctagctaggagtagaagatgaagagaaagacagaaacaggcccgaacaaccaattaaaaccactccataattaaattaagtagtaagctggagtacaatccatccattgatcaccatgttgagagactattgcccaggtaagccaatacggcaataccacagccacacgcgcgcgcggagctcctaacgattgtccggtgaagaaattaactatcttctgccattccgtattttccgttgcttctcgttgcacgcacgcgtcacacgagcacggctacctagcctgccacgaccgtacattggcacatggattacgtgccgcttcatccactggcctccagacctccacgtcgtctcgctcgatcgatctcctctcttctccgctctccttgaaccttctttcttccatgatgagtacgagtacggcgcccagtgtgaaatgccccccacaaactgcgtgagaatttaatatttgccactctatcaaactgcctgagaatttaggacctgatcacttttatgacattttcaaccatactattttccttaaagttatcaagaaaatatatacgtttagtttgttgccaaatttaatcaatacaataataaatcctaccaaaattttagcaatatattaccatcttgctaaaacttggtaaggtttattttgactacaatctaaatagacccttactatttggtactctataggtccggtggtatttagaaataagaatttagaaaagtggcatttgagcaatggtattttgatacagtggcaaaaaataaaaagcccccccccccccccccccccccaaaaaaaaaacccacgcaccccaaaaacaccacaaactgcacgaccagcaacacacacgcacgcaatctagcgatctccccaactaaccccattaactgatcacccgtcgactgatccctccaaagattgtaccaccattaatcacccttcatcattaattaattttcctcgacaaaaatgttactcaatccatccaattctaagcgagtaactttttactatcttattttaaatttacgagtttccgtgtcgaattttgatcgtatatcttattttaaactttttatggttagtatttttattattattagatgataaaatataaataatactttatacgtaacttatgttttaaattttttaaataaaataaatgattaaaattgaacataaaaacacattattatacttagaatgagacgaatggagtaattatgtttcttcactaattaagctgaccaatcgccagtgctcacacccactctcctagcctagctagtatctatatatagacgcatataaccacacgcaagaagcatccattccgatattccatcgatcgatcacgtcgcaaacacacacagtacacacgcaagctacctagcgatagcaatggcggcggcggcgagatggtgggtggcggcggtggtggtggcggtggcggcgatggcgggggcggcgaagggggacttcgcggcggacaaggcggagtgcgcggacaagctgatggcgctggcgacgtgcctgacgtacgtggaggagaaggcgacggcgagggcgccgacgagggattgctgcgccgggcttgggcaggtggtcgccggcagcaagaagtgcctgtgcgtgctcgtcaaggaccgcgacgagccggcgctgggcttccgcatcaacgtcacccgcgccatggacctcccctccggctgctccatcgccgccaccttctccgactgcccaagtacatcacattttacactttatttaatcatcatcaattgattgatttattaattagttaactaacaccgccttaattagtttgttagctagtttggttgatgccatgccggccgctttgtttgcttactatccgtcttagacaaaatttaaatggtttttaatcgtattctattttctagccttgcctttgaaacggctaacgatgcagatatttgaagggaaggatatccctccaaatatttttttaagagaaaattatgggcgtgttaagaattaaacataagatatcggattaaaatcactatctcttaccacttcactatttagaaatttcttttacttataaaatattgtgattgctctgtctatttttttactatgatcgtcggctgtagttcaacttcatagctttgcattgcatggacgtgctcaatcaagtttgcttcgtgcatgctgcaaattaatcggtttaattttttttaaaacaatggatagatatccggtttctatatccacaagcgaacatatacaaccaaaatgggtatggatggtataatttagttttggatgttgttcctgtacagtaggagtacaactacatcgatctcgatctggcgaattgaatgaaacactaacctggagtggtgctggaccatgcttgcttgttagaactgtacactactatgattagctttttgtcgtgcttgcacaccgtacagtaacacgtacgttaattgcacggtgcaagcagggtccggtcgatcgaccaaataattaagtactttctagagcaatttgctacagaaatcagaccacctctgcttcaggaatcaatactttcttcatttgatatcatcattgccatgcctttttttgcttctgttgatctgttcgtgattaattcgtcggtaattagcatgactgaactaactgcttgttactaatttggatcgatggccatgtatatatgcagagatgctgaacatgtcgcctgactccaaggaggcagagatcttcaagcagtacgcgagggagcacgagtccaacaacgccaccaagcctgctcctgctgccgctgctgctgccaccggtaataatcattaatcaatctctgatcgatcaaacaataatcctcttaattacactaccaagaagaaataatagtaatcagatgacagataatgcatctgtctaaatcttgagttaattaatcagtagtactataaataataatgatgctaaatcgagagagagagagagaattctgagctttctgcttgcatgtgcgagctaacgacatgtagcacggtgaagtgccatgccgtgcatgatagcaagagttatgtcgagaaagctacagcaaacgctacactagctgctgcattgaagcttcgatgtagaaagcgtagtgccatgagaaatcaatgccacactcctccgtagtaaccgccacgcatggccaacccgtccatccaaccgaaactgctgcctgtactgtactgtacgctggagactgtacccaaaacttgcagcagcagtagaccagaagtccagaataccggaccatgcagctgcggcatgtttggcttcatgactaaaaacgtggagaagatccctagtttttcacgcgcacatttaacatactactaaacggtgtgttttttctaataacaatatataaaatgttttaaaaaattatattaattattttttaagtttaaaataattaatatccaatcaatcatacgttaattgttcatttcattttatatatcttttcaatcttatattggacagcttaggacttcttaggaacatatgaatttcacaggaactgttcatttcctcctaaaagtttcttaagatgaattcctccatttcgttttactaatctgaaagactggtaattgca

SEQ ID NO: 36266 - DNA, 7602 bp, Oryza sativa
  unsure (1)..(7602): unsure at all n locations
ccacattttcagaggcgtgtggagcaaataattcacatcaacaatacgattaaaaagagagaaaaaaaatagatgctggagggataaactcttcagcatatgtgagaaactgagaaaccatgagttggtgtgctcaggcgagcatggagcgaagaacagtcgttttttcctcaaacgtttttcgtgtttacgttttccaaactgttaaatgatatattttttaaaaaaaatctatagaaaagttattttaaaatatcacaataatccatttttctattaatacttaattaactatatgctaatgagtcgttttgttttacgtgtttgggagatgagttcccaactcattgagaagaacacagccgaagtcaggccaaagttttggataatgatggccgtcgggtgactgggcggcgggaggaaaaatcggtcgctcccccctcccccgcccctgcgcacgctgatgtcgctggccccaccacaatacctgtccccacctgtaacaaatcaaccacatattttgaaaaccctctattaaggaattttggtttattttttgttccataaaaaatatttcacctagtgtacttacaaggtttcactatgtatatatctaatgttgcagtgaactgaaatattccattgcaacaaaaaatccacatattttggaaaccccctattaagggaattcgttttattttttgttccacccaaaaatgtttcacctagtgcacttataatgtttcactgtgtatggatcaaatgttgcagtgaactgaaacaatctttcgctatttgctgaaacattgtttttatataaggtgaaacaatacccaatttaaatgagtgaaacattttcgatctacttagtgaaacaattccgatatacttggtggaacatcgtgcaacatttaaaaataattcaataataagcttaaaaaaattgtcgtcggaatatatccacgtgtggtcttgttttgaagatttaattgcaacgaatttaatggtgcaatcggatcataatttggataagtaatttaagagaaaaatcagtttaaattagtttttacacgtaaatcgggcgctgacgtcagcatgacgtcagtgcccgatttttctccaaatcatcgggcgcccgagccgtaggcagcccccaaagttttattatttattaattaatcaacatttgttttacacgtgtatttctatattttgttttctcttaatgcaatggaccaaggccttatgcacaaactaggacacgggcctagtcgcccggcccaccacgtccaagtatgcctcacgctctgcctcgcgccacaggaaagaggaaaggaaaaagtccatttggactcccttaattatacgccgaatcttaagtcgtacccctcaggcctcaaccagaaaaccggataggacgactctatgaactattgaaaccagtgcaatttgactccctcggcggttttgctaatgtggtgctgacgtgacggtgttgacccgatcttcgtcccacgtggcgtctatgtggcattagaattaaaaaaaaatctgtggaacctatttgtcattaaaaaaaactgggtgatactgcaccagctggcgaaccgcaccagccggaacgcctgcccccgccatgccgcacgcggcgaccgccgagccgcagtagtggaacagcgccgccaaatcatcagcgcaacaacggtgacgtcgacgagccgggtgatgagctcctccaaatcatcaccgcgccccggcgccgccatctccatgcccaccgccgcgtgtggcgccgtggcggcagcgtccagcagcagctagttgttgccgtgcacagcgacggcatcgttgaagcgggctgtgagctgctccatctccatgctcgccgaggccaccaccgtcgacgtcgatggatcagaaagctcgaccgctggtgccgagaattgacagtcttggactctggttggcatgctcgatgatcggataaagaagggtttggcttcgtgaatcgtgatgtccgaggagatgacgtcttgcttgctccttttatggcaagaaagcgcgcgtgcgtgcgtcgctgacctgagtccgtctctgtcgtcgggggaggcagcgccgacatcccgagatggagaggccgactcctccctctcgagtgacggagacggaggggtggcccggcggcacgaagaggagctggtccgcggtagcccagaccggcggacggggacagggtcggcctagaggagagatctaggaggcgctctttctcctgctgagtcgagattgataggggtggacaggcagtggaggtcgcggaagccggcgggggtggcggcgttgcaaccggccctcgcccgcccgctgccgccgctctcgtctccggcctcctcggccgcggcggccgccaccagccatgggacgcaccgccgcagttctggccctcgcccgccgccgccgtcgctccagctctccccgcagacggcgaagggggagagaaaggggagagaaagagagataggagatccggtcgcgcggagacgcgtcgctgcatgacctgcggctcgaaggaagagagagaagggagggagaaggaggaggaagaagggttggagagggaggtgggccccacatgtcagtgggttccacaatatatttttgtatgtgaatgatagatgtgtctcacatatattttttaaattctaatgtcacgtaagcatcacgtgggacgaagaccgggtcaataccgtcacgtcagcgacacatcagcaaaatcaccctctaaaaccactgagggagtcaaattacactggtttcaatagttttgggagtcgccatatccggttttctggttgagggatatgaattagattccgcgcacaagtaagaaagtcaaagtggactttttcaaagaggaaacagccaagttggtggcatgattggacaaattatttcacacataagcagaaaactccacaaaaatttacaagccatagaagtttatgagcacagtatgagacgaaatttggagcattttttacatacagaagaaattggtgacttgcgtggtgagagcaacaccatcaatcaaagaagaaaaacaatcacggaatgatcataactggaagagattttcacattagaagagcaaggaaaaaaaaacatgttagtcggatgggacattagtcacagatcaattgtaaatatttctattctagagtgaaacaagtaccgatcaagttcatcttctactccgatgaactccatctgttttattttgttgcgttatagtactagactttaacctacactggcttggctctattaaaacaacatttatgtgatccaaaattataatcttaaataagtacttttaaatataaatctaataaattcaattttacgtcataaagattataccctaatagagcaattgttagccaaagccttgtcgtaacgaaacaaaatacatcatatattccttttgaaaacgggtgcactattttaaaatgacaaactaataaaataacacttaaacatccagttctctaattaacacaggttatcttatcaacatgtcatgctctaataactgtacgtctattgcacagctcaaatcattgtacatcatacatctggaaacccatctgaaacacactaaaaagaatttacatcacatgcctcttttagccacaatagcaagacctctacgttctttgcccaatcagacagcacaagtgaattacacagggtttgaaaagtaattctgggaacactctcttcggaggccatgtagtacccaaccagcaatgctgtcagtactaaggtgtacctttaaaaatatttaactctacgatatcggaaggaaaccgtaaaatttacatggaacatatttggtgcatatgggaagtgagggcacaggcgaaattgtcccatcacaattcttgcccatccaaatctgtcctgacagggtaatcaaggccctgtagaactggcattcttctcaaatcctcttctgagtacgcagggatgaaccaatacctcttgtcatttccaaaaacctggtaacagaacactgtttagttagctttgccttttgttaaagttatgttcacttattcacatgtggctgactgagttcagtagtgatgtcggaatggggtttttcatggcacgcaaaacaagacaagtcattagcgcacgtttaattgagtattaattattacaaacttgaaaaataggttatttgattttttttttaaagaaacttttatataaaaagttgtttttttgcaaaaagcacaccctttagcagtttgagaaagtgctaatggaaaacccggaagttgccaccccctaaactcactaccaaacagggctttaacagataagaattgcaaccttgcagtagaatgcttagcaaaaaaagaaataaaaatgaaaaagaaggcatatttcagatgttgaagataacacatagtactaacttgaattagtactagtgtactaccaggctagcggctttgctgggttatattttagtaatactggccaaagtaaccataagttaaataaatatcatggcccttgagcacctgtaaaatgccacactcgaaatgtatggaactctaaatgacgggcagcttaaaatattagaagtttggaacaatatatacaattttcacaaattagaaatagaagttcaagtaaattcttaatttgccctggaggttgatcacatcccttatctgtccttgcagaaccgctatttggataaggaaaatttggcacttgtatgggaaatgggataataaaatgaggagtgaaaatgggtggatctaccacagaagtctaaattagggggtaaaaggtccacttttgatttctgaactactctggtttacaacctgtactttaataccatttaatttacatcacacaactgttggaattggtgcaaaatgcatccaaagcagctttcttgactggttttgggttttgtggttgccacatcatcatttttttaatacagtatgtcatttattacctcatctggaaaaaaaggagcattaatttccttccgtaaattatttgccacatcagcctatgactctatgcatcatatatatgatgtcatatcatccaagaccactctctaaccatcatatacatgattttgataactggggacgttttctaattagcattggcattcagaatatgacctccctctgtcccaaaataaacaaacctagtacgggatgtgtcacaccctatactacgtttgtttattttggaacaggtggagtaaacaaaagggatagtagaggggccaaaagtatggcttccctctaaaatatctgcatttgtgcatgtcctataatcccacctcatcaaggtgtatcaagcctttaaacaaagataatttcgcgtgcgcttgcaccattacaagaagtaacagattatttaacatgttctgaaagcctaacctgaatgaaattcctcttccggccaatatcatacatccagcgtggcgtagttttcttttcatatgcctaaataaaaaaataatgtaacaaattaatctcaccttggagatatcaaaagtaagtatttaatagacattgataaatacttgagtatttaattatacattctagatacttgcctcaattgttgttgtattagcagaaacaagtgaaacatgcataatcataaaacccagaacactcaaggaaaaggccaggttcaacactgcagagaaaaagaatattataagccaatcctcagtcaaacgtgcccaagaataatttctcatgaatgaaagtaatgcaattaccaaaggtgaggaaagtggttgcaagtgctgcaggacttcctgggatatcaatatcactaaagaaggctatgaagtgaggcaatagagaaagggtaaccagtgttgtctcaaggaaggtgtaaaactgcatggaatcattaaaaacatgaactcagcttcagaaatcaaaggatcgaatagctgtgtggaagaaaaaaggatagtagtccaaaataagtcaaacgaaagcaccaccaaggcagcagcatttatactgccaatattaatatgttattatcagagaagtgaacacactaattactctgatttatatttttttgcattattttcttcactgctatataagtggaatccccaagtagatgagaaaagcaataattaatattcaacaataacacactaattactctgatgcatcaaagccacaaaagccacagaagatgcatatgcagtgggtcagcagcatgacagaggagctaccaactgtttgttggattgcgtctccattagtttagtacttaatatttggttagcttgtttattagcttgtaaacataataatatggaaacgttatgcaccagtgaccaatgacatgtccgatatcaatacatcttcaatacgcctccgatacgtatcgaccaagtattgtaaaattaaatagaaaaaaataattagttttatgttctgatacatggtcgattcatctccggcacatatgacatatgcgatatggcccggcccacatagccacatgataaatcacatccccctacacacccccaccaaagcgccatccttttaggagctaaggattgtccttgaggtacattgtacttgcttgcaatacattattgattattttagttgtaaataattgagaatttgaaagtatttttattaaaatatgtagacgtgtcgccgtatcggtatttttctgaaaatggtgaatccgcagatcggtattgtgtcgtgttgacgcatctatgtccttgcatcatagatccacccctctagctaataacatcgaatagaagaagcattttaagtattcatggtggcttaaattgattatacatttcacgtgcgtgtgtgtggtttggggtgaatggacatagtttgctgtataagatattgatttgtaaacacagtgaataaaaatagactgggcaaaatgaaaccagtctcattgcaaaaagaagggttaaagcaatacaaaaaaaaaaatctgtatagttcgctagcatcacaataaataacagactgtgaatatgttagatataccacaactccagtagttattgaacgaactttttacattttcaccgaggttgtgttacccagagtccctatgaacaatctgcgaggtattcaaacgtcattttttgcatcaacgcgcctggtgaatgatgacaccgctcgctctagctgtcaccgcacgctaccgccctaaggggaagaaggggagagaaagagagagaagggaaacagggaggagaaagcaggtatgacatgtgggccccacatgtcagtgggcccatatttatgactaatgggtcccacgcatattttttatttctatcgctacgttggtgccacgtgtaagaaagactcggtcaatattgccacgtaggtgccatgtggcaccacgtcagcaaaattgcctcccaaaaccgctcagggagttaaattgtaccggttttaggagtttgggggtcgagatatctggnnnnnnnnnnnnnnnnnnnnnnnnnnnnnnnnnnnn

SEQ ID NO: 36267 - DNA, 10991 bp, Oryza sativa
  unsure (1)..(10991): unsure at all n locations
nnnnnnnnnnnnnnnnnnnnnnnnnnnnnnnnnnnnnnnnnnnnnnnnnnnnnnnnnnnnnnnnaattaaatagaaaaaaataattagttttatgttctgatacatggtcgattcatctccggcacatatgacatatgcgatatggcccggcccacatagccacatgataaatcacatccccctacacacccccaccaaagcgccatccttttaggagctaaggattgtccttgaggtacattgtacttgcttgcaatacattattgattattttagttgtaaataattgagaatttgaaagtatttttattaaaatatgtagacgtgtcgccgtatcggtatttttctgaaaatggtgaatccgcagatcggtattgtgtcgtgttgacgcatctatgtccttgcatcatagatccacccctctagctaataacatcgaatagaagaagcattttaagtattcatggtggcttaaattgattatacatttcacgtgcgtgtgtgtggtttggggtggatggacatagtttgctgtataagatcttgatttgtcaacacagtgcataaaaatagactgggcaaaatgaaaccagtctcattgcaaaagatagggttaaagcaataacaaaaaaaaaatctgcatatttcactagcatgacaataaataacagcctgtgaatatgttaaaaataacaaaactccaaagcctatctcccttctaaacacatcctaagaaatatatcaattacagtaatatcataccaggaagagaagaaagtatttgtagtttagtgccccaacacaattaacaacccatacacaatgatgatccatcttaagaacacatcttccacctgaaaccatgattagtgataaatacacaatattgttgactatacaattcataataactagaacaacaaaaaattgatcctgaagaataaatcaacaacttacaaacagagcaatgatggcatcgaggtggcttcatctggttgcacttcctacaatacctagcccttggatgtcctgtgtcattgtgagcgatagattgttgcgagtttacctggctattgaaatctaagccagaaaggggggcagtttctcccctctcctcatcaaagtcgagattccaatttggtggaacagaaccagggtcggtgaatacaacagaaaagtagctccataaaagcataacaagctacaatgagaaataaactaattagtgtcaaaagcaaatatgcgggaaaaaattgaaacggtgcgaaaatgtttaatattacagggctaatgtttatagtcaactattcttcgcatccaatttttgagttaatattgtgattcttaatcattatagcatcaatattgcattttgttcacctcattttgcactttcctttcttaacttctcagtacaatccatccgcatttcaacaatgtgggtagtgtatatcaggaaacatctaatatgttgtcaagaagcatgataggaaaataaatactagaccatggacataacagctcaattgtccgaacatgtatccagctcactcgtagccactcctacttagtacaaaaaatctgaggaaatacaacgagggctacttagtactgattggtatcagggctacttagtactaattggtatcaaaataaaggtggaaaaaaacaaaatcaaaacagtgcgaatatgtccaatataacgggggctagtatttataatcaactatttcgggcaaggaaacttcagttaacattgcggttctctaatcaatatagcatcaacattgcattttatcaactcattctgccgcttttttatccttaaatctatcactgcaacccatatccatttcaacaatgtagcaagcatacatcataggcaaatcatgtattttgtccagaaacatatattaggaaaataattacttataccatggcaacaacagatcaatttatcggcaaatccagtattttgtacagaagcatatattaggcaaacaattactagatcacggtcgctatagatcaatttatccaaatcagtatccagcctgcatatagccactccaaccaagtaccccaaaaaaaaacaaccaacacagataacaaaattttcgacctgtatcctaacattgctccaaaaacactcaatctctcgtctacttgcgagattcgacccaaccagctaatcgttttcaccgtttttgacacccaaaccccccccccccccccttaagagttcgagccaatagttaccaggaagtggaagaggagcaggacgacgagcgcgaggagggtgctggcgccgccggcgaagagcgcggggccgtagttgtacaccacgaccgcgtagtaggtgaccccgacgatggagaggacgagcaggatcatgatggagcccagccccctcagcgcagtgcagaacctgaacacgttccacgccatcgtggcgcccgcggatctgtgcatctctccccacctcccccgcccgcgcagcagcagcagccgacgcacgcctccgccgccctgcggctccccgctggcgaggggattagggaagaaggcgccgccgccgccgccgcgcttcgccggcgagggggattagggaagaaggatttggagatggaagaagacaggggaatggcaaaggttagaggtggagtacgcgggcggtcaggtcgtcttctctcagctccgcgtttttactttgaaaaagaaatcgcacaaaaaagatcgtttagagggatttctagatgaaccataaaagaaaattgaaactaaattaaaattgttgggtaagggttaactgaaaatagtcaaatttgttcaaatcggaatcggttagaacttaggattatctgattatgattcggtgaggtttcagtaccaaactttttttttaaaaaaaagacatatgactatatgagtgggtattttatggaaaccgtttggctatgccggtgccgccggcgctcgtaggatggagatcggtgcagatggtgaattcaaattcgagacaaaagtgtgatggaagcggaataatatacccgcatcattgctggtggtaggatggagattgatgcgcgcagcgagcgaggagacgggagtcgaggttgagaggatggggaaggtcgattgggtggctagggtggtgacatgggtcaacaggtccgttggtggaaaaagtcccatttgtatccctcgatgattctttatagtaactctggttaacaataccttgttgaaaatgtaaaaagttcggtcaatagttactccttacagactaccggctcctactccaacagtccaaccatactttgagttgtagaactgttcttgtgtaattgtgtttttcttttagctaggtgatattgtccaactatcttgtggttagtattaatccatcattcacactagaattaaaaaggattttttttatttgcacgtttcccaagatacattttatgcaaaaaaaaatcctatatatctattatattattaaaaagccttaaaatgaggtaccacgttcgctgtgtgggctataaattcccacattaatcggagaaaaagaaaaaaaaaggagagtccaagtaaaaatacaatctaaaaatagctgaaattcggaattaaaaataagcaatattgaaagaagtttccatataagaactcaatacgagattaattaaaattagaaataaaaataaaataaaataaaatccaaaattagaaaaggaaaggagaatccaagtagaaatacaatttaaaaatagctgaaattcggaattaaaaataagcaatattgaaagaagtttccatataagaatccaatactagattaatcaaaattcgaaataaaaataaaataaaatctaatattagaaaagaaaatgagagtccaagtaggaatacaatttaaaaatagctgaaattcagaattaaaaataagaaatattaaaataagagtccatgtcagaacctaatacgagattaattaaaattcggaataaaaataaataaatccaaaattagcaaaagaaaataaaagaagagttcaagtaggaatacaatttaaatttggctgaaattcggaattaaaaataagaaatattgaaagaagaatccatataagaacccaatacgagattaattaaaatttagaataaaaaataaaataatatccaaaattagaaaaaataaaagagagttcaaggaatacaattttgaaacaactgaaattgaaaataaaaaataaaaaacattaaaagaacacaatacggtattaactattttttaaaaaagatgaaattagaaaaagaaaaataagatttcaattaggaatacaatttataaataactaaaatttgtgataaaaataaatattattgaaagaaaagaccatctaaaacacatgacgagataaattaagtaacatgcctataaaggagtagagtggtggcggttgatacgacatataaaaattgttaataaaacaccaaatagaatcctaatgacgattaaaaggagaaacgtcaggcaggccgtgaagcaaacgagtaaagcagttgccaagacttctagaaagttaaaaaaaaaaaccccattgataatcatattcgattttaaaatcttaatgacaataaaaaggagaagcagcaggctgagtgtataagagtatagttgcagagcctgtaactatagaaaataaaaaatgaattccaacgatagttatgtttaatttttagaatcacaatgataataaagagtaggcggcatacgggttgtagaggggcatagtggcatcgtttgatgggacttctaaaaattataaaagaatgaaactacaagtccaatttttaaaggttcggaacttctaaaagtaaaaaaaaacctatgataatcatgttcgattttaaaatctcaatgacaataaagaaaggaggcaaagggcgagccgtagaggagtacaatggcaaagccgctaatggtttggcgggacttctagaaactaaaaatgaacccaaacgataattatgttcgatttttaaattctcaatgacaataaagagaagagacagtggacgggccgcagaggagtataatgacaacatttgacgggactctagaagttataaaaatgaaacccaacgtgacaataaactctaaaaactgtaaaatccgatttttaaagctttcaagaagaataaatagaaaatagtggtagatcgagcaagcaaataaagaaggagatgacataagaggtagcaaccggtgtgacttttaaaaactatataattagaaacacgaggatgataaggtttggtctttcaaagtcttaagacaacgagatatctattcaataaatttaagtaaaatcatacttaaaaaataatatgattttgtttgggtgctagccgcgcaattgcgcgggccacccagctagtttctgaaaaaacaaagaaatttagttttcaaatattctacgaaaagtttttagataatctttgaccctccacgtgttaaaaaaattaaaaataaacataaactacctactcacttctttcgttaaaagtatatttttaaaaaataaatctcatcactaaaaattctattttatgatcgttatgttctactccctccgttttttaatacatgacgccgttgattttttctcacatgtttgaccattcgtcttatttaaaaaatttacgtaattataatttattttgttatgagttgttttatcactcatagtactttaagtgtgatttatatcttatacatttgcataaaatttttgaataagacgaatggtcaaacatgtaagaaaaagtcaacggcgtcatctattaaaaaacgaagttagtataatataaaagattttaaagagatataatataatcatataatataaaagattttaaagggatatatggacggagggagtagtaccggtctactcccagtctccagagacattccaagaacaaccatatgtctttcttcctttcgcaaccgtccaactcaactcctcattattccacgtacccaaagaaaaacatcccccacccaaaaaaaaaaaaaatccgcgcagctgcaaaggcgagcggagctctcaatcgagcagcggttccacttctagaagcttcttaatcacgcgggaggaaggagaggggaagcccccggcggcggcggcggtggggttcgcctgcgcgcggcgatgtcgtccgccaagtcgacgaggtcgcgcccagccgggcactccggcgtgctgccggtgaacgctacggccggaggcggcgacggcggggtgcctctcgccgacaagatgaagatcttcaagaccgacaacttcgaccccgacgcgtacgtgcagtccaagtgccacgccatgaacgagaaggtaaagggattggtccactcgtgaaacggggaggaaactggagtggtagaattttggtcggaagttcacacgcgcttttgctgttctgtgttcgagaggtgtgagggatacggtgtcgggagtttcccagtgcatttgaactagcgaaagtgtgaattgagcgttattaggattgtttcccttagagggaaaacggtggttgcatggaactagatatgtttattgtgtttgatttttttcatgttcagatactagttatgaaacgggttttttttactctgatgcggagaaatactgattctggccagtactgacaaatttctggttgcgctgcatgcttgcgtagttgaattgaggtcgaattaagtttgtcaataaccttgaatttgcatttgtctggagcttggagggagcactgaagtagagtgctgttagtttgttagttttatgttatcttctagagaagtgaccacatgtagatttacacatatttgcaaagaaccggagtttgtactatattatggcggctctggtgatgaaatgaatcgtacgcaaattttgtaagggttctttttttgttttagaaagttggcgtttattgtatatgagataaatggttgcctttaaattgcttttacctattgttttgtgcgggagaccacttgtgctcatggttgtcaaaggatttgggtagcaacgaatggatgatcctacacttctaccttttctgcatgagttatgctcacttaagacctattttgcagttgtgccgtatcatgcatgtgtgcattttctgaggcttcaaatgttgagtttcctttgcatgctccctgtgtgtgttttagagcttgaactattactttagtaaaaggcacatcatgcttggaaaatctaacaggattgatgctcaaaaactgtgacaggaaataagacacctctgttcttatctgcaagacctaaagaaggcttcttctgaagagatgcgtagaagtgtttatgcgaattatgctgcattcataaggtgtgaacacaattgttgaaattttaatctaacccaagggagtatatccctggactcagagtatcgtgtctgattattctccaatttttattctttttgtttctctaaaatgagtatgcctgctagctttgtttattgctaatctttggcatctcaaccgctgcgcactccatacaagttcataaaattttgaattagtattttgtaagaatcacaatccaaagaattattgaaaaaagaaaggtaggcagcggatttgtcgtttctgcaaaattatatgcagatgtcataaaacttgtgggatgcaaaatcataattgtatttttttttcacatctggtatttctctgtttttcttagttacttcctgggattgttctctgttttatccagttcataactttcggataaaatgttgataactcaatctcctggttttcagaacatcaaaggagatatcagaccttgaaagggagctgctatctgtcagaaatctgctaagtacacagtcagctctaattcgtggtctatctgaaggggttcatattgattccttgactacagggtctgaaggctctgcagaagaggggacagatgaagaccaggagccctcagaaatacaaaactggtgcacagatttccctgagatgcttgatgttttgctagctgagagaagagtggatgaagcattggatgctttggatgaagcagaacgtgtcgttgctgatgaaaaacagaaacagacactcaccacagctgacattctggccgtgaagagggctatctctgataatcgtctgaaattggcaaatcagctagcagaagctgcttgccagtcttctactcgtggcgttgaacttcgtgcttcagcttctgctctcaagagactcggtgatggaccccgtgctcatagtttgttgcttagtgcacacaaccagaggcttcaatgcagcatgcaaactatacatccgtctagcacatcacacagtggggcatacactgcatctcttgcacggcaagttttttctgttatagcccaggctctcagtgactctttagaactgtttggtgatgaaccgtcttatttgtctgaactgattacatgggctacagaacaagcaatgttatttgcactacttgtaaagaggcatgctttagccgcttgtgtggctgctgggggcttgagagctgctgccgaatgtattcagatctcacttggtcattcttccttgctggaaactcgtggtttgtcactttcgtctgttctgatgaagcaattcaaaccctctgttgagcaagcactggagtccagtttgaggagaattgaagagagtactgctgctttagctgcagctgatgactgggtactcacctatcctccatctggtatacggacgtttgctagatcatctgctagtagtttgttgctccaacctaagctctcaaacagtggccatcgcttcagttcaatggttcaggtaatgttctattgcttgacaaatgtttctagcctttgtaattgaggatttatacataaagttattcttttaatgttttactgtattattttgcaggatttctttgaggatgttggcccactgcatagcttgcagttaggtggttctgcaatggacgggcttctgaaaatattcaattcatatgtcaatctgctcataagtgctctgccacactcactggatgatgaagcgaatttggaaggtttaggaaataagattgttcgagtggcagagactgaggagcagcagctagcattgttcgctaatgcatccttactagctgaagagttgctacctagagcagctatgaagttgtcgtctgtaaaccatactggtgtgaatgatattcgtaaaaaaagtgtagacaggcaaaaccgtgtagcagagcagcgagaatggaaaaagaagctgcaacgtattgtggataaacttaaagatagtttctgcagacagcacgcccttgatcttatattcacggaagatgatgacacccgtctgagtgcagaaatgtacatcaatatggataatactgttgaagagccagaatgggttccatctctaatttttcaggtccgtataaattttttgcccttaacaactatctggataaacattactgcttatatttgtttgaagaatgaggttcattatgacattcatcattgaggtagttcttctatgatctataaaatatattgatttttagatgaattgttgtaaaataagtaaaccaaattgtttttctgaatctatgctctatagcacttcctttcttgtttatatacatagaagacatgaaaaaccgaggaatgatgcaagggttagatacatagaaggataaagtaaatatagcatgtttcatgcatgcccacttgacatgtacacattacgtcttaatcagcataaacttggtaaaattggccttgtcgtgtccttttggccttggttcgcacacactagacaagtctttgcactaaaacgagtgtttgccaagttcatccactagattgcacccaccaaacaagttcatgtaccaccaatgcaattcactcatatggtaaagaagttgcattcagcttgcaaataatttcctagttattgcttgtgctattatactggtatgtctagcccaacattaacaagatcaaccaaattgtagaaccaacagtacagaactctgtttggttcctgatgagttgtcaccaaaaatagattttggcagctggctggcttgcaattttgttcgaagaaatgctttatttagaaattgaaaccagaaaattttgcactttgagaaatataacaaaggtacaattttgaattagataatagacttcagtattttgtcaggcagaaattttgttaatgtaaagcttagatgacaactcatgaaacttgggcagtcatgctgcttgcaaatctacccaagaaactttagccttttgttgcagcatctcatatattgttgcaggaattatatgcaaagttaaacaggatggcgagcattgctgcagatttgtttgttggtagggaaaggtttgctacattcctactgatgcggcttacagaaacagtcatactgtggctatcagaggaccagagcttttgggaagagattgaagaggggccaagggctctgggtccccttggacttcagcaggtgagttctttttttcttgttttgatcttatgacaccaactattattcttattttcaccttccttttcagttctacctggatatgcaatttgtcatcctttccgggcgaggccgtttcttatctcggcacgtacatcaagtgatactgaaaatcattgatagagcaatggcagcattttctgctacagggatgaaccctgataggtatgttactatctatctgacttgcatctatccttttgcggttaataaatctatttcagtccgactgtatttagtaggaggtgctaatattaatatctatgcatgttatgctgtaatggcaatcggatgcatgcatgtattttgctccatgttacaattgtaatagattcctcacataccagaaac

SEQ ID NO: 36268 - DNA, 4043 bp, Oryza sativa
  unsure (1)..(4043): unsure at all n locations
nnnnnnnnnnnnnnnnnnnnnnnnnnnnnnnnnnnnnnnnnncctactgatgcggcttacagaaacagtcatactgtggctatcagaggaccagagcttttgggaagagattgaagaggggccaagggctctgggtccccttggacttcagcaggtgagttctttttttcttgttttgatcttatgacaccaactattattcttattttcaccttccttttcagttctacctggatatgcaatttgtcatcctttccgggcgaggccgtttcttatctcggcacgtacatcaagtgatactgaaaatcattgatagagcaatggcagcattttctgctacagggatgaaccctgataggtatgttactatctatctgacttgcatctatccttttgcggttaataaatctatttcagtccgactgtatttagtaggaggtgctaatattaatatctatgcatgttatgctgtaatggcaatcggatgcatgcatgtattttgctccatgttacaattgtaatagattcctcacataccagaaactggctggaataggctagtgattatgcaattcctggtttattcattttttagataataattcctggtttattcatagctggaataggctagtgattatgcaattcctggtttattcataaaggttggtaactgaagatgatatacccgtttattctctgcagtgtccttccaagcgacgattggttcatcgacgttgctaatgacactatcagtaggatcagtggcaaccctcgaactgccaatggggatagggaggtgaacagcccgacagcctccgtttcagcgcaatctatatcgtcggtcagatcccatggcagctcctagtgtacatagtagccttagtaaccaggtcttgtataggagtgagtgtgaaatagtttctccatttccctgttgtattctctccttaggtcttgtataggagtgagtatctcctagctttgttccccatctggtgtacatgccagtatatagacctcgtttggatgggcctcaatcccagtccatccatgtgtataggccaggattctgaactaaaatcctggcccaaactcatggatggaatgggattctgcatattccaaaggcggccttaggaaaatatttgaattgaatcggttgttcagagatgtgtctttgtaaatttggtgagaaatgtatgacccagtgtagtttgtcttcttggaaacatactgtaccatcttgatacgcgtagactgactttgtgctgattgttcatctgaaaagagtattgtcttccaaaggctgatgatgaactctgaaaaactgaagattcatctgtaccatagtagcctagcaacaagccaacatgcactgaacacgcgcttgctacctgccaaccaatttgacttgtgcttacctttcttcctacagtgtggtcgctttcgcctttattttttttagtggtgggttcgcccaagtgcacggaattgaggacttcgcttaccattggagaatttggtcttcattgtttttaaaacttaattttgaatttgattattttttatttttcatcatagtttattttgagtttgctaatgatatgcatataaaagttttagtcacaaatgatcttttatttagtactctctccgttttatataaaaaatatcagcatctaaaatatcaaattagttttattaaatatattttaataatatatttgttttgtgtttaatatactactacatttttctatagatttaaaaagaagtttgactagtaaaaaaacaaaatgatttgtatatgaaacggagggagtaataagtgattcgaattaacataagaataagtaaaacaatatgctcatctcgcactccgtgaccaggtctattctaccagaccacatcctgtccacgtcactcgttagtccgtcaacgatgaggacgatttaccaatctccacttatcatgcagccgtctaatcgcgatccgacggccaggatcatccgacgcgctgccccttgacaaatcggacatggttgaaaaagcttctctcacaatctagttttgatcacattttaccaaccacaacttaaatacttaacaactcttgcataaagtaatgatcaaagcttgatgatgattatgcatggaaatcgcccgagggcctgtcaatttctcactctcgctatagttagcattttttcttggataatctttgatatgctactttgattaataatatctataaaaattttaaataaaaagtaactacatgttacgatagtttgtttaatgataaatttagtaacatcaattttatacgattgatctttctacttttcttgttattaatagtaaaaattaaaaatgtttgacttaatagtgtttctattttaggacggaaagagtacttattgatgatcacaatactaacagagccttttatgtatttagtgatttaatgtttgatcccttcaaagctttcacaaagttgtcctttccacacgtcctcctatatgcacttatatagcattgcattggcaccaaaactatcgacctcatgtcctcatcatcatcaatggagtgcaccggaaacatgtcggcggcgccattgctcgtcttgacggtggcggtgctcgccgtgctagcctccacctgcgccgccgacccagagccgatacaagacttctgcgtggccgtgccccgtgccggcggcgaggcgtcgccggcatacccgggcttcccgtgcaagccggcgtccgcggtcgtctccgacgacttcttcttcgccgggctcgccgccgccggcagcacggacaacccgttcggggccagcctgaagccgggcaacgtggaggcgttcccggcgctgaacacgctcggcgtcgccatcaaccgcgtcgacctcgcccccggcggcgtcaacccgttgcacagccacccgcgcgccgccgagctggtgcacgtcatcaccggccggatgctcgtcgggttcgtgagcacggcggggaagtactactccaaggtggtcggcgagggggagacgttcgccatcccgcgcgggctgatgcacttccagtacaaccctgggaacgcctccgcccgcgccatgacggtgttcaacagccagctccccggcgtcgtgcccgccgcgacggcgctgttcggcgccgacccggagatccccgacgccgtcctcgccaagagcttccaggtggacgccgagatcatcaaactgctcaagtccaagttcaagaagtgacactgacgtctcatccgccatggctacagcatatctgttttgctttagctgtcctagatacagtaaatagagttgtttcacgtttgatattttggtccgatatttgcccatttggcacatcaataaagtaaatttgaattgtcctatacatgcagcaaatatcggaaaaaatcacttaaagacatcaaattctcaacaatttagagaagaatttaccaaatgaatttgacgacagcacggcagccacggctaattttgcacccaacccttcacgcatcttcccatcttcctccaccatgacgcggccgcggcggcgccatgcttggttctccgccggtgatcggaatccttcccctgccgcgggcggcggcgagaatcataaactgccttagagtcgcaaacttgcacggcggagagattcgaggaggcggcgaggaatcataaactgccttagagtcgcaaacttgcacggcggagagattcgaggaggaggaaacggaggcgtatcccggcggggatgaggaggccgcccatcagcgcgcggcgaagcagccatcgacgccggcggaaggagaagcatatgacagtaacaaatcgggctgggcctacttttgccagaaagttcaatagtacgctgttcccctaaatgggccgcaacgaaaattccgaaattggtgtgcaagtcagaatatagcctgcgcccatttgnnnnnnnnnnnnnnnnnnnnnnnnnnnnnnnnnnnnnnnnnnnnnnnnnnnnnnnnnnnnnnnn

SEQ ID NO: 36269 - DNA, 1063 bp, Oryza sativa
  unsure (1)..(1063): unsure at all n locations
gttctccgccggtgatcggaatccttcccctgccgcggcggcggcgaagaatcataaactgccttagagtcgcaaacttgcacgcggaagagattcgaggaggcggcgaggaatcataaactgccttagagtcgcaaacttgcacggcggagagattcgaggaggaggaaacggaggcgtatcccggcggggatgaggaggccgcccatcagcgcgcggcgaagcagccatcgacgccggcggaaggagaagcatatgacagtaacaaatcgggctgggcctacttttgccagaaagttcaatagtacgctgttcccctaaatgggccgcaacgaaaattccgaaattggtgtgcaagtcagaatatagcctgcgcccatttggaagtctgaatcatataccaatggaaaaaagtctacagttcctatctgaactgctacctcaaaccgaatgagatttgatatataccaatagtagcatgtattgccatagctatttttctctttatattcaattaatatggtattttctatcctcacattctaacatgatgtcttattctcaagttatatttctgaattcataaaatatgtattcaaaattgaaataatcaaatgcactttattatttattcattcatgtgccaaatatacatgggcaaatatcgtatcagagtataatatcaagcgagaagcaaggctatttactggaataaacatgtatccatatagggtctgtttggtacagctccaactcctaaatttagctctaggagttaggtctggagtggagttatggagctacctaaacccagctccacaactaaagttcattttgtgagagagctccacctagctccactcccattttttatgtagctgaaactgtttgtctgagctccagctctataaggggtggagcagaagctatgccaaataggtccgcactatgtacgtacatgtaatctaggacagctatcagtgcaaagagcacataatatannnnnnnnnnnnnnnnnnnnnnnnnnnnnnnnnnnnnnnnnnnnnnnnnnnnnnnnnnnnnn

SEQ ID NO: 36270 - DNA, 1880 bp, Oryza sativa
ccattatgcaatggattctatggagaatatccactaaggtcacatggctaccaaggaagtgagtgggagaaaaaacctgagactctcgatcgcaggtaacttcctaaatgcttgttatttagttggttccctgctgatgcttaccattgacctatagacatatttatcccattatatctacaggcaaagaaaaagatctcgaaggtacacgcaagattttgttgaggctatctcggacgtcgacccaaacttcgacagtgatgatgatatcattggtgaagcagtctatgatgaggaatatcttagaagtcgaaagcaatataaggccagacttttagaactcgataaagagttccaattggaacaagttgccgatgatggtaatgatgaagtggaatatccttcgagtaccagtgaagatgaaaaggagccccaacggtacaaaagattggctacttgcaatcctcgagggaccaacttgagaactatcgatggattccaaacatgcatcacacgaagtaagcgttccacccgcccacacatgaagtatcatcagtatgatctttctggcacagatacagaattgggaaagccaggtaaaataaaggtaccagatccagatgctggttctgatgcactaaatgacatggagctctcgacaactagtcaagaccaggaggaagaaggtgctgaagtaaataaagagcggccacccctgctttctcctagcaggaataatggaagcgatgggagaagatttcttgacttaaacgaggttgcgcctgtaggcggttttgatgaaacacagagtcgcaacggcgaaaggcgaccacctggataacaactgaggatcatgcccttgggtttagatactgagtaacattgttgatccatcagaggccaatgagcacccatgagagagcgatacaacatcattcatgcgtcaacctgattggaggtgcttttgtcaacttggaagaaccaagtgaagaaacgatatggtccatcataagtgcagctgtagaattaccattagctgatccagtctgatgattgtagaccatggtgagatgtgtgcactgatgtctggcacgcgtcaactgatagcgtattagcgtatgcgtgttagattgccatttttcttcttctttttgagtcattgtcacattgttgtttcaccccggctacatatgcttgcgaaatcgcgaggcctaaatgagtaacattgttggtgtggcttggccgcttcaggatgcattctctgcatgttgtcatcagtctcaaactgtgattcttgccctcccgtatttccaattttccatggcttgtgtagttgtgttgtgtatgtaattgtagcttggaacttcggcaaacgaaagctattcttttcttccccccatctgtgcttatttgaaccattctccgtacaagttctgaagttcatcatggaactaattcaaaccaaaatttgatttatcatgttactatcttttactatctccgtttcaagtttcaagttatataagactttctagcattgcctatatttatatagatgttaatgaatctaggcacacatatatgtttagattcattaacacatatataaatatagacaatgctagaaagtcttataattataatatgaaaaagtattatacttacaatttacacctgtttcaagataagaaacaccgtgaatcaaaaaggaaaatttcaaaagcaaatggcaacaagagcagttgggccgtagttgggctgggccaactggcccagattgacaagcacgataatgtgggggtgggtccgtgtcgcgcggctacaacaataacaagaccacgttcgttttcacccgggttcgggagggatctaaaccctaa

SEQ ID NO: 36271 - DNA, 745 bp, Oryza sativa
tttagggaaactccagttcgctgtaccaaagacggaatgcgtgattaattaagtttattcttttttaaaaaatagatcaatataattttttaaagcaacttgtatataaaagttataaaaaatatactatttaatagcttgaaaagtgtgtacgtgatgagttggaagctctaacacacgaaaacaaccgaagttccctcaattcttttttcttgacttgatttttcttactccagttgggagcaagcacaaactcgaacaaaacaatgcaaaatacggtcagccacccaggtcagtgaacattccttcctcttcacatgcatcttggattagtgataatttagtgatagttttttaattagttttattctaaaccgcagcatcaggtgttgctaggtcaacagagcgcccccacccgcacggaatcccgcccacatcgaaatagcggtcacggccgccacgcgccacttttctccacgtgtgctcccgtccacacgtcatccttcgtgcacgcggtccatgcaccagccaccattcccttcgcctcgaaggaagcgtagcgcatacaccgcgttcacgcgaccctacccacgtggccccccacaattcctccactaaatattttattatactcttttcgaatcgcaattaaactaaccgaaaatttgagtgaatttttaacgaaaccgtcattaataaactaacacgtccttccccttcgctgtgtgttgggttcggttcgctt

SEQ ID NO: 36272 - DNA, 1204 bp, Oryza sativa
  unsure (1)..(1204): unsure at all n locations
nnnnnnnnnnnnnnnnnnnnnnnnnnnnnnnnnnnnnnnnnnnnnnnnnnnnnnnnnnnnnnnntacgcaccccaagtggatgttccacattcatcaaagataagtgcaatattgatagtgttgtattgctgtgtaagtgggcaatcatgtttagcttttgtctttggttgttgtgatggcagggatttgtgcttgaagatgccactggcttatcattgaatggggatcttgatgtgcaatcggtgtttgcagggactttgcccactgcacaccctagcttttcacctcagaaacacctagagatgttgcctatttggcaggcccctccccttccagacgaaccaattgagattttcattggcatcctgtcagcaggcaaccattttgctgaacgtatggctgtgaggaagacatggatgtctgctgcccagaagtcctcgaatgtcgtggcccgtttttttgttgccctggtaaaatcttgaagatcaaatttgatggcctgtatgtccaagttgcatgcttatgtttgtggacttgagctgatgaattatcttttctgcagaacagcagaaaagaagtcaatgcagaattgaagaaagaggcagagttttttggggacattgttattgtgccattcatggacagctatgacttagttgttctaaagactgtggcaatatgtgaatatggggtatgtctaagattggtacatattttcgaacttgctactttcaagctgctctattaacatctaatgaactgtttgtcaggtgcgtgttgtttccgctcgatatataatgaagtgtgatgacgataattttgttagacttgaatcagtgaaggatgaacttaagaaaataccaagaggtaaaagtctctatgtgggaaacatgaattatcaccacaagccattgcgcactgggaagtgggctgtcacttatgaggtaagcatgtttttattttacaatgaccttatatgtcttatcattgattgaagtgctgtagagaacatttcaataaaagttatttggcctgcctgacgcggtttttgctgattcattgaaatcttaacagaagaatatagtattcatggcaatatggcatgctaatgtacttaactcaatctttcacccttttgaggcatctaacaaataatcacttactgtaaccatacagcgaaacttagcataacaatggtataga

SEQ ID NO: 36273 - DNA, 14124 bp, Oryza sativa
  unsure (1)..(14124): unsure at all n locations
nnnnnnnnnnnnnnnnnnnnnnnnnnnnnnnnnnnnatgtctaagattggtacatattttcgaacttgctactttcaagctgctctattaacatctaatgaactgtttgtcaggtgcgtgttgtttccgctcgatatataatgaagtgtgatgacgataattttgttagacttgaatcagtgaaggatgaacttaagaaaataccaagaggtaaaagtctctatgtgggaaacatgaattatcaccacaagccattgcgcactgggaagtgggctgtcacttatgaggtaagcatgtttttattttacaatgaccttatatgtcttatcattgattgaagtgctgtagagaacatttcaataaaagttatttggcctgcctgacgcggtttttgctgattcattgaaatcttaacagaagaatatagtattcatggcaatatggcatgctaatgtactttactcaatctttcacccttttgaggcatctaacaaataatcacttactgtaaaccatacagcgaaacttagcataacaatggtatagaacttatgttgctgatacccattgctgactgtagttgcattaacttgtagccatatgcacaagcttattgatccttctctgagaaaacagcaatgctgtcaaccgttcattctttatgctgctattttcaaatttttctgtcgttttgtctaactgtttatgtagatgcttagtatttttggtataataatgattataactttgaatcctttttgatgaatcaattatcagggcctacaatttgtgaagctgtttcaatacattgttgtagttaaaattaagaaatattttctacatgttgactaaattttccgccattttaactagatcttgttaactaggtgcatgtgttccatctttgaaaaatatatttggaagttggatctaacatgatattttttgtaactgggcattcaacatattagtggtgcagtctttggttatggttggtattgttctgggccagttaactttgtttctctatagtgtcaatctacggaaaaaaatgtacacttaatctcactgttcttttctagtgccaaggaccacttatgaatagtagcctttgtcatatagcctttttagtttaaaatcatctgaatttgtttaaaattcaaagcctaggaaagttctgtaccaactttgtacatgtacaatgtatttctaggtggtaatctacattccttgcatccttgggcttacacagttatgtatgaacctacataggagaatggaaataattgacgtcctacaaattgtgagaatggaaataattgacgtcctacaaattctgtgtccttttgtactctatccaatttcgttttctcttttgctgcttcacctataccaacataggtttgggtgcctaaagtctgccatgaattcattgcacttatctttttaatttacaggagtggccagaagaggattacccaacatatgcaaatggtcctggctacgttatatcttctgatattgctgcttccattgtgtcagaatttacagctcataaattaagggtaagctcagaagatttgcttctggttgttttttgtggtgctaaaagcgacacataggggtaacttggattcaacaatgggatattcatcatataatattctattgaattccttgtacataacacataagcaaactactgtggattttgatgtcatgtttcggaataatctgagcgtaggttgagaagaaaacaacctggacatactaatgaagtaatgatggcagatgtctaattcactcaattcacatttgcttgttttgcagctcttcaagatggaagatgtgagcatgggcatgtgggttgagcggttcaataacaccagacatgttcaatatgttcacagtatcaagttctgccaatttggatgcatagatgattactacactgcacattaccagtcaccgaggcaaatgctatgtttgtgggataagctgcagtctgggaaagcacaatgttgcaatatgagatagcgacaatgaaactggcagcatcgatccccttcgattgtgttagtggtcattcttctttgctacatgatgatcctgagcccaagatcgaaggactgttttgcgatgataaattaagtcctcagatgactaacaaatggccatagtttcttgcttttcatgtagagatgaccgtcgaaactttcagctagaaaccaactcagggaatgaatacgaagttcagtgggcactaatagaactgctcaaggacttcatctgtacatgtgaagggtagaaagcttagttgaaattgttgctactcttgatatgcctgattgtggttgaaagtcatgaacaacccatcaggtacgtagaacatcttggcgttttactcaatttgtcgcagaatttttgatttgacatggtcataagttatgacatgtatttagttctggctgcaaacatcttgcatgagttcatggagtatcagatttttcttttccttcttgtttttagattcaggttgtatcgctgcagctcgagtgttcatacgtattaatttgaaatgtacgtacatataatatttttgtcgagaaatacagtataaatacatgtgcgccacccctatatacgcatacaagtatcatgtttccttgaatgttgtggataaatatactccagttgctagattagtatagagtattggtgttgtgtaaagttgtaacaacagattcaataattaatacaaccatttcagtttcaaatttaaattaatccatattgttttatattttaactgaagatgatcgaatctttcagttgaaggtaattgtttgttaccgaattaactgactgaattttaatttggtttgagttgatggaaagtaaaaaagctctaggaaaacagaccaaactattctatctgtcctataaattacgaagctagtacatactagtactaatcagattcgtactattaaaaactcacattcgatacttggttggttttatgggaggaagagggtactaaaactcacattcgatacttggttggttttatgggagcttggttggttttatgggagggagagggtaggatcgagtcagaaagacacctgaacctgtacaaagaaggcccaacttaactaggaataagttcactccatgaccctcaaatttgatcgaaatctaaaccatgaccctaaactacaaaaccagatatctcgacctccaaacttcaaaaaccggtgcaatttgactccctgagcggttttgggaggtggttttgctgacgtggcttctacgtggcaatattgaccgagtctttgttacacgtggcattgacgtggcaccaacgtggcggtagaaataaaaaaatatgcatgggacccattaggcattcacacaaaaagaaatgtgggcccactgacatgtggggcccatatgtcagtccttcttcctcctccctcactcccttatctctctttctcttaccttcttccccttcggcgacggtcccaccggcaccggcggcgctccctaccaccgacgagctccagcccctcccccgcgtgcagacggatggcgagcccctcccccgcgagcggacggtcagtgaacctctcccccacgcgctgacggccggcgagcccctcccccgcgggcggacggccagcgagccggtgagccttccccccgcgagttcctctactgggccgcctcctcgtcgccgtcgttgtcgaccccccactccctccgcacctactgcctccttgtccaccttctcttccgcatcgccgccgccgcgggatggcgatgccgctcgctctcgctgtccccgcacgcttccgcccttaggggaagaagtggagagaaagagagagaagggagagagggaagagaaaaaaggtctgacatgtgggccccacatgtcagtgggcccatatttatgactaatgggtcccacgcatattttttatttctatcgctacgttggtgccacgtgtaagaaaggactcgtcaatattgccacgtaggtgccatgtggcaccacgtcagcaaaattgcctcccaaaaccgctcagggagttaaattgtaccggttttaggagtttgggggtcgagatatctggttttgtagtttagggttatggtttagatttcgatcacatttgagggtcatgaagtgaacttattccacttaactactagctcagcccaagatcaagaacccaaacactatccggcccaattgtagtacttctcggcccaatatgaagagcccaaacagcatccgactttggcacctgtactacgcaaggaattcccctacgcaacgcaaagaggtactagtatcccaataaaacccgcgaccgcaaggcgcccccggtgtcaccgccacgcgtgtccgcgaaacccgccgcctcccgtcggcgtgccgcgtgcctacccctccccctcccccgccgccgccgccgccccaagcgagttgctggctccttcttccgccgcacgctacccctcctccccgaccccgccgccccgatgagcggccgcgacaaccaccaatggccgccgccgcaccgaggctacgacccccgggaccccgccgccgcgtggcagggcgacgcctcgacctccgccgccgccgcggcggcggccgcgggggtaaacccctacatctacgtccccaacccccagtacgcccccaaccctctcaatctcgtcctcaatcatgtgctccacaaccccgccgccctcgccgcctaccatcaccagcagcagcaacagtaccaccaccaccagcaactcctccattcatctgcgtaccaccaaaaccctacccataatctccagcaccgcgctgccgtccctgcaccagcagcaccggcggccgcccctagcatccagcaccgccctgtcgcccccgcgacagccgcggccgcgccggggcagcctcagccgaagaagaagaagaaacagaaggagccggctccgcaggcgcatcccccgccacccctgcccccaccgcagcagcagcagcagcagcagccaaagccgcagcagcagccgggggctcttgagagggcgcaggcggcggcgaggaaggtgcgggacgagatcattaaggctggtgagggcgttacagggtggaagatagcgcaggcggtgctggtggcgctcaaagtggattcctggggctctcttggtgtccagctccatgaagtacccctcctgcgcgacctcttcctcgtcgagggcaaggtcagttttgcttgattagctgcagggacaacaatagtttgcaattaattgttgctactatgtatccctgcaaaatttgtatatgttctgttcagtcttaatttgcgtgcaattgctaaattctaaagctgaagtttcatgagaaaattgtagcataggtatgaaattctgcactgtgctgggtgcgttgctgtcgacatatgcaaatttcacgtttctcctttagtattaacttgccatctttgtttatttctttacattgtttcttttgttatataattgtatcacttgctgaatttccatttcttttatgtttttgctataatgttgtccctttacgttggaatggaacgagactacaagtggtacaagttctattcttcttctgaaacagaagaaaggaaaacaaatatcaaacggttgaaactttcttagcctgaaattacaaattgtttcagctcttggtgaaagaattaagcagttaaataaattaccaaagtcaatgttgcatagcatgccttggcagaagatagataatcagttacttatatatagtactgcgattaggtgacgccgtgataggtatttgatgcaaaggacccaaaaaggtggaatgatgtatgatatgggagataacataattctaaaagtagcaaactacttctgatataaaacaagctgaatattaagaacctttccatgcaaacatcattattgtgaaactgtgatattgaattagtttgatgtcgcttatttacaatatgtatcgaatttatttgcttttcctttgcacttttgagtgagcataaagctgctgaacttttgttgttaatatcaaatcatcagtatttggttcaattttacttcgtgatgctgcttatttatttcacatgggcatggccttttttttgtcaggtgaatacattcatccattgctatgttgcagcaaggaaaattgtttcagtttatgatttagagtctgagatatgcaaaaatgagagcattggacagtttgaagagttggggttggggccttttcttcagcatccacttgttgcacattatttttcagtacctgccgatttgtccttggtacctaagcttagtagtgacgagattataaattggcttcagaagtttatggacaactctaaaaagaaaattacagtggaaaacttcttggattatcttgcggagcaaaagtcagtctctggaaaggaaaaccttggtgtacgaatacaaagcttgaggtatgaatgttagaattgagcacgtacttatttattgacttcccccatgcgtccaacatttttagtggtgcatacttcaaggttgaaatagaaataactagtttcctttggtctttcttcagaattttcttctttttctaatttgggagattttgtaggttgcatatttcctttctccggcaggccaggagaactgaagtgtctgctgttaaagttcaaggcaacaccagtggctcaggtgatggtagttgtgagaaggatttggtgaaaaatagaaaatttcatttgagcaaacaggcattggatgagaggttcagtgctataactagtcgtataaagaaattaccaggtatcaataagcacatccattttgattcaaccgatgatgaaactgatggtgattctagttctgagggtgatgcagttgataacagtgagagtaaaactggttctgctgctattgataacaaggatgttgataagcgtgttagtagctgtccatatccttcaaaaacagaagaaatggagcgtcttggcttaaagtctgaaacgagtaaaaaaccacctttggatagtagcaaggtaaaagagagtagtaaaaagggttatacgagagaaaaaaggaaatctgaagagaatgggagccccacctcttcatgcaaacggcccaagaagaagcaaaaggttcaaatgcaaaagcatgagttatcacctaattgtttcttgagtataggtaagttggagaaattcataacgacctggaaggaagcatgccgtgaacatccagttcaacaggtatgctaattcatgatcatatttgttttctttctgtaattgttaacctgaatgatgccaatatttgtttgaaacaaacaggcaccataattatgtagctctatgtactgatatacaagtttctttcgatttatttgtgatatttgtcatacttgtttgatggtttggtcgtacaatgtacttcatttcattacttatttgaaaacacatcattgattgtttagaaagaggtaagtgtgtttagtctagacatttccaatttctaaactaaattgtcttgcatttcaccatgaaggttttagagttgctagcaaattactatgcggaaacaccaaaggagaagaagaaaataataaagtttttctccgagtaccctggcattggcttcctaaatgttgccgtgagttgatttcttctcctttactcatcccccttattcgttttacttgtatctattatctactatccatactatccaaatatgttgcacaaaatggctttaaccttttagttgctacctaattcattttaagacagcgggttaatgaactcataggatttatagatgcgacttgcaagttatatcctctgttgagtgggccattctatgtctgcgtgtgttcgagactgtcattatttgtgtttgacaagcagatttgtttgtctttgatcaatcctatgtgtgtgctcatctgtactattttatctcctgtcctcccatatttgtccatttcatcctggagaaaattcaaattcggcttttggaatgcagtattccagtacctgcccatttcaatttagcgtttggggttgtaactccgttttcaaataactaataacctagactcttgatttgaactttgaccactaattactcttaaatgattgggctaaagtgcagaaaaagtttcatgcttgtattgaggacataatacactttaataacatggcaacctttttaatgtttttagatattttgcaaaaaaggactagtggtcaaaggttaaaaaagattagttcccattatcagttatttgaaaacggagtaataaataaaatttaggagtatatatgatactacctccgtctcatattacttgtcgctttaagtttctgtttgtaatgtttgatcattcgtcttattcaaaaaattttggaattattatttattttgtttgtgacttgttttattatcaaaagtactttaagcttgacttattattttttatatttgcactaatttttaaataaaacgaatggtcaaacgtttcaagaaaaaagtcaaagcgacaagtaatatgggacggaggcaatacttatgatagttatgtgtttaattcttgtcattttagcttgattatttcatttgggcttggaatggagaaaacattattcagattttggctggtatttgaatgagtggaaaggctgattctgcccggaacaggatggaataaccagcatagtagctgctagtacacagcctcctctgctggtttgggtggtggtactgcacattccagccagttccagattccagaatggaattgataagatctcttctttgccacttctgaataatggaataagaagaattcttccattctttttctcgagggagaaaaaccaaactaaagcagaattcctagtaaaaataaatccaggattcttccacttagatgaaacagcttagatgaaatagtaagtaatagtcccgctcgcatccatggtaaatgttaaaggaattatacttgcagggatacggaaatacgctagtcactcagtttctgaagactcaagctgttgatttcagctttcgtaggggtcatttggggattgtttaagcatagggatgggcgaggtatggttcaattgacaggtggttgttatgtgaattgaattttcattttacaatcaagtgactgttaaaaaaatacaataaagtggctgaaaataggttgtggtagaaacaaggtacctggtgactatgtccctttttttagcataggccttagagatagtttaccacagcacacaagagcatcacttcatcagttcgtggacctctaccaacgatgtccataacaaatgaggtgttgattttttttattttcttgtagttatctgtctagtattcatatggtagtgcactaaataaataaattccaatatatattgtcctgaagcatccatgactagccagattttgcatgcagttacacatgttttctccctggagatatttgctttacctttcttggtggaggtattatttctatggagagccaataaaggattgaattgtgttttaacagcttgcattatttaagtaaatagacttttttttaaaggactaacagtgtccaaccagcaaaatctggcccagccataaactatggttgggacacattgaacaggacaaaccgactttacttgcctaagagcatttcttccctttctccatttgctataatagtttggtaccattttggggtgtttgttttatgtactgcaacatggatatgcaggttagagcgatgggatgtggtctgctggatagtctttatgatgcgatcaatgtctttaatgagaataaatcatcatcaaatattcctggtaccaccactgagcttatggaagtggagccaccaccaagtaaaagaaaatcaaaatgtgtcgcgaaaggagacaatgataccaatgttggcagcaaggatcctggatgcagtactctctctctctctctctctccccctgtggcacacacacacaacactatttgttttgtttgatcttcacacagaattctgtgccatgccatggaactgaaagaaattgaaattccctttatgttgcttttcgaaacttgcaacacctaagtcaaagaaataccacctttttcacgtttatcatatattcctgcaggtgtcacagctgatgatgtaatcaggagaattactgaattttttgagtccaatcgtggagtgtccagaaccgatgcttcgcaagtgagaaaatctacattcttgagaacacttctcgattgtgaaacatgcataactgctaaattttcagccaaccaatttagcgctcttggccatggtactttcctcgagttcttggggaaacatgagcaacatttaccccctaagttgagcagtttcttgaaagtcggaaagttaacacattcttcagtggaagtttctgtactgcagcaacagattgaggttttactctgccaagctgggggtaattggcttgaagatggtgagttttcggaggatagtttctctaagcttctcaaaaggcaatttccaactattagctttgatattgtgcaagataaatctggagaaggacttcttgattctattgagagacaaaggaaaaacatagaaataaataatatcatgttttctatgtctttgttggagaaacggtggtctggtattgttccaggtaaccatgataccgttgatgggctaatgaatgatattcaacaatcttgttctgtaacagtctcctcacaagaagcaattaaatgtttgcttaaggctccaatgctgtcagatctacttacttggtcgcattgggatttgttgtttgctccctctctgggttccttcatgcactggttgctgaatacaggcccagttcaagatctagcttgcatcgtgaccacagatggtaggtttattagagttgatccatctgctactgttgaccaatttttagaaggcattattcaatgttcaccattccaagtggcagtgaagctgctttccttgctacatgtttataatggttctaccaacactccaatttccttgttgaagtgttatgcacaacgagcaataggcatcataatggacaacggtaatgatttgctgaacactaaatctgaaggcaaatcctttagtgcaaggaacatttggtctgatatgtcaaaagacattgacgacatagttcatctggttgccaaatttgtacttgactgtcttggtcatctaccttccgaattccggagtcttgcagcagatgttttattggcaggacttcgaactatcacgaagaattgctattcagccatcttgcttgaagccactgaaaccgggcagctgtgcatgcttcatgatattgggttatcacttggagtagcagaatgggctgaagattgtcgcagattatgtttaactgacgaaattcatgcaaatatagaaatgcatgcttcttctaggcatccatcaactgcatctggagttgctatatgcgaaaactctaacttgcttaatgctactgatgttgatataatgaagaggagcaagtcattgcctggcaaggataatcaaattgttgctgtaagtaaaaaccaaaatgtattaaatatcgtcacagcaaagcttgatactgcagaattcattactaacaaatctcccaccttgggagaagtgaatcctgaggaagcaactctagttattgagaccatacgccgtgaagaatttggtttggatcagtccttaagttgcactgaaaatagtttgttgaaaaagcagcatgctcgacttggcagagcacttcattgtctctcacaagaactatactcccaggattctcacctacttcttgagctggtaaacttctccctgcatgtttttactgccttgttttcttcgcttgctctggaggcgatagcatgaacatctggatttcttttttgctgacattaatgtactctaatcaggtacagaatgctgatgataatacttatgttgaggatgttgaacccacattagcatttattcttcaagacaatggtattgttgttctcaacaacgagagtggcttctccgctgaaaatattcgagcactttgtgatattggtagctcaacaaagaaaggatccaaccagggttatattggaaataagggcattggattcaaatcagtatttcgggtagggtaaaatcatgttctaactatatttaccttagtgctgtgtaaattctgtggttgcatgccttcttatatgtagttacatgatcttatcgtaacagttaattgcttcattgtttatacttttacaccttgtaggacctttgagttatgtaggaatggttccattttcattccattattatatctttttcagatcccctgatgctcccgagatccattcaaatggtttccacgtgaaatttgatattacagaaggccaaattggttttgtattgccaactgcagttgcaccttacaatactgattctgtaagtagaatgttatctgttgaagatgtcaaggactcttcttccttctggaatacttgcattgtgcttccattcagatcaaaattcaaggagggtaccggcatgcactccattgcatccatgttttcagatctccacccatctctgctcctgttccttcatcggctaaaatgcatcaagtttaagaacatgatgaatgatacgctattggttatgagaaggaaggcccttggtaacggcattgtgagaatttcaaatgggaatgatatgatgagttggttggtagttagcaagaagttacagggcacaattgtacgcaatgatgtgtgctctacagagatagctgtggcatttactttgcaggagactcagatgggggagtatgagccttacttgaagcaacaacccgtatttgcttttctacctctaaggaattatggtcttaaattcattcttcaaggggattttgtcttaccttcttccagagaggaggtggatgctgataatgcatggaaccagtggttgctgtctgaatttccttctttgtttgtcagtgcacaagaatccttttgtgctcttccttgcttccagggttgccctggaaaggctgttacaaccttcatgagttttgttcctctagtgggagaagttcatggattcttttgtcagctacctcacttgatcctttcaaagttacgtctcacccgttgcatggttttagagggctctagttcgcgatgggtctacccatgcaacactcttcgaggttgggatgaacagactagaatattaatttctgatagcttacttctggagcatcttggtcttgggtacctatcaaaagatataatcatatctgatacattatcaagggccctaggtattcatgagtatggaccaaaagttttgattgacatcatatcatctatttgtcgagttgatggttgtattgagtcactggggctggaatggctatgtgcttggttcatttctcttcatttatcattgatgcaccattcttccaaaaatcttccattaaccacaagccctgaagatcttttgtgtgctctcagaaaaataccatgtattccactttcagatggttcatttagctctatagcagatggacccatatggttgccttatgatgttctcaattcaaaacctgattccagaagtagtatgctgaactttcctgttctatatagtaaccttcggacaataaaaccccgccttctatctgtgtcttgtcaaaacaagtatctcacagaagaaatgcgagcaaacgacctgatggacattctgctgaagatgggagtgcggaagttgtctggacatgatattataaaaaatcacatcctggtgtctttgtctaacagtacagaagctaatgtggccaatacaatgatgatagagtatgtgagctttataatgcttcatcttcagtctccttgtgcaagctgtaactttgaaaaagaagagataatgtcagaactacggaggaggcctatcttacttacgaaccatggctacaagtg

SEQ ID NO: 36274 - DNA, 3065 bp, Oryza sativa
  unsure (1)..(3065): unsure at all n locations
nnnnnnnnnnnnnnnnnnnnnnnnnnnnnnnnnnnnnnnnnnnnnnnnnnnnnnnnnctatcttcagcctatcccagcctttgcgaattctttactgaggcatgtggtgtaccaaaggttcccaagacatctgactatgttgatatacttttagggctgtcgaatgctgcattaccttcagaagtagccaatcaggtaagttgattttgtgcatgaattaccgaagattatattttgtaatagctcatcagtataaagcttttatatatttgaatgttgtctgtagctatttccagctaattattgtttttacaacaaaacaccattctacatgattttgtcttgtaaggtatctcctttaaatttccatctctctttacactctctatgtaggtctttcatgtgtttgcgaggtgggctaatgatctccattctgcaaatgacaatatgaatgatatattgttcttggaaggatctcttcaaaagttggagacaacaatactgccaaccttgggtgataaatgggtctctctccatccttcttttggccttgtttgctgggtagatgataatgagttgatgcaacactttgaggactacaatggtgttaacttcatacaatttggagaactttcttatgaagacaagcaactgctgtatggaagaattgctgcattgctaaaaagcctaggcatccctgcactttctaaggtaattaaaatcctgttttgggaacggtcattgaccttttttatctacttttacctggaagaccattcatttttgtcactgagagaaattttaataatttcagtgttctttatttatgaaaaatattctccaaattaatctctattaagagaacaaattttatcattgagagaaaatttaataacttctgagtgttctttacttatggaaaacatgttccaaattaatctctattaatagaacaaaaaaagggcacaaaatagaatgattactgaactggctgtggcaccagtgtgtttttcatgcacttctcagatacctattttctacgatccaccactgctcatcctgagtgggtagtagcaaatcggagaaacttcaaggtggatgaatcttgattattttattttatgtatttatttattttgcaaaatatgtttggatgatgctgactttacacagcttttcttttgcggggaactttagccagctgtcaaaattgactgcctttgatgagacgctcagttcagttgatagcagctgaaaatatgcgttctgtctgaatgctgcacatgctttgatatttaattcttacacatcttttactgattatgtaaataaataaatgcatatttaacaattgcatatatacatcaaattgctcaagcatacgagtaggaacttacatattgaatattcttagcagcaactattgtccattttctgtatgtttctcatccaggattgttgcccttctcataggttatttatcgtgaagcaatattttacggtacagtggataacagagaaaaggttacagtaatttcttggctattaccatatatgcaacgctacatctataagatgcatagagatacatatgtaaactttcaacaaaatgaaatcacgaagcttagcaatctccaagttattgttgttgagaagttattccacaagtataagctgaaagaacgtgagagttcttgtaagagaagattcaaatgcaattgcctattgcaggttagtatctacctttctattaactacctgctcttcatttgtttcttattcttataagaaagagaacttctggagaagccctttttgctagaattccacccacaaacaattgtatttcaagttctgattattttgatttatttttttccacatgtggaggcctgtagggtagcattatttatcgacctccttaccttctaagcttcatgccttttgaactttatgctatgcaaatgcatgcataatgtactcattactcaacagtaaaattttactctgataaagtcagctctgatttcccaaatccatttgttatgttccttatttccagggaaataatctatatgctacgcaagaagctgattcacattcactgtttctggaactgtctagacttttctttgatggatcccctgatctgcactttgcgaactttctgcacatggtcaaaaccatggcagattctggcaccacagctgaacaaatagagtcttttatcgttaataatcagaatgtgcctgatttgcctgagcatgaagctgtttggtccttttcttccttgatcatagcagaccaagatgttgattgccaaagaactgaattccaatctatatgtgacagtcagaaaactgaaatccgatctacatgtgaactcaatatttccaagcatcagagaacgtctggagttgcttcaagttggccaccaaacgactggaaaacagccccagatttcataacatctcacaatagccagtttacacccaatcaagagacaaacttgaacaatgttgtaccttcgttagacttaaccaagactcagtgtgaaaactcagaagatattgtgggtcctgttgatcttgaaggggattggattacagaagatgattttggatcagaaaatacagtacttgcagaacgtataggggcaactggcgatgagcctcatatggtgatgtcgattaactctgccaatttgccggcttatttggatttagaaaccggaagctcagcaaactcagtggtggatattgagctaacagaattcaatgataaactggcaaatgtttcggagaagagggataggctctgcataaaggctccagacagagacaaattattgagaattggcaagcaaggggaagctgcagcccaccaacattttgttgatcattttggatccaataatgtcaggtgggtgaatcaagaaaatgaaacggggttgccttatgacattgttgtcacacacaaatcgggtttcacagaatatgtgnnnnnnnnnnnnnnnnnnnnnnnnnnnnnnnnnnnnnnnnnnnnnnnnnnnnnnnnnnnnnnnn

SEQ ID NO: 36275 - DNA, 8509 bp, Oryza sativa
tgcacctttgggtaagcctttactcaatagaaagggaggttgtggggattttgccactgcacctttacttcaataggtacaatctgacatacgctatatcagttttgtttggctccatatttaccaacatagggttttccatagtaagctcattctatgctttctggatatactacttgtcgcgatggttctcggccatgtcataggacatcacctcgtctaacttgtaattttagctgttgtaactattcatccaactttgtggcctcggttttcagttcgaggttcttgatacatgaacgtgcctgatcataatgaaaagtcccattgcaattgtacaaatatctcaattttaattaccatgtgttatttactttccagtaatacgttaccagaatcctccaatttcacatatacaaagaggtgtgtgccaattccatactggagtactcctatatttttaagtcacatactaagggtgtgtttagattccaaaataaattttggtcaaaaatgtcgcatcaaatatttggacatatgcatggagcattaaacatgggaaaaaaaatcaattgcacagtttgcatgtaaattgcgagactaatctttttgagcctaattgtgctatgatttggcaatgtgatgctaagtaaacatttactaatggtggattaattaggcttaaataataaatttgtctcgcagtttaaagacagaatatgtaatttgtttttgttattagtctatgtttaatactttaaatgtgtgtctgtatacttaaaaaaaaaatttggacgatgaactaaacacggcctaacatgaggagtatgtgtagcgagctttcgaatgccaacatgaggagtatgtgtagcgagctttcgaatgcacaaggtcattcatacctgttgttcagatgaagtttttatgtgaccggatgagcagtggggacgtgtggtcctttgcccagtcgcaccaacatctattactagggacacgggcaccaactgacgacattacgaacaatggcccggtttctcgaggagtaccagaaatctaacttgcgagacaactgccacgaactaaactgacgaactagatggaacgaacaatcccgtgcaatagtccctgcctaaactgccgtcctcatacccgtcgttcgtgtcccatacgtggaaccgatcattgcaccgtgctatgtactttggtcgggtctagtccagccagaatatggtggtggtgtcggcgcagccgcactaacgcggcacgtcgactcgtcgtacctgctgcttgtttttttgagtggaaacggactcgcgcaccggcagcaggcgagcgggagaattccgttgcattcaaaccaaaccaacctaaccagcaccaaagctgtggccagccactttaccccctcccgcatcgcacgcgccccgacctaacgcaacgacccgacgcgtctcttctcctcgtcgtcggtgccgtgccgctccggttggactctctcctcgacggcgccggtctcggcctctcgggttatctccgcgtcgtccaaacgctcgcccacacgcgaaagaaaaacgcacacaaaaacacacgcaaaacgagccgttgcgacctgtctctctctctctctctccgctaatccggtgagtcccccaccaccgcaacggtccggtctttaataaacacccagcctcccacttcacctctcgcttcgcttgtcgcttccgcctcgccacgcctcgcttttccaatgccgccgccgaagcgcgcgtgccgcctcgcgctgctcgccgccgggggagcctacctcctcttcctgctcctcttcgagctcccctccgtctccatctccgtctccactgcctcgccggcggcggcggcagcggccaccacgcaccgcccgcgccgccgcgagctcgaggcggcctcctcctcctcctcctcctcctcctcgcctctccgcccgctcaagaccgccttcccttcccgccgctccccgctcgccgtctcgtcgatccgcttccgccgccgcaactcgtcttccatcgatgcttccgccgcctccgccttcgccgccgcgcgcccgctcatgcaccacctcctctcctccttctcttccccttccccgtcgtcctcgccgtccccatctccgtccacgtccgattcatgcccgtccacgatctcggtgcctacccaccgcctcacaagcggcggcggcggtggcaatggcgggggtgtgacggtggagctgccgtgcgggatgggggtgggatcgcacgtcacggtggtggcccggccgcggccggcgcggccggagagcgagccgaggatcgcggagaggaggggaggggaggcggcggtgatggtgtcgcagttcatggtggagctgctcgggaccaaggcggtgcagggcgaggagccgccgcggatactgcacttcaatcccaggatccgcggcgatttcagcggccgccccgtgatcgagctcaacacttgctaccggatgcagtgggcgcagccgcagcggtgcgagggctgggcgtcacagccgcacgaggagacaggtaaactctcatactactatatcttatcacttggtatctaaattcccttcaaaaatgtatatttaaatgttaaattagcctcaaactgatgtgaactttaacattttggcgaatggttttggccattcagttgacgggcaactgaaatgtgagagatggattcgggatgataacagcaagtcagaggaatcaaatgcgcaattgtggttaaaccgtttgattggtaggggaaatgaggtggccgccgataggccatacccgtttgaggagggcaagctgtttgctttaactgtaacagctggtttggatggctaccatgtcaatgttgatgggagacatgttgcgtcgttcccttaccgcactgtaagtttgttaattatgctcctatagattgctggtcagtttttttatgccatcataagatttgattatttgattgtggtttaattgttggtgcaacagggttacagtctcgaggatgcaacaggcttgtctttgaagggagaccttgatatcgagtcgattttagcgggacatttgcccaattcacatcctagtttcgctcctcagagatacctggaaatgtctgaacagtggaaggcaccaccactgccaactgaacctgttgagcttttcattggcattctttcagcagccaatcattttgctgagcgtatggctgttcggaagtcatggatgattgacacgagaaaatcatctaatgtcgttgccaggttctttgtcgctctggtaggtacttatgttcatgactgggtttttcgaatatgttatttgcctgatgcaaactctaaccaaaaaagcaccttcacagaatggggaaaaagagatcaatgaagagctgaaaaaggaggcagaattctttagtgacattgttatagtgcctttcatggatagctatgaccttgttgttttgaagaccatagccattgctgagtatggggtaggcaattggactttactggacaaatacatcattcattttttaccatgcttctatttgattgaccttcatcctcatgttaaccttgtaggtgcgaattgttcctgcaaaatacataatgaagtgtgatgacgatacatttgttagaattgactcagtgctggatcaagtgaagaaagtagagagggaaggaagcatgtatattggtaatataaactactatcacagacctttacgatctggaaagtggtctgtatcatatgaggtaagaatcacaagatgccatttgctttgcgattaaaggagtcacactatgtatgatgctgacccttgattacaaaaatgaatagtctttgttttgtatttccttcataagtggaacttagttgttcagcataatgctgctttatagagctggcacatatattctgctttttatttttatatcaatttatggttcagtgcattcatgttgatcctctttcaaacataactatttccgagttaccatcatttgtcctttaaaacctgacattggcatctgttagtttgttatcatatttctcatggtagcagtgaactagtgatgagttttacgcggcaggagtttgatgtggtttcatgcttctttcaggaatggcaagaggaagtatacccaccttatgctaatgggccaggctacgtaatttcttcagacattgcccagtacattgtatctgaattcgataatcagacgctaagagtacgtttatctaccctatccctggtcactgaacatagaaatggagtattatgtttagaacgtgataaatggatgtatcatttttgtgatgcagctcttcaagatggaagacgtgagtatgggaatgtgggttgagaagttcaacagcacccgtcagccagtgaagtattcgcacgatgtcaagttcttccagtccggttgctttgatggctactacaccgcacactaccaatccccgcagcagatgatttgcctgtggagaaaattgcaattcggcagcgctcaatgttgcaacatgaggtagtatggacgctgacaagagaaagctcgttttaaccactaactaacggccatcaacaaggatgtgtttggaggttcaccattctatgtaccttgtggccattcgttcattcttttggtcagtggccgattgagctactgatgctgaccagatgttccttgtgtttgtctatatacacgttcaggaacgaaaaattctgccactagcaggaagtatgctgattccatccagataattgtctcatcccaattttagattgaattttatgggatagagcgagtataatgtagagttgtagcctccatctaaatttattgtaatagattagattttgttttatcctaattttagatttaatttagattctgttttatcctaattttagatttatttttatgggatggaacgagtatgagcctgttcagctgccagggctgcggccgcagcatgaacagtgtcgcactcactatacgtagccgcagccgcagccctctcgggaaggggctcgataatgtagagttgtaggcactatttacaatgtcatatctaagatggtgttcttttctcttgaagatgaagattaagttttttacgcaaaacgatgtgttattaatatataattgattgagttttaattattacaaacttaaaaaatagattaacaatgatattttagagcaacttttatatagaaagttttcgtacaaaacgtactgtttagccgtttgaaaacgtaccacgaaaatttttatcttcatccaacttttgttggaaaaatgaacaggtatattttgatatattttcgggattaagatagttttactaatttagagagggagcacaagttccaaacttccggtacaaagtgccgcgtgtccaccctgactgttcgtggcagactactgcacctttgggtgggtcactcccaagtcaagcatgacccagcacgcagcagtgccgcaccgcaccgcaccgcaccaccgctcatccgagcaaacgtggagaggaaatggcagaatccgattcccccgcaccagcaccggctcgcattgcacccttgcaccgttgcacgcacgcagaaaagaaaagaaaacgtcgcgcaccgacgcggccctcgtgacggacggggtcaaaaccgtcgacgagacggccgcgcgcccacggaacacaggcgatcccgcctcttgtctttccagtgggcgccgcgccggaattccaactccacagaccgcgctacctttcccactcctctgcctctgctctgcttcaccttccttccaccatagcagcggttaaatatttatataagcgagaaaccgctcacccaagcggccatgaacccgctcccatggcgcccctccgaacactcgttatcttcctcctcctcctcctcgcgctcgtcccggcactctcgcgcccggatggcggcggcggcggcttctatgacccggcgcgcgtcacccagctatcctggcgccccaggtcggtctgcctttgagctctttcttggttgggtacttgggtctgcagtgcttggctgcgcgccacctgtttggcgatttgcgtctgacagcgcgaggctcctcctcttgcagggcgttcctgtacagcggcttcctctcgcacgacgagtgcgaccacctcgtcaatctggtgagttgctgctgctgtgattccctcttggtgatgcgaatgggagattgttgtgagttgcgatcttgatgctttttgttttggggaatttggggttgtgacgttaggcgaaggggaggatggagaagtcgatggttgcagacaatgattccggcaagagtatcatgagccaggtgcgcaccagctccggcatccttcttatcgaagcacgaggtaagcaaaatgtgcatgttatgctgcgcaataccgcttcttcaatttgttcctgtatgctgttcggtgctgctaattatatagccataaattgatcgtatattcatatatgcgtgggagaaaagaatttgtctctgtggttagtgcattggattagctcgatattgtgttcgatcattagaaatttcgccggatctggctttatggtaatgcaaaagagattgatttgttcttcgattttagtttctagaaccttagtgtcttgactttgatacggtactctcaagagtcagcattgctaacctactcctttttattttgacccattcaaggacgacattgtttctggaattgaaaagcgtgtagctgcttggacatttcttcctgaaggtaatttcgcgcgactttatctagtttgtcttttggagtttggagctagattaccattctctggctggtctctttcttgatcagaaaacgccgagtcaattcagattctgcattatgagcttggtcagaagtatgatgcccacttcgattatttccatgacaagaacaaccttaagcgtgggggtcatcgagtcgccactgtgcttatgtacttgaccgatgtcaaaaagggtggagagactgtatttccaaatgctgcggtatgcaattagctttgacattacccccttgtaatttcccaagacatctagtttagaagttctttgccattgcttgcagggaaggcatttacaactcaaggatgaaacttggtctgattgtgcaagatctggcctggcaggtagccttcaccccctatacatttctgaacgaaatggacaatatgaattgcctttctgcacaaagttaattaacctcagtagtaggaactaacgagaccaatttatcttcatctcctctctcagtgaagccaaagaaaggcgatgcgctactgttcttcagtctccatgttaacgcgacaacggatccagccagtcttcatggaagctgtccggtgatcgaaggcgagaaatggtctgcaacgaaatggatccatgtcagatcatttgataatcctccggatgtaagcctggatttgccgtgttccgatgaaaacgagcgctgcacgagatgggctgctgttggagagtgttacaggaacccaaaatacatggttggcaccaaggattcgctcggattctgccgcaagagctgcggggtttgcgatgcttaaaccctgcacccgccaaactgaagatctgaaaatcaaagtgtcatgttaggctgttagctattttcgcccactttacttacacagttacactacttgagaagttgagatgtacataacagacaaagcaggtttattagtatgtgtttctgtgtagtttaaccttgaacgatattgattgaaagtaattggaactttttttcaggtctaaagtgctactgaaatttttcgcaaaaaagttgggagtatttcttttagaggaaaactgcttcaatttgctctggtttctgtacgctgcatccgcttcggattaaaggtcactcgtgggcctcacgttttaccccagcccagaacacgcgttgtaccgttccggccgaatcagtatgggcctcacgtgtgtcacaatctcgatccggccttccggcccatctatcacggtccacaccttcgccgcattcccgtttcggcccaactagtacgggcccgcacgtgcgaagaagcctaagcctatgggcgaaaaggcccacacaacgtgggcgccacttcacgacgtggtgggcagccggaacggcggttcgtccgccgccagttcgccggagcaccgccgcggtcctaccatccttccttccgtcggatccatctactacggccggagatctcaaccagccacctacctgtatggatgcttctagtagagtctctcctaccgatctgcccgcccttgcccccccacggccaccgccgccgccggcggccggcaatcagggaggcaacgcgtcggcgaatgcgagcgctactcaaggtattcacctatgcaggtggaattctggctcgaatttgatattgcgtcaagctcgcc

SEQ ID NO: 36276 - DNA, 723 bp, Oryza sativa
  unsure (1)..(723): unsure at all n locations
aaaagagattgatttgttcttcgatttaggtttctagaaccttagtgtcttgactttgatacggtactctcaagagtcagcattgctaacctactcctttttattttgacccattcaaggacgacattgtttctggaattgaaaagcgtgtagctgcttggacatttcttcctgaaggtaatttcgcgcgactttatctagtttgtcttttggagtttggagctagattaccattctctggctggtctctttcttgatcagaaaacgccgagtcaattcagattctgcattatgagcttggtcagaagtatgatgcccacttcgattatttccatgacaagaacaaccttaagcgtgggggtcatcgagtcgccactgtgcttatgtacttgaccgatgtcaaaaagggtggagagactgtatttccaaatgctgcggtatgcaattagctttgacattacccccttgtaatttcccaagacatctagtttagaagttctttgccattgcttgcagggaaggcatttacaactcaaggatgaaacttggtctgattgtgcaagatctggcctggcaggtagccttcaccccctatacatttctgaacgaaatggacaatatgaattgcctttctgcacaaagttaattaacctcagtagtaggaannnnnnnnnnnnnnnnnnnnnnnnnnnnnnnnnnnnnnnnnnnnnnnnnnnnnnnnnn

SEQ ID NO: 36277 - DNA, 684 bp, Oryza sativa
ccgagcgcgggcgcggcagcgcgccggcccggccgttgaagcgtccccaccgggagacgctctcggcggcggggaggtcgtcgaggcggctgcccgggatcgtctccgggctcgacctccgccgcctcaacgcgacccgctccggctcgctccgcaaggtcgccgcggaggccgctgcggccggggctcgcgtcttctccgagctgcaaaccctcgcgggcaccgtgactgagctggatgcgaccggggaggaggagaggagcaagtgccctcactcgatcgtcctcaccggcgacgagttccgggtgaaggggcggaccgtggagctgccgtgcgggctgacgctcgggtcgtacatcacggtggccgccacgccgcgcgcggggcatgccgaccgagatcctaaaatcacgctggtgcgggagggggacgagccgatcatggtgtcgcagttcatgatggagttgcaggggctcaagacggtggacggtgaggacccgccaagaatccttcacttcaatcctccgctccgcggcgactggagtggcaagcctgtgatcgagcagaacacatgttaccggatgcagtggggaactttctccgctgcgagggcctgagggtccgtgctgatgaggagacccgtatgcaccacccttgccctcagatgaaacacgatgaacctat

SEQ ID NO: 36278 - DNA, 476 bp, Oryza sativa
  unsure (1)..(476): unsure at all n locations
gttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgccatgcatctcttttctcattgcactcacatnnnnnnnnnnnnnnnnnnnnnnnnnnnnnnnnnnnnnnnnnnnnnnnnnnnnnnnnnnnnnnnn

SEQ ID NO: 36279 - DNA, 518 bp, Oryza sativa
  unsure (1)..(518): unsure at all n locations
nnnnnnnnnnnnnnnnnnnnnnnnnnnnnnnnnnnnnaagcggatcgacgagacggcgagcggggagcggcgggaagggaaggcggtcttgagcgggcggagaggcgaggaggaggaggaggaggaggaggaggccgcctcgagctcgcggcggcgcgggcggtgcgtggtggccgctgccgccgccgccggcgaggcagtggagacggagatggagacggaggggagctcgaagaggagcaggaagaggaggtaggctcccccggcggcgagcagcgcgaggcggcacgcgcgcttcggcggcggcattggaaaagcgaggcgtggcgaggcggaagcgacaagcgaagcgagaggtgaagtgggaggctgggtgtttattaaagaccggaccgttgcggtggtgggggactcaccggattagcggagagagagagagagagannnnnnnnnnnnnnnnnnnnnnnnnnnnnnnnnnnnnnnnnnnnnnnnnnnnnnnnnnnnnnnnnnnnnnnnnn

SEQ ID NO: 36280 - DNA, 797 bp, Oryza sativa
tagagagtgtaaagagagatggaaatttaaaggagataccttacaagacaaaatcatgtagaatggtgttttgttgtaaaacaataattagctggaaatagctacagacaacattcaaatatataaaagctttatactgatgagctattacaaaatataatcttcggtaattcatgcacaaaatcaacttacctgattggctacttctgaaggtaatgcagcattcgacagccctaaaagtatatcaacatagtcagatgtcttgggaacctttggtacaccacatgcctcagtaaagaattcgcaaaggctgggataggctgaagatagcatctttcttgggaacatactaatcttattcttcattgaaatgactttctctgttattatttcagaacagcctgttgggtcatgccaatacagatcttttggggacaagaattttccaggaacaaaatcattagatcgagcacggtttaatggtgtaaatatagaggagcaagacaaaactcccgtttaatgtcaatcgttgcagtggcaaaaccttctgacacaaaggtgtagaatttgcacatctggtccatactgaaaaaagaaggtcaaagcattaccaagtttagaacaaagatatcccattcttaaactgcagtacatacatgatatagatggggactgggaatatttagattagtactccttacatgactgatacgctctaaaattgcagatcacaaaatgctatgattaaaatacagacattgaaatcaagtaccttgcactaaaagaagtctgtgaag

SEQ ID NO: 36281 - DNA, 713 bp, Oryza sativa
  unsure (1)..(713): unsure at all n locations
nnnnnnnnnnnnnnnnnnnnnnnnnnnnnnnnnnnntttcagtgtagggtcacctgaaatgcaaacttgcatgcagtttcaaatccttcctcaaaaaaaatgatcatgtttcacttcttgcattctgcaggggaaccggcaagtcaggaagatctcccggccgagcgtatcggcacgcatccccaggcatggaaggttcccattcaaggaaggcaggcatatctgtggagcaaaaagatggttgcattgcaaggaggaacaaaacaagaacaacattatgatggggtctggctgtggatgttggtgtaactagggggagggggcctatatcttctgtaaacactgctatttaaaacagttttaaacataaaaactttaactttttgcaaacaaaagctaatctaatggtggggaaagtttttttgtaaaaaaagcaatgagtattaaacttccctctcacaacaaaacaagcatcaaaaattcttggcaaaaggatgtgggcaagaactcccttcttttttggcactaataactttagacatctaactagaactttggttcttttctttttttttttttttagcccaaacattcattcttttcccttgtcactgtgtatcacttacaacatcatatcataaatttgccccagagaaaaaacatgtcaagaaaggacccaccttttttttaagctctggctcttaccttctgat

SEQ ID NO: 36282 - DNA, 9311 bp, Oryza sativa
  unsure (1)..(9311): unsure at all n locations
nnnnnnnnnnnnnnnnnnnnnnnnnnnnnnnnnnnnnnnnnnnnnnnnnnnnnnnnnagtatgggcctcacgtgtgtcacaatctcgatccggccttccggcccatctatcacggtccacaccttcgccgcattcccgtttcggcccaactagtacgggcccgcacgtgcgaagaagcctaagcctatgggcgaaaaggcccacacaacgtgggcgccacttcacgacgtggtgggcagccggaacggcggttcgtccgccgccagttcgccggagcaccgccgcggtcctaccatccttccttccgtcggatccatctactacggccggagatctcaaccagccacctacctgtatggatgcttctagtagagtctctcctaccgatctgcccgcccctgcccccccacgggcaccgtcgccgtcggcgggcggcaatcagggaggcaacgcgtcggcgaatgcgagcgctactcaaggtattcacctatgcaggtggaattctggctcgaatttgatattgcgtcaagctcgcccaagtcaaaagcccctctccccaacttgcagttgttttactgcggcctccagcggtcgccgctcctgcggttttccgccatcccgggcgcgcgatgccgtgggccggcgagggcggcgacacgttgtttcgagaaatcgatgctgtatataaacgattcttcagagattggctgtggaaacaagagccatttgatcttggattgggaaggtcaggttgcaagttcagttccattaccagaatcgctgctactagttgctagaccatggagatgcgtcgccttcttgtcttgttcgctctcctctccgtcaccgccgtcgtcccggtgttcttatggcccgacaagaagggcggtgctagtgacgtcgccgtcgtcgtcgcggcgcctccgttcaatgcgtccagcgtcaccattatctcctggaaaccgaggtatagtggtgtgatagtgataccggaggaagtagtagtgcagggcggatatgatgtttttgctaagttctttgtgttggtattgtgcaggatatttttttacaagggcttcctttcagatgatgagtgcgaccaccttgtcaagttggtacgaattaaacattatcaggctatttatcgttcttaacatgctaaaatgggaagtagtggataagtttggaatgtttctgatcccaggggaaggagaagctgaagaggtccatggtggcagacaatgagtcgggaaagagtgttatgagcgaagtgcgcaccagctctggcatgttcttggacaaacaacaggtagcagaaatatgcagctttgcatacgtaacattgttagtctaaatcttctgatgtttacatttatacaagttatgtgcttctcaattgattgtaattatcataattcttcctaatgaaggaccctgttgttagcggtattgaggagagaattgcagcttggaccctgcttccgcaaggtaaacttcttcaggtgtttaatttttctttcagttatgagcgttggttaatgtcagctaacgaatctgcatttgtaacactgctttgtcagagaatgctgagaacattcagatactccgatacgagaacggacaaaaatatgatcctcattttgattattttcaagacaaagtcaatcaactgcagggcggtcaccgttatgcaacggtgctgacatatctatcaactgttgagaaaggaggtgaaaccgtcttcccaaatgctgaggtatctgggttaatctttaatgttagaggcatttgttgtcttagctattaaggctctgaattgtaattcggaatccaaatctgatgcaggggtgggaatctcaacctaaagatgattcattttcagactgtgcaaaaaagggcttggcaggtaatattccaacttaactgagaatgtgttaaacccattgaggaaatgaatctgacaatgttgattatgcagtgaaagcagtgaagggtgattctgtgctgttctttaatcttcagcctgatggcacaccagacccgcttagcctccatggaagctgcccagttatagagggcgagaaatggtctgcgccaaagtggattcatgtgcggtcttacgacaatgcatcaagcatgaagcaaagtgaagaatgttctgatttgagcgagaattgcgcggcttgggctgcatcgggtgaatgcaataacaacgcagtctacatgattggaacggaagatgcacccggtcagtgccagaagagttgcaatgcttgcagtttatagaacatttcgcatttggtagactcacccggtctagttggtttggatttgacaaatttgcagacggtgagcttagatggttttacagttcttttgtttattttgggtgaggtgtgtgttccaaactgccaatagccattagttggatacattttgttgttactgcaaatgctgaagacagtgttatgtaactcactgttgtgcagttcagagtgtcatgctggcaggcaactacctgttccccctttattttttttgttgtcttgcttcacagtggatttcagaacagaaaactgtgtcagcttgtctcgatgataaccaacttgtttggccctttccacaatatagaagccactttgtgctcagtgtcaagcttgctccttcaaagaaattccagtctcagtcctgcagtgtaaaagagagatgatttggctacagcaacaatgtttgaggcacttcttttgcaaaatattctgagatcaaccagtcgttttcgcccaaaaagcatctccaacatttcagacaaatatttgaaatgaatggacatcagtgagtatgctctaatgtcatttcaaggggaatttaaacatagattcagaatcattacagattttgagaagagaattactttgttatctctccctcagtgaaaaaggattgtgacacatcacctgaaagtagagtttatttcttcaggatgctgctcactttggacctggcttttggacctcactttgccagggcaaatctctcatgtgtcattcttcccctctcttcctcctcctagagttactcaaagatgaaaaaaaatttccccacatacatctttcttatatgtgacctgaatcatcttccaatacgaatgtacttgatggagaacagtggcagccttaaggatcagatacagatagcaatgcctccttcctactaaaacttttcttttcttttctcactgtcttttctccccctctccatccacaagaacaaacaaaccaagaaattgaaaagaaaaagggaagaaaacaacataactcaaaaagcaaagtgcagaaaagcaagcatggctccctcacttcacttgcctttgattctactctcctctcctcacctccatttaggtccttgaaaagcacagcagaatcagctaaagcaaaagaaaccccagaacaaaacaagaagcaaggatgccacaacagcgactgacacaaatccctgctgctacttgcccacattataatatgcagcagccacattgctgcatccatcgttcagctgcaacaacaccactaccacctcccccataagcagaagcaactcgtagagccacagcagcagcagcagcagcagcagcaagtgtaagtgcaggagagtgagagcaagaagaagaagaagaagaagaagaagagagtgagaaaaccaagaaggccaccggttgctgctatgagacggccggccgggtcatcatcggcggcggcgttggcaatggccatcttgttgggggttcttgtgttgatggcactggtcatggacggcggcgagaagaccggtgcgccggcgatcgccgccgggaggaggatgctggtcggagcagcagacgcagggcagatgaggactctggaggatttcaaggccgatgatcctttccaggacagcaagaggagggtgcctaatggccctgatcctattcacaacaggtactgcaaagcatgtttcattctttctttgcttattttgatttgtgtctccaacttctgttcaaaatactagtccaagttttctgtgtcactatgtcatttgcgtttgaaagcaccagaaaagaagtttgttttttttttgaaaaagaaaacaaagaacagaagtttccatattcatgtccatgcataggtttcttgaagtttggagctgctgccttgttggagacggagtaacaaaatgctgcagctcctcatcaattttaaaataaatgaaacttctattgtgttgttcttgaccagaaatatgaagcttttctgttaaggctaaactacctgcatgtttttcttcttttttggtttctttcttaccaacttgtgattaaggtgtatgtttctgagttctgactcagctgtgatgtgagcgatgtgctggtacctaacaaaacatctgtctttttcaaatttgttatcaaactacaacttcataacactccaaacaaaaatttaacaaaacaaaaaaaaaacaacttgtagagtaggctggggaaaaggaggataaggtgatttggtgcccaaattatgtctgggcataaaaggttgagaagaataaagagaatagaatatataaatatatatgccatgcatctcttttctcattgcactcacattcccctatgatgatatgcaaatattttagcaaaagcaagtagattagtcctagtctcgtaatgggcaacatatatagatacacagatcatacttgaagtgattgcattgcatgcaaatgtagtaatgcaggtaatcaaacaaagtacacctgaaagtctaacgtttttcagtgtagggtcacctgaaatgcaaacttgcatgcagtttcaaatccttcctcaaaaaaattgatcatgtttcacttcttgcattctgcaggggaaccggcaagtcaggaagatctccgggccgagcgtagcggcacgcatcccgaggcatggaaggttccgattcaaggaaggcaggcatatctgtggagcaaagagatggttgcattgcaaggaggaacaaaacaagaacaacattatgatggggtctggctgtggatgttggtgtaactagggggaggtggcctatatcttctgtaagcactgctatttaagacagttttaagcataaaaactttagctttttgcaaacaaaggctgttctagtggtggggaaggtttttttgtaaagagagcagtgagtattaagcttccctctcacaacaaaacaagcatcaaagattcttggcaaagggatgtgggcaagagctcccttcttttttggcactagtaactttagacatctaagtagtactttgtttcttttctttttttttttttttgttccaggcattcattcttttcccttgtcactgtgtatcacttacaacatcatatcataagtttgcaacagagaaaaaacaggtcaggaaaggaccagcattttttttaggctctggctcttaccttctgattagatgctgataaaatcaattgcggccaaaactgactaatttatgctgtaaaaacttcaaaactgatctggtatcttttgtcttgtttctgtctgaattactgtactttaaatccccccccccccaaaaaaaaaagaaaaacaaattctgcacactgaacatgccacaagaaaacaaagaagagaaaagagaagagggtgagggagggagaggataaagactgaagagaaaagaaagaaacggcagccaggcagacagccagagctgcaagaatgcttttttctcctccttttgtttcctccttccctctctccttccattgtccctcacctcttttaacttcttttgttgtaagttagtagctttgaaatttgaacaggcatactcgtagtagctaaagtggccttggttgagctctctaaagcaaggactgatgagaagctgtggtaaaataggtgcttgtgtgtccaaaagatgtgaacttctgaaggactaatctattcttttcttgaccagtcatcttgtgtcctggaagaactgagttatatgtactacatgcatggaccagtgtatgcttggactgctttgttcactggaagagatgcagggctaagtggggacaaagatatttcctatttatacatgaacccacacagatgctccagggtcccagcatagaccctttgtttgtattcttctcatctcaagcatagaactatactactgtactgcatactacaagctatagagttgcattgcatcaatgtaatcttcagtatcacttggtctgttttaatcccagacaaaatgagaagaaagtttagtccacattagtcaatacttaatactccctccgtcccagaatatagactacgatgtactaggtgatgtcctatctaatcttaggttgctatattctagtacggatggagtatcatttatctgatctggtgatctacaatactccatttccaaatgtagtactttatcatcaaatactattcgtttttaaattttgaccatttgtcatttttgccaaaaaaaatgtaaatatttaaaaagacttagtattattgaagtgggatacaccataaacattagcattaagctttattcatcgtaatttgaaaaaatattagtggtgaaagttgaaacggtggcggccaacggtgctaagtattattcggggaacctaagttaagcaacagtttcaacaataatatataccacttgtttggacgattcaagaagagacataagatgatacatgcatgcaagctctcacaaattcaagatgcattgagacggtgagacgtgagacctgaggcgttttattgaattttcatagagaattcgttcgttagtacaaacaggaaagttcagatgcgttgggttttcaagaaggccattgagtagagtgttcgtctacctctgaattttcaggaaactttaccaggcctggcaggtgtacccaagccaggcagaggatctcgtcgcgtgatcttctcttctggttgggctcctggacccctggttcttacaccgagctgttagccatcacagcttcttctcctcgggttctgaaaaggttttggttatctatatttataatatctctatatattgccaattggcgtactggtagaatacaacttgtagaagcctctgtgttctgaagtctgaagcagacctgtactggagcatctgaccagtttaggggaggtgagatgcacacaagacgacagttcatgtctcagcatgcaatgcaatgcatgatttgtttgtttaatggcctcttatttacatctttccagcagttcgcaagcaaattaaacttcctaagcacacccttactgaatgaacaggaggattgtaggttccctgcctgaaggtctgaaactgacggtttgcacaacgggagggtgaaaatgggatggctacccgcccatctgttaagctgtgtgtgcaatttacccttatcaaatatatatgaaaatatattttaaatccacctacaaacgtgatgaaagattggttaatcgttattttacaagctcataagtaatattacatttttttcctcgatgtatattttttaatgcctaatcgcttctctagatttgttatctatgaattagagatacaaataaatatccatttccgaatccgattccgaagaaaaaatatgagatataatacgagttatatgctatccgatactatccgtacctaattctaactttgaaggaatatgcgtatcgggatgctgggatctaaccatacttggactaatttcacctctatgcacaattacgaatttttcaagttgtttaagaatttataagaaccattaacatacttgtacgttgtaatagaccaaattcatataattgtgaataagctagaagggtgattggagataaagtattggattcgatggttactcacgtgaaccttacggacacactcatatattgcacgaactgtccaagttgaatgttctattacttgatccagcaattcagaacacgaatatgtgattattacaaaaaaaaataaaagagataaggtttttgttatgaagcgcttgatttatacagcctcgtagtaaaactgttaccaaaattttggcacacggtagacaactcgtatctagatccggctcctctgcctttagactcaaaaggtagagaggtacacagcaaaaatatgtcttgttctacagtagttcgttcgtttgttgtgaatcgaacggctaaaaatacttccaaagtcagagcagtagagctctcagatgatccaaatccctcgcataccacccccggcacgtccatagacttttgagacatatttgtacttcctaggccgagttgctgagttatgatctgctcccaaccggaagcggcccatctggcggcccaacccgctccgcattacgcatttgcactcaacgcagcgcgacgcggcgtgtcgcgcacaacacaacgacagcgcgcgcattccacctcctccacgcctgcacgaacgtactgtactccactactgctgcgtcgcactgtgcattccaccgatacggaggccacgtcgccgtccacctccgaaagctagtagtattactgttactgcgcgcgcatttacacccaccacttgctctcatttactccccttcacctgcccaccctgtccctcctctcctccctctatntaacccgcaaacgacgccggccaccattgcaccacctcagctcgcgccgcggaacacgagacacagagagagtagagatcgagatcgagtgctaagctagctagagtcgacgatggcgaagtggtgcagctcggcgtcgcgtcgtccctcctgctctgcctcgccatggcgcacgccgcggcggcggccagggccgtgcccggcggcgacggctcgacgacggcggcgtcgctcccggcggcggcggcggcgggcaccggcgcgggcgtggaggacaagaagaacctcttcgtgggcgtcggcggcatgggggacctcccgggcttcccggccgtcggcggcgggctacggcgggggcttcggcaacaacggcggcgccgtcttcagcggcgtcaccggcccgctcggcggcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36283 - DNA, 13550 bp, Oryza sativa
tcatttactccccttcacctgcccaccctctccctcctttcctccctctatttaacccgcaaacgacgccggccaccattgcaccacctcagctcgcgccgggggacacgagacacagagagagtagagatcgagatcgagtgctaagctagctagagtcgacgatggcgaagtggtgcagcttcggcgtcgcgtcgtccctcctgctctgcctcgccatggcgcacgccgcggcggcggccacggccgtgcccggcggcgacggctcgacgacggcggcgtcgctcccggcggcggcggcggcgggcaccggcgcgggcgtggaggacaagaagaacctcttcgtgggcgtcggcggcatgggggacctcccgggcttcccggccgtcggcggcggctacggcgggggcttcggcaacaacggcggcgccgtcttcagcggcgtcaccggcccgctcggcggcgtcgggggcggcatgggcagcgtcggcccggtcggcgggttcggcggcgccggcggcggcaccccgttcggcgggttcggcggtggcggcgccggcggcgtcaccccatgaaccgtagtattactgagagctacgtacgatctcatgcatctacgtgcgccgcgtgcgtatatacgcacgcgtggtgcacgtgtagtagctagtgtcatcttttgcttttgagtgtcgatctcaggtgagttgcatgcatggttgggcagggaggttggagtttgtaaaagtttgggtttgtggcctgatggcaagagtcgagtttactagtagcttctagtagttgtgtgctaagttaattgtgtgttgttaagtgcacgtgatgcatgcgagatatgatgactatctttagttaatgactaaatggtattcatgtcgtgcgtgtaaatgttctctagtgggaatgtgggatggcgactcttacctgtttcatggcacagcactggaactggatgtatcccccacaaacgatgtgggctcaggctcagagcctcagacaccatatgcatgacgacgcatggcatagcaaagcaatatgccaatatctatcgagcatgtacagcctgagcaaaagcgccatgaagcagctgtgttcttccccatcttttgcaactcatctctttactttttcccgcgtgcacactttttaaattgttaaataatgttttttttaaaaaaatctatactaaagttgttttagaaaaatatgttaatccatttttaagaaaactaatacttaattaattatgtactaatataataaagattcgttttagtgcgcgtaggattagttccaaacaccacataccaaacacccgattcactcattcacagctacagtgctcatttgcacaagcatgatactatgtactagtaggccaacttaattaattacacccaatccgtaaataaagcatactctatattgctgtgttcactacagtactccggcaactagcagagtactgtacagtctacatcgagatgggagtaggagtttgtaggtaacgtggcgatctcgcgatgaaattagggtgtgttcagttccacgtcaaaattaaaagtttaaagaaaaaagttaaaagtttatgtgtgtagaaaaattttgatgtgatagaaaagttgaaagtttgaagaaaaagttagaaactaaaccagaccttaatcgcgaatccacgatgctgtttttggtacgagggggtagtggactagtggtacgtggttgctcacttgagcctgctagacctagaggagtactactcaacttcaattctgatgacagttgacagcacggccgtgctgcgtgtgctgcatctctcgttgcctccacatcatgctgcagcggatgagtggagcgatccttggaccttgggatctcgaaggcaaggtcagtagtcgcatcgcaccgtacggtcccggagatatggtactacagtacatttgtaaattattggtcgctttgactttttcttatagtgtttaaccatttatcttatttagaaaattagtataaatataaaacagataagccatacttatagaacttttaataataaagcaaatcacaaacaaaataaataataattctatgatttttttttgaataagacgaatgatcaaacgctacaaacaaaaactcaaaacgataagtattttgggacagaggtagtacattagagttgctttcgaggagatctctctagtactcctatcccacagcgccaagctagccaagtactttctccatcccaaaatgtagctgctcagtacgggatgtgacactacctagtacctgtccagattcatggtattagtagtgtcacatctcatactaggcagctccaggcatgacctcaacttgggctatggagattcgatatggctgcattgattgatcgaatcccgcctcgagatctattcctatctcatctcatactcctacgcatagacgtatcacgtaggtgaaccggtcaagggatcagggccactccactcccctcgctctcacgccgccgctgcttggagatgttggaggtggagcaagcccgagcgaagtagcgaagtggtgtgccttgacatggatcacggtctcacggacgccattggtccacccgtcggtcgagctggtggtacatgtggctgtagcgcagtggctccggataaagcttgggcgtacgccacggcggctggcaccgcaagaggcgccatttatgacttggcagcacagagcgggcagctgagccgagagtccgcagatgagagcaggcagctgagacgcagcgtacgcgggtggccttaaatttgcggcagagctgaagagcttgcgataagatgaaggtagaatcaatgcactgcactcatcaggattggccaagaccaaggttggactcggcagtgcgtgcggattggccctggcagcaacggacccatcgggatccatcaggatttctcccagtgtttgcctccgcgtgccctgcatgtgccgaggtgcagctgcagccattgatggagggaggcctagaacaagcctctgggctctgcctgttccgggacgcaccgagcaatgcgcggtgcacacgcactaatgcactgcaccagctcaacttggaatggtcttgcattcgctgcagcaacacacctcgtcggtccttatctactccttgccaactcttcatccaaaacttgggtagctatacgaatcatcacggaaaaatcagatgttactctgtttctacaaccacgacgttcaagaatcaagactgaaccatacaaaacatgctgacgaaaacagaaacgagcttttatgtttcattgaggcctctgcttccatataagatgctgaaaaatagtagaaacgtgaattttctgtttcattactaccggtaacttcttatattagcaagcagaccaggaggaacggaggcattccgggggcaattaagtgaatctaatcatcatataataataataatagaacaaggaggttaaaatccaagctatacacacatagcatccaaaaatacacgacacttcaacccacaacccactgaccgagtcaccaaccagcattcaacagacacgacagcgtaaacactcaggcgccgtaaccagccagagcacaaactagaaagaaccaaacacctctccaatttccccccctttttgccccaagcaagcagtactgtaagtgcagttgaatgagtcaatttatgcctacttgcatttgaatccatggcacacggacaggattatgataaggatgagcgcaattattatgccaagaacaatcagcttgatcttcatgttttgcagccacatctttctccttacctgtgttcctgcctgcctgaaatcttgggcctgcatatgcccagaagcaaaaagcttagatatattgttatttcagacatacagaattgcagcataatttcataaaatcttttgttacggaaattccggctcatgcttagtaaattacaacatcaagttaatctttcttagagccccaaacttagcaacattcaggttagccagaactaatacaagactgttaagatacacataaatttagcccagatggcacaaaagccaaaaacttcaatatccgacgtggaacaccactccataaactatcaataattatgcatcaatattcaagtttgttccattcctttcacaagctcaagaactctttcagaaatgatcgtaaacacctctcagtaaaaactgatactaattcatgaccaatttttagtggcaagaaataataatttgaacaaatcaccacgtttaaagtgaaaaaagtagcacctagacaccacctaataataaccaaaggcagccagtctgccatcaagttagcacctcggtgaacactggaacacctaataccttgacttgtgttttaccaatagaactatgcatccctaataccatgacttgtgtttttacacattcaacaataacaagagtaatctaccccactagttaccaccagggtgctagtgactagtcaaaaatgaagcacacacccaacgtaaatttgcatccacttaattgtgtcattttagcggtatttagaaatatttggcatctagtaaggaaaaccaactgcataagtgggtctctactctctaaaagacagtattgagtagcactaacaataaaagctccaaaagaaacttgaagtgcaataacaggtacagtgcaggctgaaggaacatgtcaggacctgtgaacgcagattctcggtcttgtcaacgagcagttcaattttctctccacgatcaagaacctgcaaagagaaagcaagatcagaagcattcttcaaaggaaatcctcaatgttctgagcataaaaactgtagaacgaatacacaaacacaaagaaaacaaataccttctcaatattttccatcataactcctttgacttctgaaacttgtgccttcactttcgcaagcttgctaatctcttcaggatgatccacacagtactgcatgtgttctttaagtttcgatctacaaatagtaaatagagaagtattagtcgaagggaccaccataactttatcgactctatccctggcaacaatacgtacccaaaatctcggttgaggctgttcgcagcagcagtagcagcttttccaccagcatatctttttgtgaaatcatccttaactctatccaagaatgcaatgggaatctgccgccctactgattcaacagctacgacacagtatgctgcagaagaagtgtggtattagaaaatcaacgtcacaggctttcaagtgataaatggttaaagtaaatcgtaaaacgggtgctctcatatgagatgttaacagaagatacaagcacgtgtgccaaattttagaaatgtggtaactgtgccaaatttgcaaagctaagatcatatgggtataaaaatcagctacttaataaattttccctgctccttattggaaagtttttcaagcactataatcattgatagttggcaacatgatacctcataactaacatattactacttttagtcatcaccaaatcgtggaatttctagcattaatcaccatggcaactccaggtcttattctgaccaaagaaattataataagacatttcagcactgaaactaaactataaattgcgtgcataatagaataacaaggtagcagccgatttcattcaacgcgctatctgcatgcataaatatgagctgaaacttgacaggagcagcatgcaaagctcacaaacagctgtctactaaaaatagcatgcatatctagagggctcgccattgactaaatactctaaggcactggcttacggctttgcgaataatcggggcagacctaaaatccaagctcttacaccatagctctcctatgcatacagtcagtccagggactaaaaaaccggataaaggtgaaaaaaacaatggataatcatatccacttcgatacggcggaactattgaaaggtcctaatcccaaccaacatctgcatctaatctaaccaacaagtgcgatgaccaaacttctcgcacgaactccacagcgcatcacgatctcaaccaacatcccgatcgccgatgctaaccaaaacgaaaacgacctaaccgcgtctccaacaaatcagcgagatctacacccaccatcccaaatcgagcacgcgcggtatcagatccacgcagatcagatgcactccgcggggaatcgatcgggaggaagcaaaaaggatcggacgggggatgggcgagaggggaagggaactcactgaagccgtcctccacgaggtagttgaacgtgtggccgtcgcagttgtaggtgaacttgttgttgctcgccgggagcttcatgaggcactgggaggcgatggtggtgaagttgccggtgaactccgtgtactcggccaggatgaccgtgccgcgggccacgaacgcgtagatcagcgactgctgccccatgtcctcctccctctctctctcccctcgccctccgcctgtgctcgccgccggtgacgtgctcctcgccgccggtgaagttggcgaaccctagggctagatctcggcgaggtaggagaggggagaagaagggggaaaggtcggtttcgctttgggtagtgggaggggaaatgatgggggtggaaatgggaaaagaaatcaaatttggttggtggaattttcaaaaaaggccctttgtttcctttctagttaagtataggcccctggccgccacctgttttctttgctgttaagcgattgatattagctggcattttggactattgtttttcaactttcaagttgattatatgacctctacgtctggtattatttttctctttgttgtgatggaaatcatcggtaggttacaccgttatagctgccttgtaattaatcaaactaattgatgggcaccctaatgacaattttgaaaaggacagatacagtatttcatttttagccacttgttcgttatttatgactgatgctcacatccacaaaattttcttttgctatggtcaatgctctagaaaatagtatatgtgttgtgaagctgtgatatgtctttgtagctataatgggaaacagagttataaaaacataattggaacataggaaagttatccgggttgataacagcaaaatattaattgcaaatatatgtattatattaaaaccttatgatgtagcacgtgtgtaaagtttaaaaaaacattgttctatatatattgtcacacttttttttaaaagttttcatgcatcctcgctcctctttttttgcttgccctgttctctatctctggtgaatcatcaatcgtagtagttgccacttttttttagcatgcgtataaacagattcctctaaactttcaatatcatccatcgatcctcaaattctggaaatagatagaatacaaaatatgtgcattgaaccacggtaattgttggctaacgccgtgtttagttccaaaatatttcttcaaactttcaacttttccatcacatcaaaacttttctacacacataaacttttaacttttccgtcgcatctttccaattgcaaccaaacttttaattttaacttgaactaaacacaacctaaataaggtggtgcaggtgcagctcttaccctcctacattgaaccaccagctctctatatttgctaagttgcacaagtttcaagcaaaaggaagatttgacaaagaagacatggatgacaccgatctggtttgcccgtttctgtttagtagtgttggttgatcaagttagtttggtgttttatttatttgcttagacttagctgagttgacgttttgttcttagcgtttctgtgtgcagtactattttgtgttcacaagctgagatccccaatatttgaaggactagattatgttagacatgtagtaaagcttgatgtatgttttttttatctaaaaaacgatattcttaacggtgaattgcaccacttctatacagtgatgtttttaattcgaaaaaaagaaagccactacacatatgaaactgttgtcttactaccgtccgaccgcgttatggtgagtagcgttcataagcgcgtgtcaaaatttatcacgacgcaagccatttactcttgagatgattattactccctccattccgtgatttagggcgcaactatatttttttccacgtaccagaatatagggcggcacctcctcaaatcctattcatgtgcacggatgcatgtaggctttgaagactttaactcttggttgtcctatgcatggccgcatgcgagcattgaaacatgtcgggacaatgttgtgattggtgctgcatgcatgcgaagcaaagctacgtgttgggacgagcaaactctaattgatttaacggataattacaccactctttggtctatgcgtacaagacagttacgctctaatgctctatatttaggaatggagggagtatatctctgaccatacattatagtagcagattatatcattttgaagaaaaatattaatgcactagcaaaaatagaaaagtctcaaccggagttgttcccctcaccaaaccggtcggtcggaccgaatctccgatccaaccgcacggtcacacggccacagctcccattccgaatctccgatccgcacggggtagaggtaagactagacgaccgcgtccgccaatcaccgcgtggccaaatcccgagcacccccctcttctcttctccccactgtttttaattctccacggctcccttccactccatccactcttctctaaagcgctctctccctctcgtcaccgctactactagtgtacagtgccactgcgagctctcctctccgcccccgatctggtcgcctcgctcgcctcaaaccctagagctccatccaccggcgagccctcttgggcggaggtgcttcattgctgctgctgctgccatggaccccgcccccacgctcgccgccgagctctggcgaacgccgtacctcggtggcggtggtggtggaggaggaggagggcgtgggttggaggcggcggcgtccggggtcacggagcagagcaatgggagccgcgggggtggcggaggaggaggcgcagggcggaggaggcagcgggaggcccccgcgctcgaggacgactcgtccaggatcgtctccacttccggaggaggaggcggcggtcaggatttggtaggtttttttatgctccgcattggtcgtgatccgtgtggcattgggtgagtttgggggtaattttggtgtgtcagccttcggtggtgggaatctggaggtttaccagggaaaatggcggctttagactgaagtaaatttgcttgtgcgatctggccgtgtctactattggcgtggtgctgttcatgctttcttatagctctagctgggttccccgttgatgcttgtttttgatttggtaatgtacagtggaacgagccaatctgtagttctggctgcagatagacagtcactgctatgataccagtatgtaagaaaaggaattctcagcataatttagtctcgaaagttccgtaaattgaaaagaacacagaatgtgcacacaaagtgcagtaaggaaaagctagcactgtcaatagtttcgaattctataattagcaaatacctttggtaattgagagttgagaagacactttgtcaatgctgaatgcagttaggcgtaggaacatggggtgtgtcctcctcacgtggaaggcttcaccagatgaggtttcaagccttttgatcgatatagtttcctctggattgcttgtggaattacttctacatcgtagtataatatagaacacaatttattgttcacagctgggctgagctcagttgagagtgtcatgctctgttacacaggaaaacatggaacaagcttatgtgcaatcgttcatccatgtgactttcatattatagaatttctcattcaaccataagtagtgtttgacctttagtatttataaaacctggagtattagattgtcggttttctattgttaacataatggtttcactatatccaagttgattctgggtgctgtttttgacaaggactacttctatagtgtttgcacctttgtaatgttctcaacttttgtcaaaagaaagaacattataagacattcatattatagtactagttgttagcacccagtagtgctgtagtttgcatctatagtgaatttcctatcatgacattttgatttttgttgcttggtaatgcttgttatgtttgattcactggagtgttggtagcatatgaactcaactctcaagctaacatactactatactagtttatttttcccacaaaaatctaaaaaattttacctctagaagaaatggaactagttttttttgaactacccatcgatgtgaatatggcatagagcttgatatttttcttctatacataactgtagccaacactcaacactcgacattatgttactgctggaatcttcttggagctgtttatatttgatcaagctattggccaacacccgtcttaactatccttgtcgaatgccaagtgcttagtaactctggtgcaatgcaacagcttttgggtctttgactaaattgcaacagttgctgctatctgttcacgctggttaaaagctgttgttagacagactattaaattctatttattatctccattctccagtactaactactgagtcaacaacctgttggtccacacaatgttttggctggagacaaggatcctgagtggttccatggtccaccgtataattgaggcattctgcagcaccatcagatctataaccctagaaattgcatgagctcaaatacaagatgcaatcagcatttctttgcttgcatttagtagccaaaggtgcctgtaatttgaatttgaacatgcacacttaatattagtggaggtcatcattgtcaggcattctagttctttgattctattggtgcatttctatgatttttgcctcatatattcaccaattattgatcatgttgataacttgagtggttgttttaacttttgaggtcagaaggcaatatacagtgccttttcccctttaacctttaaagagaaaaaaaaaagcatggatcatgttttgatatgcacggattatgtggaatttttatgagcagactgattcagaagcaaagcgtttcaaggcaagtaaatcaagtggagataatagcagtttaagaacagaggctgaaactgattcaagaaatgctagcaagtctggtgatcaaaatccgccaccaccagaaccaccaaagcaagactacatccatgtgagggcaagaaggggtcaagctactgacagccatagccttgccgaaagggtcagttagtgtacttgtttttgttaccgttcttgtcaatcacagtcccattacaggagtggaaaatctggttacaaatcgaacctctgaagatctttcttttttttggggggcaaacggtcaatttcatgtttatactatgatatgaccactgaaaattctgttcatttttggcaggcacgtcgtgagaaaataagtgagcggatgaaaattctccaggatcttgtccctggatgcaacaaggtctcaacatattttcctcattttgtcccataagttggggtttaaatattatatttttgtaacatgacctctaaaacatccccagttctgtttctgtaattgattttcattggaaaacttttgcttgcttggccaggttattgggaaagcatcagtacttgatgagataattaattatatccaggctttgcaacggcaagttgaggtatgctgtttcaccattggcgctttatgaaatttctttaccctccatatctcagctaatcgctctataatttgctgttatctgcagtttttgtccatgaagcttgaggctgttaatgctcatgtgaataatggaatcgaagcatttccacccaaagatgtaagtcaagtagtaaaattaacagtttaaatagcatgatcattattacaataaaaggtctcaagatatatttgaaagattctgtggcatactatgcgctactggcactttatcttagctccaatctttgactttgaacactgtgttaatatgttgtttttttcaacaagtcccatactctacaggcaagccagctatatgctactaccatatgttttagtttttgaaggcgttatccattgctcccttctgaaaattattaccattttattgaagctatactcctgaatttcaaaaacgtttaggcagggcaaggcatttaatatctgcagaggatacacatcattgaaacattttcctgatttttactctttatctaaccatggcatttgtctgtttgtttagttcaatgtgtttatgtatttactaagtactagtagctctgtggagctttatgtaaacttccaaatttggtttttagtattaaaattgtttattttcttttgggtcttttggttgcagtttggtgctcaggtatacaacacggctcctggattgacgtttgatccacaaacaccaagagaatacgcccagggatcaacaccatcggaatggctccacatgcagattggtggcacctatgaaagagtgacatgaacagaacaaagtcaggatggtggcccaaaataaagcataccatgagttcagtcagaaaccacggctttagattatttttcgaaactctcgtgctccaaattcgatttcattcatagcatggagctcatgtatttagagactgcgagcacagtatttttacatctgtaccgggatacaattctcatcagattcatgtattccacggaatttcggcaggtcacgctcattcgtagcatgaaagaaaagtaataaccatcaataattctcttgctataaatcctaaagcccttcatttttttttgccatcgtatgcttatctttctgaatcttaccagtagtttgttggtaatttgattactcacatttgctacttcgatcttcgatttgtgtttgtactcccaagtcaaagccatcaatctggcaaattttcacaggatagttccaacaatttgcacaaaattcatctgaactcgttctaagcgaaagaacagggtggatgaatctggagcaaaactgcacaaccagaactgaacctcccgaaaaccccgcaaaccgcacgccacgaatttaccatcctacccctgtatcgcagatgcgtctccgttccgtttcgcagtctgttttgcccccacgcgaaatctccttgttgcccttttcccccttctctcttctcccctctcctcctcctctctctctctctctctctactcctttcctctcctctctccttgccctcctcgcccccaatggttgccgcggccacggcgccacctgcccattccgcggcgagcccttgacccacccctgatctcgcggcggcggccgatccggcacccggcgacgtgtcccggcggcgatggcggccgcaacggcggcgatggcggccgcaacgccgccgcgggggcggcagca

SEQ ID NO: 36284 - DNA, 3701 bp, Oryza sativa
  unsure (1)..(3701): unsure at all n locations
gaagctcgcctccgtcatcaacttccttcacgtgagcgccctcttgctccccctccccccactggctaggattcatggggtttaagggtgtttcgcttggggtgttcggtatttgggcttgacatggctgctctttctccggtgccgcaggtgttccggccattgctgaacataacggtggagttcacgcgggagaagctgaagaaggcgatcctatcgcccaacaatacattggatgacgttcatatgcctctgctgaaggtgatcgtgtagtttctgagttcgtttgattaggccgctgcgtcttagcctcttatggaatggggtttctgagaacagagtgttttttgcctgttataaatgcaaaaaagatgtgcttttgttgttcacatgagtattgaaactcacaaccaaggaattttggctatttgaatccaaaggtgcatgtagtacaatgctactatgatagtcaaacgtattgttatgatacatactgcacatttactacaacatactactaacatcatgttactctggcaatttgctaaggatatctttgtaagaaagtgtccttgatagctagagacggatataagaacatcactttgtagaataatgcacaacataatgccgcaaaatctgtttgagtcgcccatcatgtatctagtatgagtatctactaactacacattctataaacagttttggagttatcttatttttttcatacttaattgcatcttgcagtcgattcctccagtaactcgaatggctatgggacgtggaacatggataacagtgttatgcaggaaattgaagtactggtggaattgggtatatgattttgtcctttctaagaacattttgtgtggaacagtactgcattcagttgtttagctaataaagctagtactgcaggttgcagaaggtgatcttccaattgttgcctcacacgggtgagttccatacccaagcgattcttgattgaatcgatgtttagtgttgtatcttgaatgacttaaaccgattttccttgctcagtgcggaaattgaaatgtacaaggcacttgagccagcaacacgattagtgatccttaaagcaatatgtgatatacgtgttgaggtatgtgccctatgattccagctatctttttgaaatggtagaattgaatctcatagctaatgtcctatatcaatgtgtagtaactatcgagacctactatcttgccctagctgcttgtcttgtattacgtgttacatataattccctcacacccagcttcttagtggattctgctaggtattccattctacaaaggattagtacataagctatgctgtatttccagacacaagctctttttgtaaagtattttggtcttgatctttacactcaaatatattatgtttactgatgatgctttgttatatgaaagttgaaaacagtctcggtgctaaaaagaaaaggtgaagcctaatcgatattccaaaaatggctggccgtgttagcaattataaaattttataatttatagtggatccttgtgtaaaaggaatattaattgagcatggggcaggggcaaactcaacacttattccttaagattggattgagcacaaacatagctgcaagtcttattgttatgttttcaaggcacatggtttatttatgtattcttgcaagtttggtgacaaaatgtctgatctgtaagcatctaattttgcagcaagaggatattcggaacttcatagatagttctttaaagcgtggttatgagcttcctgtgttccgtaaagaacgtattggaggagattcatatggaatctcatactggtgtgcaacagccaacttttgatataattatgcaattaaatttaagaacatttttttgtggccaggagcatctctaatcaattgatgtgctacaggtatgacgaggatcccgtccttggacatcggttatatcgtgagattaggcaagtggagtatgagaaggacccaaccaaaaaagctaaagggaagggaatctcaaatgccccagttgtatcctatcaatgggagactgttgcatgcaactttattgaatttgaattagcagcagtaagttttgagtgaaccattaccatatgtatttctttattatgcaatctatgattgaagttcttgaatagttatagttcttctgttctccattgactcacacattataaggcacagtgttgattaggtcatacaaatgagaatttctttggatatccttagttaccgttggtacatggtattaccatgccatctctgtaaaatatatccagcagactgtaaaatatatccaacctccatacctctgtaccataactaaacagtactccctcggtttcatattattagtcgtttgacttttttcttagtcaaagttctttagatttgaccaagtttatagaaaaaaaatagcaacatttacgacacaattaatttctattaaatttaacattgaatatattttaatacaatgtttgttttgtattgaaaatgttactttattttgctataaacttggtcaaacttaactaagaaaaaagtcaaacgacttataatatgaaacggagggagtacttagtattgttgattccaacttgggtatatgtataacatgtgtttcatgcttatgtagcaattgtgcttacaataaaattgaattcgtgggtagtagcaggttgtttagtatagcaaatggccttgttagaatagaacttagattgcactaacatttagtattaacaatttattggtgcatgttctgcaagttagcagagggaaaactgtcatgtatttatcaccacaaatggcatatatgctcctaccaacctaccaaacttaaacaggcaactgcacgtgcatgggtcctttttagaaccgattacctacaattcaccacaggatgctatgtcatctacagtgatctaacttgagatagagaatttaccaaggcgacaaattttactcccaattgatgttttagaacccatgaagtcaacttttttcgaaaacaactcgagatattttttacaacttttatgttgtatatacaacaacttaagtcctatatatatattgtaaaagtactgttgtatgcttatggttttgttattttgagggctgtggttgtttgaaattataaccttgaagatcttgaataatgagtgacaccaccctaaaagattggtggatcgtatatttgtccatgctttaacatcttgctgtggagattgatttggagaaaaaaagttcttctcacacatgtaaaaatggttccaagatttgctattccatagtgtggctggcggctgctgtatattgcattggacttttgttagaaaaaggcagagcctatacagatggtaacacaacattgtcattggatatagtttataagaacatttacaaaacaattgtgtatattgtaccctgacgatcgaatatatggaaatttagtgatagtagttcttttctgcctatcttatgtaggaaaaactcttttcaagtaggaacaggactgaggtctcgcttggcaagaagttgaagaacaattatcttccagagatggaaaagattcacaaggtatctaaccgtaggtctcagagagttnnnnnnnnnnnnnnnnnnnnnnnnnnnnnnnnnnnnnnnnnnnnnnnnnnnnnnn

SEQ ID NO: 36285 - DNA, 1796 bp, Oryza sativa
  unsure (1)..(1796): unsure at all n locations
catgtaaaaatggttccaagatttgctattccatagtggggctggcggctgctgtatattgcattggacttttgttagaaaaaggcagagcctatacagatggtaacacaacattgtcattggatatagtttataagaacatttacaaaacaattgtgtatattgtaccctgacgatcgaatatatggaaatttagtgatagtagttcttttctgcctatcttatgtaggaaaaactcttttcaagtaggaacaggactgaggtctcgcttggcaagaagttgaagaacaattatcttccagagatggaaaagattcacaaggtatctaaccgtaggtctcagagagttaaaattgctggtcgtagaatataatagaatgttattttatctcaatgttttgctcctcttgtagaagaaggagaggctgctcaaaaagcaacaaagagaagcactcctccttgacaaccgcttgacagtgaatgggttcacctctgtccgctctcgtcgtgaaagaaagcgtgtcacctatacttttggtaagcttgaacctgacgcgtttgagggaaaaactgacataggaagaatattggaccatatctgctccgtgccatggttcttctgtctggaaagacagtactatacttcttttacctgtttcattgaaataattgcccttaatagttccttctggttcagtggcattacccaatgatgtttttggccagttcttagtcttacatcttcacgtagttgttccttcattttagacgttcaatcaacttttgaattctactgtaatgtcagttaacatgtaatataatttactaagcttctatcggttttcattgaggaagctatatataccctgattacctcgtaatttgataaatgccagcaaattactctccgtaacctgttaatatgttctcaagtttgctacatgtaatttttatttaagttgcatagtctggtcattttatgcactgaatggtctcaattggagcaaaatcatatcatatacataagttaccaattctcttaactctgaacatgtttacttatcatgcagatgattatgagcgttcaataaatgaagccataaaaccaacaaagtaggtggattatctctgcttgatagttttcatttaataatttacaagtttggaaacatgatgcttgtctgtactatgtcatgatgcaaatgtctgaattatcattgacaggaaaagtgagaactcttctgagttcattactacttctaacagaagagtacacccaaaacgagagacagcgaccaatggtaggttagctggtccttcgccattatgcaatggattctatggagaatatccactaaggtcacatggctaccaaggaagtgagtgggagaaaaaacctgagactctcgatcgcaggtaacttcctaaatgcttgttatttagttggttccctgctgatgcttaccattgacctatagacatatttatcccattatatctacaggcaaagaaaaagatctcgaaggtacacgcaagattttgttgaggctatctcggacgtcgacccaaacttcgacagtgatgatgatatcattggtgaagcagtctatgatgaggaatatcttagaagtcgaaagcaatataaggccagacttttagaactcgataaagagttccaattggaacaagttgccgatgatggtaatgatgaagtggaatatccttcgagtaccagtgaagatgaaaannnnnnnnnnnnnnnnnnnnnnnnnnnnnnnnnnnnnnnnnnnnnnnnn

SEQ ID NO: 36286 - DNA, 15248 bp, Oryza sativa
tgaggggggatcggcgattctgaccaacatgctgttctccgagctcggcgtctccgagcctactgccagagccatcagggagatgaactacacctacctcacccaggttcgccttgcctccgtttgaacctataaattgctaactacctcattcgctgcacgattccttagttgcgttgaaaattgatagctgtttatactatgcctagtgttctcaattggatagatataatgtagtttgatgcggtgctcaattggaaatctataatgtagtttgaagcgcgtgcttaattggatgcctatagtgagttgggtttggtagagatatgctcacatgaaattgttcttgtttcttgtgcttgcagattcaagctaggtccataccacacctgttgaatggaaaggatgtgatgggcgcggccaagactggttcagggaagactcttgccttcctcataccagcaatcgagatgctccaccacgcacatttcatgccgaggaatgggactggagttgttgtggtttgcccaacaagagagcttgccatccaggtatggttttgcatttttggtttaccaaacgaaatcatggtacaactaatagaatcaatcatgctacagcctgtttgaggaaactatgtaatcagtcatgctggaagttgatttttgcaatactaagtacttgaatttgttaaacatgggaaatatagtttctgtagtccgttctaggcttgtgagcaaaatatatgccttgcttattgcatttatggatttttttttgaggttcttattcatgtattgccattgatatatttttttcagacacacaatgttgccaaggaattgatgaagtatcactcacaaactcttggatatattattggcggtaatggccggagaggtgaagcagatcagcttgcaaagggagtcaatttattagttgctacaccaggcaggcttttggaccatctgcagaataccaagggattcatatatagacggctaaaggtaaaagaaacccatatttaattctatcagttgaaagggtgcatatgatttctctggaaacagtgtaggtatttagaccatccatgaactaactgaagagaaagcacaaaattcatagttctactgcactataaacctgatcacataaccagtctttgttctcatgtctacactatactgctcattctgtgcttttgggtcaacctttttctttcaggactaaaagaatcactttttttttgtagtgccttataatcgatgaagctgatcgtctattggagcagaactttgaagaagatatgaaacagatatttaaacgccttcctctggtatatttcatctggccgtctgacatttatcattttacatatgcagaccataacttgtaactctttgcttacataatgtctcatttctttttttggtaaatcgctacttatgctatgcagaatagacagacagttcttttttctgctacacagacagagcaggttagtgaatttattattcagtttgttgaaacttttcattcattttttctctgggtgatgtactgattcattgatgaattccacacaggttaaagaatttgccaagttgtcatttgagaaaaacgaagaaagtacctcaaaacctgtttatgttggtgttgatgatgctgaaactaatgtaaggaaattgtcagccaagttgttttttctcttttcataatgtttgtaggataataaccataatgctcctacaggctactgttgagggcttacagcagggatattgtgtcattgatagcgcaagaaggtttttggttctttatgctttcctaaaaaagaaacagaataaaaaggtcatggtgttcttctcatcatgtaattcagtcaagttccatgcagaacttctgaattttctccagatagaatgttctgatatccatggaaaacaaaagcagcagaagcgtaccacaacattctttaacttctgcaaagcagaaaagggtatcttactatgcactaatgtggcagcacgtggacttgatattcctgatgtggtgagtttttaatggtgattttttaaaaatctcttatatggagtcccccttttctgatataaggatgtttggcaatgttttaggatttcattgtgcaatatgatcctccagatgaaccaaaggtgggttattctgaatgtgccaagttagttttctgttattttcacttatttgctcatttcaatgtactgagtaatctgtttactttcaggattatattcacagagttggacgtactgcacgtggtgaaaaaggcaaaggagaagcactgttgtttttactgccacaagaactgaagtttcttatctacctgaaggtagtactttacaaagtaatatgttttctattttctgaagttaagagaaattataacatattatattggtgcctgcaggctgctaagatttcgctgacagaattagtgttcaatgaaaacaaagtgccaaatttgcaatcgcaccttgtaagtgttttttcacagttagtgagttgttttaacactgtttgtcaaatgtgtctagtagtaataactcaagttgttggacaggagaatatcgttggcgagaattatttcctgaatcagtcagctaaagaggcatacagatcctacatcttggcatacgactcacactccatgaaagacatttttgatgttcataatctcaatctgaaggtacactgcttattgaatttctttctgaaggatttttggttcccctgtgcatgaccaattgttacccattatatgctttgttgtattggacattcaattcacaacaaatgctcttcattttggcatgttccaaatcttttaagtgtcaagtggagtgtctgttgttttttcttcaattttagtagtatttagctctcttgagagaaaatggtatgtgctaggtaagtgatgataatttatcatctttaacttttatataaagtatgtgctaggtaagtgatggtaatttatcatctttaacttttatataaactaactgaatttcttctgcacttttttactgagctagattaaagtttatttttctagtatataatttgttttatgtgcttatggtagtgaatctttgttgtatttttatctttctgttttacaaacccaccattaataaatcttgattcagacagatgggtctaaatcctttctatctggcaggatgtggcagcgtctttctgttttaagaacccaccaaaggtaaacatcgatttggagagctctgcatccaaacatcggaggaagatgaggaaagtggacggtggaaggaggcatggcatcagcgctgcaaatccctacggaagaaaaggcggtgatgacaaaaggcagtttgcaagattctagagatgttcaatacatggagtctcaaaagacccttggccctatgaaattttgatagataacttatattatcgcatcatgctataacacaattattctgtccaatgtatccacttagtctagcactcgagattgttgagaaatgagaatgaaatcgtgtgccaaattcattgctggtatcctgaatcctgatgtttgcaattgacagcgttctacaaaatgtataaagacgggtgggctatttatgtcagactaccactccattgtcttcatcttgtcgttcagctgcatccttcttggccttggcctcctgcaacgcgttcaccagcctcgcgaggcaggcgccggcgtcgtcccgggggttcttggccgtgaggtgctcgccgacgtcggccggcaccaggtccacctccggcagcagcctctcgacggcggcgaacatctcgtggtcgtcgacgtcgaggtggatcttggccatggacttgaacgtctcgaagtcgcagtaggacatctcgatcttcttgtccatcctccccgtcctgatcagcgccgggtccaggtcctcgacgtggttcgtcgtcagcacgatcagccgctcctccccgaacgccgaccacagcccgtcgatgaagtttagcagcccggacagcgtcaccttgctgtcgccgccgacgccgccgccgccgccgccgcgatcgatcactttcttggtggtcgtcttggcgtcgtcgtcgtcgtcttccccgtcgccggtggccttgcgccggccggtgaggttgctggagcagtcgacgtcctcgatgacgatgatggacttgctggtggtctggatgagcagcttgcggaggtcggtgttggtgtgcaccgacgtgagctccatgtcgtagacgtcgtagccgaggtagttggccatggcggccaccatcgtcgacttccccgtccccggcggcccgtgcagcaggtaaccccgcttccacgccttcccgactcgccggtgctgctccttgccgttcttgaacatgtcgaggtcgtcgattatctccctcttcttctccggatccatcgccagcgtctcgaacgtcttggggtgcttgaacaccacctccgtccacaacgaacacatgtaactcctaaaatgagaacgaacacatgtcacctccgtcttggcgtgactaagtgcggtaattaatcaagaattaggtcttcattcactgaatttgaagtttgtatgctaaattatgatggtacaaaagttttatatttcatccaaaataaataaataatgattcagtcgaatgttatcaacgttttatggatttgtagagttagaaatatcttagttggtgcgtgtgttaattagtgtgagcgattaagctaattggtttacccgtcgtcgccccaacgagagctggggatgttggtgtagagcttgcgctggcggctcatggccatgaaggcgcggccctggtcgcggacatgggggaggtaggcggagcggacgaggtcgcggtggcactcgtggaagacgaggcggtaggagcggcgctgcgacgcgcgcccgccgccgccgcgccggcccttgtcgtcgtcctgctcgcagtgcgccgaccaccacagcgtcgcgccgcggaagtggtcctccacctcctcgccgtccgccatgctgagcaccagccccttgctgctactgctgccagcgccaccaccacccccttcgcctgcgccgccgccgccgccgccgccgcgcgcgtcctcggcgttgaggtggcgcacgtcgtcgcgcgtgccgacggcgccgtcgaggtacgccttggtctcggcgaacacgtcgctgcgcgtcatccggccggcgtcgtactcgtggatggtgatcgacaggtaggggtcgatgagcgccgccagccgccgcgcccgccggttcagctgccgcgccacgaacgtctgcatcagctggaaattctgcaggtttcgcagcagcattgtcagtatcagcagcaccagccccgaattcaccggcccaaaccacgccgccaaatccatcgccgatcgatctatcgatctcttcactacaattctacagcttcaacaaacaaattccttctgatttgatgaaccgaattttatgttcttgcattgctagcatcgtagcaacagagcaatatttatagagtgcaaaaatatcagtgatatcgatcactcacaaagtagtgaggtacacgcgtaaagttgctgaattggagaccaaattgtgagcactttggtgcataatgggttcacgtgcatttcagattttcagactttcagagggcaaaaactctaccaaaaactcataaaagcatcgtttttgttagtgccaaactttcgcatttatgttcgtcaagctttttggcagtgcaccatcgatcttacctttccagaggtaagagacagggaaaatcgtaaccgttgatcgcactgatgcgatcggatcatgtcgtgttcgtaggaaaaagatgtgtgcgcacaaaagcgttcttgtcatcactgacgaaattggagactgaaacatcatctgattagctgtccgttgtcgtttttatatctgagctgtaaggccatcatctttcgtagaaaacttaaagcaattctcgacggctcgagtgtatttaatcgagtggtggcgccatggcggccaagctcctgaactgaagaggagtggatcgctttctgaaggagaaagggacactttgctgacagcgaccaattgatggtggaaagaagaaaaggccgggagatccagtcatccatgggccatagctagatatatagcattgcactaattgatataactagttaatttctttttgtttattttttttgacacaccaaaagtatccttagatatttagtactccctccgtactcgtaaaggaagtcgtttaagacagcgacacggtctccaaaacacaactttgacttcttatttctataaaaatatttattgaaatgtgatatatgtatatttttatgaaagtatttttcaagacaaatctattcatataatttttacatttttaaactcaacaactcgagagttattcatgatttatattcccaaggtttaacttaaacattgtcctaaacgactttatttacgagtacggagggagtactaaagaacacacctaaggacacttgtatatttgatatcgacgttaaaagcttttgcacatttgcaaaaaagttacaccataagtacctttaaatattgagaaattttacagtcctcgagaccaaaattggtacatcactcttagaggagtatttgatatcgacatgctttgcatgtttgtgaaaaaaaaaactttgttgctttgttttgtctttccttgtagcatagattgtatttttttaataaagtaaaatgcaccatcggtccttaaacttgtcaggaggtttcacttaggtccacgaacttgcaaagtacacttcgaggttcctaaacttggtttattgtatcatcccagtccaaaaccgcgtttgaccgtggtcttgcctacgtggcacgccacgtggacgatgacatgaaattttttctcccttgttttttggacccgtcgaccgtctccacgtgccccagcctagcccccccacccccgccacctccaccgccgccaccgccaacgacgacgacgaagcccgagagcctacctgtggagatggactctgagcctgatctcaagacgccgcctccgcctccacatctcgccctaccacagccgcaagtggacggtgcagtgaggccgtggaacctgcgacagcggacgcgacggcgcccagccgcctccatgtcatgggtggcagcggtgcccatgccgtccttgtcccgacgccggaagcgcgcgccgttcttggtggagctcaccccggaggagatcgagtaggacatatatgcgctgctgtccccctccctcccgtcagcgccactgtcctccctcccgtcgcgtgcgcgcctccagcacgacggctcggcaagtggagcggaggctgatggagaaggagatgaaggcgtggctgtggagctcgcggtgcagcggccgccagagaggaaaaaaaggaagaagggaggaaaaaaaaggagaagggagaaaaaaaataaaaaattctatgtcatcgtccacgtggcgtgccacgtagacaagaccacgatcaaacgagactttggaccgggatgatacaataaacaagtttagggatctcgacgtgcgttttacaagttcgtgtacctaagtaaaatctcaagataagttttaaggactgatggcgtattttactctctattgccgactactcctactttatatacttctggagatatttgtgaaagttttttaggtgtctttgggcattggggtgtgcaaaggcaccacctatcgtcgtcatctggctaagatcaatcgtcgaagtctttgaccggaaatgctacgtaggtatgcgcattaacaagacacttaccagacatacctacgaacttgattagcttaattataccatgtggttgtgtcatgcaccaatgttccttttgttttttcatcgcccttttagtgtcaccactgtgttggttaataacttaatatacacgcacatgatatgatctgattgaagcattaatttatagccattttcaatatagagcttcatactggtagatcatgaacaggtgatgttttggacgttgacctgaattctccaaattccgaaatacaatgtaagctaattaatcgaatcatgtcgcgcagtatcgctctaaattatttttttttgagggaaactaaggcgggactcgtcgacaccagcctgaacttttattgaattaaagaaacatatagggggaagagttacaatgagggataagagagaactaaattaagaactaattacaggtttgagacccaattacgaagctgcttcataagtcaatgtcgctagcacagcgccggagaactgacggagtggagtcgtctaaggaattgaagaccttattgttgcgccgttttcaaatattccatattgcagctagtaggatggtacatgcgccagattcgtggagggacggcgtgcttgggtggggggatgtcccagacatcttccagacgtggtagggaggcgatctgttgtccgtcaaggccaaaggcgtgccagacagctgctacaccggagcaacgtaggaagaggtgctccacatcttcatcgagggggcagaaagggcagcatgcggatgttgctaatccgcgtcgagctcgcctttcattggtgaagatgcgccccttatgtgcagttcaaaggaaattttgcatttgacttaagcgtggttgtcccagattggcccggcaaaatgatcatttgtgagctccgagtagcttaagtcgtaagttgttcttgttgtgagggggtggtccgaggacgagatgcgccggtcgttcgtcgcagagtctagcacatggtggcaaaccaccggttggacggtggctagctcgagcgtggccgccgccgacagcctgggccggaggtggaggagcaaatcaggagcagcgagggcgtctgcaacagagatgtacacgctctaaattgttgtcggcgttcttcacttgagagaatttaacattcaaattaagcagattgtcagttcactaagaaaatcgagtcaaattatttagcacaacatgtggtcaaattattccacaatgaaaataattttcttaaaaaaacttagtctattactgtgatcataagctacgtggactagaaaaaacgagaagctagcaaccactccagcaaggcgccaatggcggctagctacttatccttcccgaccacttctacatcgtcatcttcttcgtcttcgtcttcgtctttgtcttcgccatgagcattttttccttttgatttattctccttggccttctcgagctccttcactaatgctgcgaggcacgtgtcggcattgtcgtccaagctcttgggcgtcaggttctcggcgacgtccgccggcgtcatgtccacctccgacaggagctcgtcgacggcggcgaacaggcggtgggagtcgacgtcgaggtatgtcttggccaagaacttgaaggcctcgaagcagcagtaggacatctcgatgtgcttgtccatccggcctcgccggatcagcgccgggtccagcttcttgacgtggttggtggtgaacacgatgagccgctcgccgccgcacgccgaccagaggccgtcgatgaagttgaggaggccggagagggtgaccttgctgcttgcgtccttcttcatgtccggcttgggcggcgcgccgccgtccttgctgccgccgtcgtcgtcgtcggccgcctccttcttcttcttgcgcgcgccggtgaggtcgagcgagcagtcgatgtcctcgatgacgatgatggacttgctcgtcgtctcgatgaagagcttgcggaggtcggtgttggagtggacggaggtgagctcgatgtcgtagatgtcgtagtcgaggtagttggccatggcggcgatcatggcggatttgccggtgcccggcgggccgtgcaggaggtagccgcgcttccacgccttcccgacgcgggcgtagtagtccttgccgttcttgaacatgtcgaggtcgtccatgatctccttcttcttggccgggtccatggcgagcgtgtcgaacgtcttggggtgctcgaacacgacgtggctccacgccgaccggacgaggccgtcgacgtcgctccagttgtgcgtggagatgttggtgaagagcttccgctgccggttctgcaccatgacggcgcggccctggcggcggatgctcgggaggtaggtgttgatgacgagctcgcggtggcggtcgaggaagaagaggcggtagtaccggcgattctcctgcgcgcggccgccgccgccccagccgtagtacccgcctccatcggtgcgcggcggcggcgtggagtacgcgcaccaccagacggtgacgtcggtgctgtcgtcggcggcgacgacgtcggagacctcctcgccgtcgaccatgctgaggacgagcttgtcggcgtccttggcgccctcggcgcggaggtggcgcacgtcgcgcgccgacgacgcgctgaggtaggccttgacctcctcgtacgccgcgctccgcttcatcctgccgccctcgtactcgtggatggtgaccgacaggtacgggtcgacgagcgccgccagccgccgcgcgtgccggttcatgtgccgccccaccagcgtctgcagctgcagccgctgcagattctgccacaccaccgtccacagcaccgcgatcaggctcagcaccacgccggagttcagcccgttcaacaacgacgacgacgacgacgtcgcctccatttgtctcaaaaccaaattaatttcccaattcacgaacacgcagaaggattgatcagagatgtgatatgggtggatatggatatggaaagatgtggaggctttggcacttggcgcgccgtggatttataggggcgcggcggcgggcggaatgtgcttggaaagggggtaaggaatggtggtggtgtggtggtcgagtcgtcgttgtcgtcgcatctctcgcatgtgcagctgctgctcaagccgacatgaacgtttttgttctcttgtgatgtggtggtagtggactggatagactagtactccactgttgtttacttttgggcgaaggatcaaatgctaggcgtttcttaatctcgcgctctgcttgaattggtgacgttgtggggtgtgtcgtaatgccgacgacgacgaggtatggggcgggttttctttttctgttttttttccagcttttgaaatgcatacggtttttctttcttggccgcgaagggtagactgacgagcaggctgcacgacgacgacgtttttgggcgtttctacctggaatatggcgcggtgggcggtggcgttcaacgagacgtgttttggacttttggtagtagctcttactactactactttaaaagcagcaagggatgggcagtaatcccttccgcacggtaaatcggtaaatcgagtggtccattagtatgtgattaattaagtattagctaattttttttaaaaaaagatcaatatgattattttagtaacttctgtataattttttttcaaaaaatatactatttaatggtttgaaaaacatgagcgcagaaaaagagagaaataggttccgaacgcgcagacacaccatttgaaaggtgagaaagtttacctatatagatatataggattttgttatatggaggcagcatttgattaattgtaggggtaattagccctttgctcacgttttttttttctcaaaactactattattgaattaagttgattactgaaactttgccattgaaagtttgtgcttatctatatatgtcttggatggatatatgtggtagtgtggtgacaatatatgtgtgtgtaacaggagacgtcgtgcgtcgttgattaggccattaggggcgtaatcctctgttttaagcttgggaattagtttgttaattaggagcccactacctaccaaaccagctatttcccactaaaatctacaacagtaggtcaaaccgatttcagatagagatcgcgcacgctgacggatggatccacgtaatatttgcaacgttggcaacagatgacatcatttcacgatagagatgcaaaaagaaagagcgaatgcgaagagatatagaatgcaggtaaacgaagtcgatatgtactggtacggctaccaaattgcaagtggtacaatatactagtacctttttttcttaaatatttgaccttaggagcaagctttaagttaaactttttaaactttgttcaataattttatattagggtaacttaataaagtttaacaatattataatattatggtgatacattttaagacaaatctatgcatactatttctttttctaaaaccaagcatttgagaagttattgatctttgaaatttttatttaaagtttggtcgaatcttattctatatgttaaatatttataatggggtaaaagggaaaaaacttatactaggtagtaggtccatatcataacaaatcataatctaaaacaatcatatagtcaaaattacttttctaatgtgatagactgatagtgctactcatactcccctgttctatggtgttgtgatttgtgaatactaaaactaacttctccatccatcacaaagttggacttggcattatcttatttatttattcatttattttggctaagtgcgcatgtaggttcatagaaccaacgtataactggtctattattttctcttttaattgcactagatcaatactaatactactgtagctcacaaattttatttgctgctctgcagaattttcatgctagcacaaaattcttgcatcgaagaaaatccacgtcaggactcatgagtgggccttgggccgagacatttgtgatgttgggccaggctcgagctcctccttctccgcgtcgtctgtctcacctgtgtgctatgaccaccaacctgtctgtctcgtactcttgcttccgcttcgccctgttccgactaggcggtgtcagaaactccggcggcgagaccgacgagatcccgccggcggcggcggcgggggtgctcgctcaacgccgcaccacagggggaccctccggtgtgcgcccccgccccctcgcgcggatggcggcggcgcagctgctgctgggcgaggacgggagggggtacgatctcgcgcggcggctggaaggcgtgcggcgcgtggcgggcgtggctcggggacgccgcccatgccgcgctcgcgcagcacctccagaccccctccacctgggacgccttcctcttcccctcctccggcggcggctccgcggccccaccccctcgcccgctcctgctcctccagctccgcgtccgcgcgctcctcttcgacaaggcctccgccgcgctcctcccccgtgccccccccccggcgggcctcaactctgtcaacgccaactgtgagccccttcgacttcgctgatcggttgattgactctagggatctgatgctggaatcgcttgggtttgggtttttactgtagctacaagtcgggagaaagtagcttcatggtgttctaggtttcgtggcatcttggggcggatgaggtttatgtttagtgactccgggagtgagatattgttcagaaaacagcattgagcgtgttcagaaaatagcattactgcataactggtgctgcctacttttaactgatctgtgatttagcgcgaaaacgttataattgcgcagcgccacttccccgttgtcatggcaggtgaaaaatgttaatttggaacgttttattgttaactggtaagtaatgattgcgctggaccttaagtagttttctaatgttctagctggacgggatatttagtctaacaattagtagttagtgttagttagctcttaactaatatagatcatatcttgttgtacacagccaatggcctatatatgttgggggcatttgcctcaatgaagattatcgcgtgaggtctatcatgccttcatttattacttgcgaatttcaccagtaagtgcgatcaaggtttatatgtgaggacaactgagatttctgccccatatgcaaaggaaagtcaataatcctgctaaactaagttgggttattaagatgggagctaataggaaatggaaccattaaagttggtaatgatggaatgggattttttttattcacatctgcctgttgttgcaatctaatatagagttatatgtgagagaaaaatggctcgtttttttgtaggggttatatctttaatttattgggacttttgattctttttaggtggatgtaaagttatatagttgttgaagcaactgaccagaattttagttccgctggtttgtgtttcacttcatggaggctaaatgatgccacctaaatcctacattactgtaaaatcagctaatatgttgaactaatttaatgccgccataaaaatgttggctatcaggtcaaacttgataaaaatatcaacctttatatgctagtatactagtaagctgacatcgcaaaggaggagctttgcttgatgttttacttggttaaatttgagctataagatcaaggaatggtttgtctagtattatggatctcattcaaataaaatttgattgaagtatttttcttcttcaatatttctaactttattttggggttttgattaaaataagatgatattttggtttattacatatccttttgcacctttgtgaaagccatatcaaagaaattaaccacatgcaaatgcgacaatgtattgcggttgtcaaccaagaagccttttaatattcaagttcaactagttatttcttcaatgtaattacttggtataagaattcatttttttatttgcctattcatagtgttattcttatctgtttatctcagatcttcagctccatgcagatgatatttatttttcattggaagatgagcaggaagatatcaatcaacaccatgtatgttatctctaatgttttttttaaaaaaactttttgggaatatcagcattgtgtgactctttctagaaaacccctttctctttcttgatctgttgagtgatatgctattctatgcaacaatgccagctaccatgtatgaagtaagattcaagttgtacgttacagttggatttcacgcactatctctttccagttgagcaccattgtcgcagttttgtcttttatgtattatgtactattgtataatcattgttatgtgaagcatcctttta

SEQ ID NO: 36287 - DNA, 698 bp, Oryza sativa
tgctatattctagtacggatggagtatcattatcctgatctggtgatcgacaatactccatttccaaatgtagtactttatcatcaaagactattcgtttttaaattttgaccatttgtcatttttgccaaaaaaaatgtaaatatttaaaaagacttagtattattgaagtgggataccccataaacattagcattaagctttattcatcgtaatttgaaaaaatattagtggtgaaagttgaaacggtggcggccaacggtgctaagtattattcggggaacttaagttaagcaacagtttcaacaataatatataccacttgtttggacgattcaagaagagacataagatgatacatgcatgcaagctctcacaaattcaagatgcattgagacggtgagacgtgagacctgaggcgtacacgcgcgcgcggagctcctaacgattgtccggtgaagaaattaactatcttctgccattccgtattttccgttgcttctcgttgcacgcacgcgtcacacgagcacggctacctagcctgccacgaccgtacattggcacatggattacgtgccgcttcatccactggcctccagacctccacgtcgtctcgctcgatcgatctcctctcttcaccgctctccttgaaccttctttcttccatgatgagtacgagtacggcgcccagtgtgaaa

SEQ ID NO: 36288 - DNA, 609 bp, Oryza sativa
  unsure (1)..(609): unsure at all n locations
nnnnnnnnnnnnnnnnnnnnnnnnnnnnnnnnnnnnnnnnnnnnnnnnnnnnnnnttctcgttcatggcgtggcacttggactgtacttacgcgtcggggtcgaagttgtcggtcttgaagatcttcatcttgtcggcgagaggcaccccaacatcaccgcctccagccaaaacgttcaccggcagcacaccgaactgcccagctgggcgcaacctcattcaacttggcggacaacatcaccgcgcgcaagcgaaccccaccgccgccaacaacaacagctttccctcttcttcctcccaaatgattaaaaaacttctataagtggaaccactactcgattgaaaactccactctcctttgcagctgcaccgattttttttttttttaaaagggggatatttttctttgggtacctagaataatgaggaatttaccttgaccgttgccaaaagaaaaaagacatatagttggtcttggaatatctctcgagactgggaatagacccgttctactcccttcatccatatatacctttaaaaacttttatattatataatgatattatatctctttaaaatcttttatattatactaaccttcttttttaa

SEQ ID NO: 36289 - DNA, 599 bp, Oryza sativa
ctttgaaggagactcagatggggaggtataagctttacttaaagcaaaaaccggtattagtttttttccttataagaaatatgggttttaaattattttttcaaggggattttgtcttactttcttcaaaagaggaggtggatgttgataatgaatgaaacaagtggtggttgtaaaaatttctttttttgtgggtaaggggacaagaatctttttgtgtttttccgggcttcaagggttgcctggaaaaggttgtaacaacattcatgagttttgttcttatagtgggagaagtttatggatttttttgggagcaacctcaattgatcctttaaaagttaggtatcacctgtggaatggttttagagggctatagttagcgatgggtctacccatgcaacactttgtgaggttgggatgaacagattagaatattaatttttgatagtttacttatggagtatgttggtcttgggtacctatcaaaagatataatcatatgtgatacattatcaagggccgtaggtatttgtgagtatggacaaaaagttttgattgacatcatatcaggggatctctagagaggacctgcaggcagg

SEQ ID NO: 36290 - DNA, 630 bp, Oryza sativa
tgaaatcctccagagtcctcatctgccctgcgtctgctgcctcgaccagcatcctcctcccgggggcgatcgccggcgcaccggtcttctcgccgccgtccatgaccagtgccatcaacacaagaacccccaacaagatggccattgccaaccccgccgccgatgatgacccggccggccgtctcatatcagcaaccggtggccttcttggttttctcactctcttcttcttcttcttcttcttcttcttgctctcactctcctgcacttacacttgctgctgctgctgctgctgctgctgtggctctacgagttgcttctgcttatgggggaggtggtagtggtgttgttgcagctgaacgatggatgcagcaatgtggctgctgcatattataatgtgggcaagtagcagcagggatttgtgtcagtcgctgttgtggcatccttgcttcttgttttgttctggggtttcttttgctttagctgattctgctgtgcttttcaaggacctaaatggaggtgaggagaggagagtagaatcaaaggcaagtgaagtgagggagccatgcttgcttttctgcactttgctttttgagttatgttgttttcttccctttttcttttcaattt

SEQ ID NO: 36291 - DNA, 1198 bp, Oryza sativa
  unsure (1)..(1198): unsure at all n locations
nnnnnnnnnnnnnnnnnnnnnnnnnnnnnnnnnnnnnnnnnnnnnnnnnnnnnnnnnattctaactttgaaggaatatgcgtatcgggatgctgggatctaaccatacttggactaatttcacctctatgcacaattacgaatttttcaagttgtttaagaatttataagaaccattaacatacttgtacgttgtaatagaccaaattcatataattgtgaataagctagaagggtgattggagataaagtattggattcgatggttactcacgtgaaccttacggacacactcatatattgcacgaactgtccaagttgaatgttctattacttgatccagcaattcagaacacgaatatgtgattattacaaaaaaaaataaaagagataaggtttttgttatgaagcgcttgatttatacagcctcgtagtaaaactgttaccaaaattttggcacacggtagacaactcgtatctagatccggctcctctgcctttagactcaaaaggtagagaggtacacagcaaaaatatgtcttgttcaacagtagttcgttcgtttgttgtgaatcgaacggctaaacatacttccaaagtcagagcagtagagctctcagatgatccaaatccctcgcataccacccccggcacgtccatagacttttgagacatatttgtacttcctaggccgagttgctgagttatgatctgctcccaaccgaaagcggcccatctgcgggcccaacccgctccgcattacgcattttcagggttagggtttaggatccctccgcgacgccggtggagacggacgtggtcttgttactcttgtagccgcgcgacacggacccacccccacattatcgtgcttgtcaatctgggccagttggcccagcccaactacggcccaactgctcttgttgccatttgcttttgaaattttcctttttgattcacggtgtttcttatcttgaaacaggtgtaaattgtaagtataatactttttcatattataattataagactttctagcattgtctatatttatatatgtgttaatgaatctaaacatatatgtgtgcctagattcattaacatctatataaatataggcaatgctagaaagtcttatataacttgaaacttgaaacggagatagtaaaagatagtaacatgataaatcaaattttggtttg

SEQ ID NO: 36292 - DNA, 330 bp, Oryza sativa
  unsure (1)..(330): unsure at all n locations
nnnnnnnnnnnnnnnnnnnnnnnnnnnnnnnnnnnnnnntcctgcagcacttgcaaccactttcctcacctttggtaattgcattactttcattcatgagaaattattcttgggcacgtttgactgaggattggcttataatattctttttctctgcagtgttgaacctggccttttccttgagtgttctgggttttatgattatgcatgtttcacttgtttctgctaatacaacaacaattgaggcaagtatctagaatgtataattaaatactcaagtatttatcaatnnnnnnnnnnnnnnnnnnnnnnnnnnnnnnnnnnnnnnnn

SEQ ID NO: 36293 - DNA, 539 bp, Oryza sativa
  unsure (1)..(539): unsure at all n locations
nnnnnnnnnnnnnnnnnnnnnnnnnnnnnnnnnntatgtagttacatgatcttatcgtaacagttaattgcttcattgtttatacttttacaccttgtaggacctttgagttatgtaggaatggttccattttcatttcattattatatctttttcaggtaactgatgctcccgagatccattcaaatggtttccacgtgaaatttgatattacagaaggccaaattggttttgtattgccaactgcagttgcaccttacaatactgattctgtaagtagaatgttatctgttgaagatgtcaaggactcttcttccttctggaatacttgcattgtgcttccattcagatcaaaattcaaggagggtaccggcatgcactccattgcatccatgttttcagatctccacccatctctgctcctgttccttcatcggctaaaatgcatcaagtttaagaacatgatgaatgannnnnnnnnnnnnnnnnnnnnnnnnnnnnnnnnnnnnnnnnnnnnnnnnnnnnnnnnnnnnnnnnnn

SEQ ID NO: 36294 - DNA, 675 bp, Oryza sativa
  unsure (1)..(675): unsure at all n locations
nnnnnnnnnnnnnnnnnnnnnnnnnnnnnnnnnnnnnnnnnnnnnnnnnnnnnnnntgattatgcaattcctggtttattcattttttagataataattcctggtttattcatagctggaataggctagtgattatgcaattcctggtttattcataaaggttggtaactgaagatgatatacccgtttattcaaatgccccagttgtatcctatcaatgggagactgttgcatgcaactttattgaatttgaattagcagcagtaagttttgagtgaaccattaccatatgtatttctttattatgcaatctatgattgaagttcttgaatagttatagttcttctgttctccattgactcacacattataaggcacagtgttgattaggtcatacaaatgagaatttctttggatatccttagttacccgtggtacatggtattaccatgccatctctgtaaatatatccagcagactgtaaaatatatccaacctccatacctctgtaccataactaaacagtactccctcggtttcatattattaagccgttgacttttttcttagtcaaagttctttaaatttgacccagtttatagaaaaaaatagcaacatttacgacacaattaatttctattaaatttaaacattgaatataatttaatacaatgt

SEQ ID NO: 36295 - DNA, 1399 bp, Oryza sativa
gcatggcaagttccgttcaggtgacaaagatataccaaaaagaacatcagagggaatgtccaattacctgaaggtttgcagtgtgcataaaaggaagagggctgtgtttatggatgatcagggtcacaacatctcagtcccaatgtcggaaaatggcccttcctcaaagaatgctggggactatagtaatttaacagatgatactttcattccagaaattaggtttccagctgactgtgtcccggaaagcgcaattcctagaacaagtgagacgtctaggatctacaaaatagaagttcatggggttcttgataatttaccggcgcctgttagtcgcaacactgcaatgcttgaaagatttggaatgatgcctgagtattataagaaagggaacaaatatcgagggaaagatggatccagagtagaaggaaaatctctaagccaagaacaagcaatgcttatgacaaggaagttggttgctcgctacttggcaaatgcaggatttgaaagtggaactgcagtgtgtattgatgttctttcagaaataataattaagcacatctctaagctggggcgtaacttgaagcttctaactgacagctacaggaagcaattttcatccattgaactccttaagatgttcctacagactgttggctacaggtactttaacctattttatatacgcgcctctttacttttttcccttttgttttccctgtgttctttttggtattaggtgcagggagatgccttctgtgttactatatatactaacacatcagttcttgcctaaaggagctagtaataaaattgagtcatgttgatggcagagcatgtgtatttaatgcatttttttttctataaaattacatgccaaagttctgatagtgattttctgctgtaacatttagtaacattggccccttgatggaaatcactaaaacgacaaatagaggggccaactaccctatgcagcaagatgcacaagtgcaaaatcaaaatgctcttcttcatgcacaacaggtaggaaactgctgctggctcaccatacttgtattatgtatatcttaatatttctatattctaaagcatatatgcttccttgctgaggaaatggtttagttagactcttaagaatttctacccatcaactgtgcaaggaggggtggttttagccaactaaaagaggcataaggctgtttgattcagaataatttatacacttagccatccaaggatagatcactgattaaacaagccttcggtgtcttccacttgatttggtttatgggagtgaatattgcctgatgatcactgattaatattagaatctggccggttgtctgtgatgactgtaaagtcctgtctgatggtgctttctcttgtagtgaaactc

SEQ ID NO: 36296 - DNA, 1839 bp, Oryza sativa
  unsure (1)..(1839): unsure at all n locations
nnnnnnnnnnnnnnnnnnnnnnnnnnnnnnnnnnnnnnnnnnnnnnnnnnnnnnnnnntgaatattgcctgatgatcactgattaatattagaatctggccggttgtctgtgatgactgtaaagtcctgtctgatgttgctttctcttgtagtgaaactcttcaatcaatctatcagtggcgtagctaatattctgtctggttttgttaagttcctaggaatgcggtggtatcagatagttcctttgaacttcttctgatgtgaaattaaccagtaacagttagcccatgaaccatatgaactttggatagtattggagcaaactaatgcccatcgcatagaaacgactcctaaaatcagtgtccacaattcatgaatcacatcatagatcactgattggccacctgattgagcttcagatagagaattgggttggtagtaaaatgatttgtgaagcagggcgtttaatatctggttttcagcagtgaacattaatgaatacctatatgtgtacaactttttattagccagaccgttcaaagcaaatggttgctggatttcatttttgtcaagcatgatatagccactgcctacatatgtatgctcagtcgagttgctgaaatatttttcttcatttgattattgaattgattcataattacatatgcaccactggcagctttcgaggcaatttgcaccccaaatgggaattaatacacagaatttgacaccacagcagcagcagcaactgctgcagcaacagtggttgaggcgcaatcaactggccagcccccgtggtcctcttacgatggcggacaaaaaccaggctatggtaaatgtgaagattgagaatacggtggactcacagattgatagcccctacggatcacttaccagacaacaattgcagcagctaaggcaccatcagcttctacagcagcagcagcagcagtttcagcagcaacagcaagttcaacagcagcagcaacaacaacaacaacaatttcaacaccagcagcaacaacagcagcagcaatttcaacaacagcatcagcagcagcaacaatcacagcaattgcaacaacagcatcagcagcagcaacaaccacaacaattgcagcagcagcatcagcagcaattggccatgtcaggaggccagaatgcccaactagcgcagcagctagcaatgtcaggaggccagaatgcacaactagcgcagcaattagccatgtcaggaggccagaatgcgcaactagctcagcaattagccatgtcaggaggccagaacccccaattagcacagcaatacaaacaaatgccatcgatgtaagtacctgtacctcctcaactctattgatctgtttaaaatctatgcttccatcttgttaacccctctgatctgattgcaggagtgcgtacggcatgaggatgccgccggtgaaagtggaagcgttccacgagctggtgagtggagattcgtctctgaaacccgatagcgactcaaacaaactcatgtctcccaagtaggtcagtcttacaccgagggaaaatcgcgtagccagcggttagctgtagtgtacaaaggactacatttgtgatctctcactgttgtttcccaagaactgaagcctttgtagttttcatcaaatccagcaaggcaagcagtgtattgtaattgtagatgtataagtggttactaactgaggtgataagatcgatgtggtaatttatcagaaacttgagattccttcatctgcctgtcctgctagttcgattatcttcaagaaaatctgagctccttgtttctgtgaaatcagctggttttgatttaccaatcca

SEQ ID NO: 36297 - DNA, 556 bp, Oryza sativa
  unsure (1)..(556): unsure at all n locations
ggcgaattcgagctcggtaccctttcttaagttcatccttcactgattcaagtctaacaaaattatcgtcatcacacttcattatatatcgagcggaaacaacacgcacctgacaaacagttcattagatgttaatagagcagcttgaaagtagcaagttcgaaaatatgtaccaatcttagacataccccatattcacatattgccacagtctttagaacaactaagtcatagctgtccatgaatggcacaataacaatgtccccaaaaaactctgcctctttcttcaattctgcattgacttcttttctgctgttctgcagaaaagataattcatcagctcaagtccacaaacataagcatgcaacttggacatacaggccatcaaatttgatcttcaagattttaccagggcaacaaaaaaacgggccacgacattcgaggacttctgggcagcagacatccatgtcttcctcacagccatnnnnnnnnnnnnnnnnnnnnnnnnnnnnnnnnnnnnnnnnnnnnnnnnnnnnnnnnnnnnnnnnnnnnnnnn

SEQ ID NO: 36298 - DNA, 817 bp, Oryza sativa
gggccacgacatcgagaacttctggcaacaagacatccatgtcttcctcacagccatacgttcagcaaaatggttgcctgctgacaggatgccaataaaaatctcaattggttcgtctggaaggggaggggcctgccaaataggcaacatctctaggtgtttctgaggtgaaaagctagggtgtgcagtgggcaaagtccctgcaaacaccgattgcacatcaagatccccattcaatgataagccagtggcatcttcaagcacaaatccctgccatcacaacaaccaaagacaaaagctaaacatgattgcccacttacacagcaatacaacactatcaatattgcacttatctctgatgaatgtggaacatccacttacagtgcggtacggaaatgatgtgacgtgtcgtccatcaacgttcacgtggtaaccctccaacccggcggtaagagtaagaacgaacatgcagtcctccacaaacgggtatggccaatcaacagagaccttctttgttcggccaatgaggcggttgagccaccatgacgtctttgattgttctgacctctcctcgtcatctcgaatccatttctcacacttcaccatcccatccactgtacaacattgtaaacaaaatcattaatcttcaggcattgcaaactaaatctaatgtttggacaaaacattgtataagttcatcgtgtttcatctgatggcaaggtggtgcataccggtctcctcatcagcacgggacctccagccctcgcagcggagagaagttccccactgcattcggtaacatgtgttctgctcgatc

SEQ ID NO: 36299 - DNA, 619 bp, Oryza sativa
catcaaaggagatatcagaccttgaaagggagctgctatctgtcagaaatctgctaagtacacagtcagctctaattcgtggtctatctgaaggggttcatattgattccttgactacagggtctgaaggctctgcagaagaggggacagatgaagaccaggagccctcagaaatacaaaactggtgcacagatttccctgagatgcttgatgttttgctagctgagagaagagtggatgaagcattggatgctttggatgaagcagaacgtgtcgttgctgatgaaaaacagaaacagacactcaccacagctgacattctggccgtgaagagggctatctctgataatcgtctgaaattggcaaatcagctagcagaagctgcttgccagtcttctactcgtggcgttgaacttcgtgcttcagcttctgctctcaagagactcggtgatggaccccgtgctcatagtttgttgcttagtgcacacaaccagaggcttcaatgcagcatgcaaactatacatccgtctagcacatcacacagtggggcatacactgcatctcttgcacggcaagttttttctgttatagcccaggctctcagtgactctttagaact

SEQ ID NO: 36300 - DNA, 1168 bp, Oryza sativa
  unsure (1)..(1168): unsure at all n locations
gaattcaatgataaactggcaaatgtttcggagaagagggataggctctgcataaaggctccagacagagacaaattattgagaattggcaagcaaggggaagctgcagcccaccaacattttgttgatcattttggatccaataatgtcaggtgggtgaatcaagaaaatgaaacggggttgccttatgacattgttgtcacacacaaatcgggtttcacagaatatgtggaggtgaaggcaacaacaaattcatacaaaaattggttctacattacattgagggaatggcagtttgcattagaaaaaggcaatgcctttaccattgctcgtgttgttctgaaggattcaaagaaagcaaatgacaaatcaaatgttctcattttgaagaatccatacaaactttgcctgaacaaatcagtgtatcttgccctcataataccacagcaatatcaaacaaaacgccgttactttgaaggtaactcggatttgcaaagtgaggtaaaccattgagatctgcaactttggctaagcctttactcaataggaagggaggttgtggggattttgccactgcacctttacttcaataggtacaatctgacatacgctatatcagttttgtttggctccatatttaccaacatagggttttccatagtaagctcattctatgctttctggatatactacttgtcgcgatggttctcggccatgtcataggacatcacctcgtctaacttgtaattttagctgttgtaactattcatccaactttgtggcctcggttttcagttcgaggttcttgatacatgaacgtgcctgatcataatgaaaagtcccattgcaattgtacaaatatctcaattttaattaccatgtgttatttactttccagtaatacgttaccagaatcctccaatttcacatatacaaagaggtgtgtgccaattccatactggagtactcctatatttttaagtcacatactaagggtgtgtttagattccaaaataaattttggtcaaaaatgtcgcatcaaatatttggacatatgcatggagcattaaacatgggaaaaaaaatcaattgcacagtttgcatgtaaattnnnnnnnnnnnnnnnnnnnnnnnnnnnnnnnnnnnnnnnnnnnnnnnnnnnnnnnnn

SEQ ID NO: 36301 - DNA, 587 bp, Oryza sativa
  unsure (1)..(587): unsure at all n locations
actatagggcgaattcgagctcggtacccatgcgaccaagtaagtagatctgacagcattggagccttaagcaaacatttaattgcttcttgtgaggagactgttacagaacaagattgttgaatatcattcattagcccatcaacggtatcatggttacctggaacaataccagaccaccgtttctccaacaaagacatagaaaacatgatattatttatttctatgtttttcctttgtctctcaatagaatcaagaagtccttctccagatttatcttgcacaatatcaaagctaatagttggaaattgccttttgagaagcttagagaaactatcctccgaaaactcaccatcttcaagccaattacccccagcttggcagagtaaaacctcaatctgttgctgcagtacagaaacttccactgaagaatgtgttaactttccgactttcaagaaactgctcaacttagggggtaaatgttgctcatgtttccccaagaactcgaggaaannnnnnnnnnnnnnnnnnnnnnnnnnnnnnnnnnnnnnnnnnnnnnnnnnnnnnnnnnnnnnnnnnnnnnnnnn

SEQ ID NO: 36302 - DNA, 708 bp, Oryza sativa
catagggattccgtccctcatcggagtcgcggtcatcctctatgtcggcttccgtccaagtagggcggaggaacagtctatatgtcctatgcagccaacgaagatactctgagaaaagatgattttggtgtatagtctcgatgtacctgtagttccttccggctgtcctccattcatcaatgtatctattatgctctagcccccagtctttcaccttctttgttctcaccctgtcatacctagacaagtagaaggtgatgaaacaatagtgagcatcaacaagggttaaatggtacaaaattgaacattgacaatgaaagcaaacaaagataagaaatatttacttgtgtaattcaactccagttgagatgtcctcaaccggccagtcttgtttcttcccgaactgtccatgacacggtgcggaaggtggtactcaactgcccagaaacaaatcaatgggcactggtacattaaatagtcaaagtctcgattgcacatcgagttcagggtcaggcttgaagcctcatttgtgtggtatggtaaccattcaatctgcaaaagttgaagagatgtcgttggttagtatctcaattaaagaagtaaatgtctaactagaagtgatattggaagtacttacatgttgagactgtaagcagtccatctcattgacataatgcttgtatgccacatcccggtgagcatgtgcag

SEQ ID NO: 36303 - DNA, 3069 bp, Oryza sativa
caatttttttataaaaaaagaaatctctaaatgctatacatctgggagaacctatggcaatgagcatagtgtttatattaggttccaatgttgtgattgcaatgtcccatttttcgaactttcttctagagttcacctacaaaaaaagatctgatcagtacttcaatcccagctgatgagttcttttagatggaatggatgcaggttctgtagaacatcataaacatggcaagattagggtctctcaaaatttcatcaccaacagtggcattagagcacctggtaaattggtataatagttaggttgctccattgcattaataaaaaaatgaaaatcactgtcaatgttgatgtgcaacaattcatggtgtataggggaaaaaacgagattaactattcctcatggcaaccttaaaagaacaactcacacaaacctgcacatcctttgtaagctcctgtgccaagagtttagtagtcaccgtcgccaccgccgtctctggtgccatgagttgctcgctgctggtcattggccttgtacattgacggcaacgcggctgccgatgaagcgactacctgtgacccagagggcacagatgggagggaaggggaaggcattggtgcggcgtacggtggatgcccctgctgctgctggtgtgaagtggcttcttaacgcagtctgttggcgacggcgacagtgagggcgacgccgacgaccatggcgacgccgatgagtggtgggctggggtgtccttgtggagatgagaagcagatctggcgccggaaggacgaagaccgcgcccgcctcaacccccactccctccgccgtctccccctcgagttgatgcgtccggaacctcgcggcagtcccgccgccaggattgggccctcagcttttcgcgccgcctgtgatgcagccgtcggcgctccgacctcgtcgttgacggatgccggaggcggagacggctgcactcggtgacggcggtcggagacggcgacgcaatggcgccagcggcgcagggcgacggggacgatgatggcgacgacgcgagggggatgcggaagcagaggcgcttggagacggtgacgcgacgacagcggctgcgtaggcggaggcaatggcgcgaggggaaggcggaggcgagggtgggggagcagacggcggagggagagggaaagggagaaggagagagtgggggaagagagggcggaggggagacggacggcggcagctcggccggcgatggggacggcgggaggcgaaggtggcagcgcgatgggtaggcgccggcgggggtgaaggcggcggcgcgaggcgacggggacggcgtgagggggaggcggaggcggcagtgcttggtagcggcgcgagagagggagagcaagcggctagggtttgaggggtctgcgctagtgggagtattttttcgaaaaagcccctcgtcttccacatatcacaacgaagcccctgtccgcgattttttctcttcaaacacaggacgcgaggggcctatacctgattacgaagaaccggagggctttttcgcaaaaatccaacctcgcactgtagctactgtagcaaaatccgacgtggacacgcccagcgtccgccccttccgccacacttaatagtttctaatgaaccatggcatatagaataatcaattcattatcagagacatggcaatccatttgtacataagcctaagagttagattatggatgtcattggttctgggtttcttataaatcggtgcaccagaaatatcttcacagaatatgtttttctcaaaaccggaagttgccttccaaaaatcgactctacaggattcggggaaaccgagaagtgtgctcaatccactacataaaagattaaactctttacggaaaagtcaaaaagtaacaccaccctctgcttctctaagtgtgcagagaaactgtatagttagtagacaagagcctaagtgtgcacagaaactgtatagttagtagacaagagccaagctcgtctaccgttgcaaaggcgtgccaacccatggttctccaaatgacactaaaatctacatccatacttgttttccggagtagctttggatcgtacgctcggttgtgagcgaatgatcggtccttcagcatctggtaggcttgtttctctcgtctgtcaacgatatcgaggtcgttgtcggtcaggagctgtggtacagcgtcagtgttctccattgacacgtcggcagatgcccgatcgctcgactggttggatcgggagccggatcccttgagcaagtgggagagccgtctcctcatgactgcacaaaggcaagaatacaaagcgaactcgagcaggggttagcacaagacaatatacccgccagttaactttgcaccaaaagcaacttgctaatgcgagaatggaggattttaactatgaggctgttggctgttgttaatgacagactttatgccaccaatacctgcataaatcaaggaaataaaacatccaacatagtgatagggttaaattctgacatattccacgagtgttggtgtatatttgtatgcaggtaataaaccaccaaagttggaccaaaaatagacttgagtgaagaataattcctatccataccaagagtgggccaaaaactaccagaaaacatcttcaaatgggctttccactcacagaaatggatagaggacgcagagaaggagcaacaggccgaagatgggctctgtgagccagacctgggtttggtcgaacccatggttcggccaaccactaccacagccgttcgaactggggcttcgcgtggatggtctagatgagctcctaaatgacggttggagggcagaagtgtcttttcgcgttccataaccatcatacctgttggtgataagccctagaggcaatcatagagatgattgtatcacatactatatttacatatttatccgatattgttccttgaaatagataactcattattggttaatgaatatgtgattctttcatgagactctttatgttgtatgctactattttggatgaagcacaaagaacaactcgcactaaggtaa

SEQ ID NO: 36304 - DNA, 659 bp, Oryza sativa
cctgggcgacggctcgtccaagaccacacgaatcggtggtcttctggacgacaaataggaagacgcgctcgtctccttctgccggcaacgccgacgtcttcgcctggagaccggcagacatgccaggggtccccagggaggtgattgagcaccgtctcgccgtgcggccgggcgcaaggccggtcccgcagaaagtgcggcggcaggccccggaacgtcaagccttcatccgcgaggaggtggcgcgacttctggaggccggattcatccgtgaggtcatccatctggagtggctggcgaacccggtcgttgttcccaaggccaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcagcgtactactcgaatttctttgggtagccagataggaagcaatgttgaggcctatgttgatgacttggttgtg

SEQ ID NO: 36305 - DNA, 6113 bp, Oryza sativa
ctcacaacccacctttaatcagcttttaattatcaattaattatcataacaagattaaccatcgtgagctaccattagatataaccataattaataatgtagtatgattcatcccattaatgagctaatgtttctaagcatggctaagcaattatacatatagcatttagctgaaccaaaccaatatataaggttctagctaatcaaattataacccataggaaaaataaagtcattttcggccattaattaattgggaaaggctcaccacccgatgacattcgaaaataatgcataagttgaaataaaacattagctttaaacgggttcaacatgctcaaagggttgtttgggatctgtgtgacttgccttaagcttccgcaaacgcttctgaaccttcctcaacgtaaacgctctcctccggaacgtcggaaactaaagcaaataaacaaaatcaacaaaacagtacaaaaataagcataaacagtatatgtggatatttttaacatgtagatctcgattttagatgaatttagcaacttgaaccactcgaatccgagttacgatgatttagttatgaatttccgaagtttaatcgattttcatctaatacagaaaattattacgaattaaataaaggatttatgacgtcacgatgacgtcatcgccggcctagcactggacgacgctgccaccggtgatagtgagctcggccgggctatccgaggacaccaacacgaagaggacgacgacgcgaactcaccgtgcaaagaacaacgatggacgacgacgaacgacggccggcgacgaggtccgacgacggctcggctcgggtccccgacggcgacggcgctccggtggtctttggcagctgcgaaggggcggacggggtgctcctccaccgtgcgaacccggtggcggcgacggacggcgacggcgacgacgctagcggcggcgccacgcggatggagcggcgtcggcggcggcggcgctagagctactcggcggcggcgctacgggcgacggctcggcttgggacttgaggcaaacggaagaggacgacaaggggatgctttatataggcttggactagagagatcggactccaaatgagaggatttgagctggaaaatccgagggttagtttggagagataaactcgaaaacgaattcgattcggtttatccgggcaaaattaatctccgagactttaggggaaaggaagaggataaggaggagataatttcccctcaactaattttaggaaaacacaagagaggtcggatttggaggggaaaaaccgagcccactcggtctcagttcggctgtcctgaggttgaaaatgaacagtgcaaagggaagcaaattagactttcggatggactgagaacagaacagggaaagaaaagggcagctcgacttgggccggcttgggctgcacagcacgcgcgcgagggagagagatgttgggctgaaatcagcccaacggcttaggagacgattttaaaaacttttccaattaaaataattcgcgaaatgatgtttcatttattaaaaatactttccttgctcaaataattcccagaaaaatctagaaaatagataaacaagcaaagtatttaatgaaattttatctagctcaattttatgttgaaatttttcctaggttattagtgtttaacttgtaagcttttaaaataggcgattttcatagcgtgacactgcgggaggaggtgggtccctgtgtgcaagctgaatgcgtacgggtgtagtcgtcgacttgcggggcgtggtgcggatccggactcctcctggcgctgggagacccttcaactgagcgttctccttcttcaggcgtgctatctcatccttcagagctatgatcctcacaagcttcccatcattcaaggctttggatgccttgtgcaggtcagagtgcatcctgtccattcccctcatcacggcgcacatgtggccgaaggtggtgtcgttctcgccgactgtcgggcggaaggtgctgatatcgttgccacttgctcggcgagggtggaaacggtacgccgtgttgcagaagatgtagctgtggtgatcacgaagcctggccatcattaggtatgctgcctcctgataggcgtgatctgcggtgcctccagatgcctcaaccaccatgttagcgaggctggtgcccaaatagcaatgaacctccagacgaacacggtggggaagctcgccactgagcggcggaacggtcgagtactccggcgcgttggggtagcccaccaccaaggtcatgcgagccaactcagccacaaaatcatccatgccgtctccgcggtggttgggttggtggtcggccatctagagaagacaaaggggtaggatcaatgcatgctcaaatccaatttaaataaagcagtaaaaaaaactcaattaaaatgaacaaatgagagcagaattttgtcaattaaaactcaaatagatcatttttgcatgagagcgaataaataagacggacttacatagcgataaaataatgagaaattagatacatactaataataataataagagcataaatacctagcaacccatattcctgagttaggacctaatgcattcctcccatcaaatcccgactgactgtcgaataaatttcaaataattttactaaaaccctagactgacctaatttgacaaatctcacattaaatgagcgaccaagatttttcccttgaaccacaagaacagatcccaattttcccggaacaaatccaattgcaaagaacacatgcaatgaaaaggattgtcctacggtcaaggttggctctgataccaacttgtcacgcccagaaattcccgaatagaattccaagcagaatgtgcattaaaacccccgtctaggaccggccggggtacacaaacgataaagttgacatacagatcaacgtcttacaaacattataaaagtcttacataaatgcagcggaaaattaaaagataaatggagctaagccttaacttgaactgcagcgggaacaccactccacaggcatcctcgacggcacggacgaagcctactcctcggagaagccaccatctgacacgtactcaaactccggggttttggggaaaatagagtaaggctgagtacaaccaccgtactcagcaagtcataccaaaatagggggtatgatgcagggtataatcaaggtatggctagaaaggttcatttgcataaagcgggcatttaaagacggtagttcaaagcagtaaaacagttgtagtaattaatcagtattaaccaatcactgtccaacgctacaccacgttgcaacaggcccaaccaaccacctgaactacaccagttcattagctaactaggggtgagactaatcacggtgaatctggttgaccgcccgtaaccgcgggcacggctattcgaatagttttactctgatcagaggtgtacaactgtacccacaagacacagccccacgacatgttaccgtgcgctgacatgccaccacgacataccgaaaagaggccgtgacaggacccttcgcataaccccctctagccaagcacaccacacctcaggtttcacccccatccccagcgggcaacgggcagtcccctctcgtgcctaggtgaatccggaaggacagaggccgtcgcagggcccgtcccgctccatcatgcccacccttgcctggatgcgtcatctagaggaaagctacactacaagcccagccgttgcccacaatggcttgtggtaagtacgataagttcttccagggcatcccgcgaaccggtccttaattgctatgggcgcgaccatcaaaaccatgcacccacaacccaccatttaatatattttaattaaccaacaccggagcggtggcattaaccaacattattactagaatctgatatcaactcaataatgtattttccccattgtgtgttagttgaactaagcatggctaagcaatccctagtccaatatctagtcatgttatatccccaagctaacaaaggagcatggtacaaaaatagcatggctgtaacagtaggtaaagatcccatagtaacattataaaacgatgcagtttttaaaggaaaacgatagagcatttgcaatataggatcaacatgttcaagtgacaagcatgacttgcctcgctctgctgctggaggaacctcggcgactatttcaaagtacaccggagcgtgaggagagccggaatctaagcgacatacaaagcaaacaatacaaacatgctataagactactgaaacagagaacaaaatcatttttaatggattctatgcatttttcttgatttactgagacttgaatgggcttaaacggagctcggatgaattagatatgaattttagaagattcactgtgtttttactacaaacagaaaaaatccttaattgatttattgcgcaatatatcccagggctgacgtcaacaaaggggggcggcgccaacatgcgggccccacatggcagtgactcgggtggcggtccgcggtggaccgggtccacggaccgcggaaggaggcagcgcaccacgtggcgctgacgtggcgccgacgtggcgcacacgtggcggccacgtggcacgccacgcgggtggccgaaccgacggccccgatctacccgagggtagatcagatggcggaggggagcgcacgttcggcgcgcacgggcggctcaagccggcccggcggccatggcgcacggcggcgctccgcggggcggcggtggcagacgacggcgaccgacggctagcggcggcggcgcgacagcgcgggcggcgctagcggcggctaagtggctaggcggcggcgcagcggctaagcggtgcgggagagagagagagagagagagagaggaaggggaggaggtgtctcaccgacggcgattgacgacggcgagcgacagatggcgatgccggcgacgggacgagctcctgaaccacctagcgaacacggtgaaaggggttagagagggagaggaagatggaagaggcgaggacgccggccgaaggcggcggccatggcggtggcgcacggcgcggagtgggttccagcggcggaatccgacaggagaggggtggatagggtggcccgcacgacggcgaacgcgatggcgtctacggcgtggctcggtgcagcggctagagacggctagcggcggccagagcggtggcggcggcggcggaaaagagggcgacggtgctagggctatggagggcacgggaacggatggttgcaaaacgaaaaagagaggagggaatggggaacctttatataggcccacaggggtcgatcgtggccggggtgaccgcgatttcgccagcggagtggggagaggtggggaggagagagaggcgggattcaaaaattgaatcccggccgtctcgagcgcgggcgcgggagggagagagagggagtgggcgcggggaatgcgggcatgagcggcgacgtgggcgacgtggcctaggacacgtgggagcgaggggtggcggcggttgcggaatcggcggccgcggctggaggtggaatacgggcccgacaggtgggccccacctgtcggtgaccccgggagagaggaggggctcggccggccggctcagctgggtcgtggccttcggtcggcccagcggggagggggaggaggaagagaatgggccggcggcccattcgaaaaagaataaggggaaaaagaaaaagaaaaaggaggaaatgaattttcttgggattaaatattgcttgtgctcatttttgattggttaaaattatttctagagctatgaaaattccactaaaaatcttgttagcacatttcgacatgtagagctcaagaaaaattccacatgccaattccgattattatttgcattaatttatttagggtttcactcttgcttttacaccggtattttctcgagaccaattataaattcaattttggcttgggagaagaacttcagggtgtgacagttgcctcctgctcaaggacttaacaataagagccactatacagaggtaccacattgctaattaacataatgactaggtcagtccccattctagaaa

SEQ ID NO: 36306 - DNA, 6103 bp, Oryza sativa
ctactgaaacagagaacaaaagcatttttaatggattttatgcatttttcttgatttactgcgacttgaataggcttaaacgaagctcggatgaattagatatgaattttagaagattcactgtgtttttactttaaacagaaaaatccttaattgatttattgcgcaatatatcccagggctgacgtcaacaagggagggacggcgccgacatgcgggccccacatggcagtgactcgggtggcggtccacggtggaccgggtccacggaccggggaaggaggcggcgcaccacgtggcgccgacgtggcgcacacgtggcagccatgtggcacgccacgcgggcggccgaaccgacggccccgatctacccgagggtagatcggatggcggcggggagcacgcggccggcgcgctcgggcggctcaagccggcccggcggccatggcgcacggcggcgctaacgcggggcggcggcggcagacgccggcgaccgatggcggcgtaatgagcgccggcggtgcgacggcgcggacggcgatagtggcggctaagcggctaggtggtggcgcggcggctaagtggcgcgggagagagagagaggaaggggagaggggaggaggtgtctcaccgacggcgattgacgacggcaagcgacggagggcgatgacggcgacaggacaagctccggaaccacctagcgaacacggtgcaaggggttagagatggagaggaaaatggaagagggcgaggacgccggccgaaggcggcggccatggcagtgctcaccggcgcacggcgcggagtgagttccggcggcggaatctgacaggagaggggtggacgaggtggcccgcacgacggcgaacgcgacgacgtctacggcgcggctcggcgcagcggcttgcgacggtagcggcggccggagcggtgtcggcggcggcggaaaagaggacgacggcgctagggcgatggagggcacgtgaacggatggttgcaaaacgaaaaagagagaggagggaacggggaacctttatataggcccacaggggtcgatcgtggccggggtgaccacgattttgccagcggagtggggagaggtggggaggaaaaaaaggtgggattcaaaaattgaatcccggccgtctcgagtgcgggcgcgggagggagagagagggagtgggcgcggggaaggcgggcgcgagcagcgacgtgggcgatgtggcccgggagacgtaggagcgaggggcggcggcactgattggaggtgggagacgggcccgataggtgggccccacctgtcggcgaccccgggagagaggaggggctcgggcggccggcttagctgggccgtggccttcggccggcctagcagggatggggaggaggaagagaatgggccggcggcccattcgaaaaagaaaaagaaaaaggaggaaatgaattttcctgggattaaatattgcttgtgctcatttttaattggttaaaattatttctagagctctgaaaattccactaaaaatcttgttagcacatttcgacatgtagaactcaagaaaaactccacatgccaattccgattattatttgcattaatttatttagggtttcactcttgcttttacaccggtattttctcgagaccaattgtaaattcaattttggcttgggagaagaacttcagggtgtgacaaacctacccccttaaacggaatctcgaccccgagattcggaagagctggtgaagaggtgcggatgggcggccttcaactcatcttccttttcccaggttgcttcttcttctgagtggtggctccactgaaccctgcagaacctggtgaccttgttcctagtcctcctttcactggtctcaaggatgtgaactggcttctccacatatgtcagatcttcttgaatgtcaatgtgttccgaatcggcttgttcttcgggtaccgtcaaacacttctttaactgggacacgtggaatacgtcatggataccgaccatgttggatggaagttctagctgataggcaacttctcctcttcgttcaaaaattttgtatggtcccacgaagcgtggtgccaacttgcctttcatctagaaacggtgtactccccggagcggagtaacacgaaggtacacataatcccctgcttcaaaagtgagctcccttcggcggttgtctgcgtagctcttctgtcgagattgtgcaattctcagcctctctctgatggttctgactttctcctctgcttccgttagcacttctgttccaaacagttgacgtttgcctgtttgatcccagaagagaggtgtgcggcacttccggccatacaacgcttcgaacggtgccatttgcagactagcctggtaattgttgttgtaggagaactccgcataaggcagacttttatcccaagctcctccaaaatcaagcgcacaggctcgcaacatatcctccaaaatctgattgacgctctcggtctggccatctgtcaacggatggtaagctgtgctgaaattcaaacgggtacccaattcttcttgcaacttctgccaaaattttgaggtgaactacctccctcgatcagatactatctttttgggtactccatccaaacacatgattcttgagagatagagctctaccaaccttttgcctgtataagtagcgtgcactggtatgaaatgagcaactttggtgagtcgatccatgactacccaaattgaatcgtggctagatgatgtcctgggcaaacctgtgatgaaatccatcccaatctcttcccatttccattccgggatctgaagaggttgaagcagtcctgcgggcctcttatgttctgctttgactcgctgacaaacatcgcagagtgcgacgaattcagcgatttctcttctcatactggcccaccaaaatttctctttgagatcttggtacatcttggtactacctggatgaatggagtactgagtctggtgagcctcggtgagtatcagatctttcagctctttgtcatcaggtacgcacaatctttctcccaaccagattgtgccatgttcatcttcgtggaaatcccgggcttttccgaccctcatattctttttcagttcagctatctcaggatatttacatgagctgctctgacttgatccacgagcgtaggccgtgcctctagagcagccacaaacccgtgttctacgattcccaagttgagatgtttaagctcctgctgcaattccttacacatgccctcagtgcacaaagcattgcagtagctcttcctgctcaatgcatctgccaccacattggctttgcccggatggtagtgaatgctcatgtcataatctttgattaactccaaccatcttcgctgtcggagattcaggtcaggttgggtgaagatatatttcaaactcttgtgttccgtatatacttcacagcgatcgccaatcaggtaatgcctccagatttttaaggcgtgaaccaccgctgccaattccaggtcatgtgttggatagtttccttcatgcagacgcaactgccgtgaggcataagcgaccactctgccctcattagaatgcatccaagcccatgacgagacgcgtcgcaatagacttggaagtctttcgtctggtcgggcaaattcagaactagagcagacactaatttcttcttgagctcctcaaaacccttgtcacactcggctgtccacttgaatttctcgtctttcttaagcaactgagtcataggtctggcaatcctggaaaaattttcaatgaaccgacggtaataacccgcacgtccaaggaaactccgaatctgtgacactgtcttaggtggggtccacttggtaactgactccacattcgatggatccactgccacaccttgagcagtaatgacgtgacccagaaatttgacttccgacaaccagaagtcacacttactgaacttggcatataactggtgctccttcaacttctcgagtaccagacggagatgttgctcatgttcttcttcggactttgaatagataagtatgtcgtcaatgaacaccatgacaaacttgtcaagaaactccataaacactttgctcatcagattcatgaagaatgcaggtgcattggtaagtccaaaagacataaccgtgcactcatacaacccataccgagtggtgaaagctgtcttgggaatatcctcttcccgaatcctcaactggtggtaacctgatcgtaggtctattttggaaaacaccttggctcctttcagctgatcaaacagatcatcaatccgtggcaaagggtatttgttcttgattgtgacctcattgagtgcgcgataatcgacgcacattctcttcgtcttgtccttcttctccacaaaaatgaccggagcaccccaaggtgaagtacttggtcgaatgtaccctttctgcagttgctcatcaacctgcttcttgacctctgccagctcattggctgccattctgtacggtctcttgtaaattggagcagtccccggtgccaaatcaatccggaattcaatctctctcttgggtggcatggtagtgaggtcctcagggaacacctctgaatactcgcagactatggggatatcttccaatttcctcgaacttttctccgcggtgaccaccgaattctccacctcaatctgatttaaggagattccctgcttcagtgcgactggtgacttgtacaccactgtttcccctctctcattggtcaaggtgaccgtgcgattcgcacaatcaatgatacccttgaacttggtcagccaatccatcccaagaatgacatctaggtctttggattcgagaaggacgaggttggctagaaatggtgatatttggatttctattgttacagaagggctgaattaaaccgaggtggaactattcccgggggtatgaacccgtattggtgtactaagctcttctcttattagcccatgttccccaataaacttctttgaaatgaatgaatgcgttgcaccagaatcgaaaagtactgttgcataaattgagttgacaggaaacgtacccagtacgacctctagtgctgcttgcgcctcttccgcggacgcgtggttgacacgagcttgggcaaaccttggcccagcacgccttagcttcgggcacttgtcagcaaagtggccatgctcgccacagttgaagcaggaccctggctttactccagtctccttcttggcttggactgatggagctgcctgtgctgtggccattggtgggcgcggagctgcactgcggttgggctgacctcccgggtggttctggctgccactggcgacctggtggaagctacttgagttgaacgggcgatactggtggacaatcatggtggtaggtccaccctgctgtccgggagtgaagcgcggtcgctggtgacttccttggttggaccggaactgcgctgcctttctcttcctgtccattttgttgcgctgatcctcctggcggattgccttgtctaccagcttctcgaagtcagcgtaatccctagagatcaactggttggtcagctcgtcatccaggcctgctaggaacttctcctgcttctccgcgtcagtgcggacatcctccggtgcatatcgcgcttggcgattgaactcatggaggtactcagttactgccctgttgccctggtggagtgcctagaattctctcttcttttgtgccacgaccccgtctggcacctgtgccttcctgaagctgcgacagaactccgcccaagtgacctccgtacctggcggacgggtagccatgtgattgtcccaccaagctgacgagggaccctggagctggtgtgtggcgtaggtgaccttcttctgatcattgcactgcagaagattgagcttcttctctatggcatggaccaatcattcgcctccatggggttggtggtgctagagaaggtgggtggactgacgcgtagaaacttcggcagcttggactgagggggagggggaccaaactgctgctgctactgttcgacttgctgctacatcctctggtgcatctgctggtgctgctgcagcatctgctgcatcatggcc

SEQ ID NO: 36307 - DNA, 2037 bp, Oryza sativa
  unsure (1)..(2037): unsure at all n locations
cctgctaggaacttctcctgcttctccgcgtcagtgcggacatcctccggtgcatatcgcgcttggcgattgaactcatggaggtactcagttactgccctgttgccctggtggagtgcctagaattctctcttcttttgtgccacgaccccgtctggcacctgtgccttcctgaagctgcgacagaactccgcccaagtgacctccgtacctggcggacgggtagccatgtgattgtcccaccaagctgacgagggaccctggagctggtgtgtggcgtaggtgaccttcttctgatcattgcactgcagaagattgagcttcttctctatggcatggaccaatcattcgcctccatggggttggtggtgctagagaaggtgggtggcctgacgcgtagaaacttcggcagcttggactgagggggagggggaccaaactgctgctgctactgttcgacttgctgctacatcctctggtgcatctgctggtgctgctgcagcatctgctgcatcatggccgccatcatctgagtctgatgggccatcacttgtgcaagcgtcgggttctctgggagcggtggcggaccattgccagaggcgctgttgggatatccactgtcggtgtgctcttcgccattgctgccctcaccggctgcgcggctgccattcctgatgttgaccatctgaaggaagagcagacggagggggtggaaaagaagaaaaacagatgctcaggaactaagctttattatagaggaatttaaactgcaattgttctgatctgaattaaaacacttaaaacagcaagcaaaatccttattaagacagccacatcataggcacatgatgtcgaccgtcgactgacccacaagcgaacaaacctagacacacaaactaacaggcaattactaagcagtcgataaactaagggaaaacgagcctaatgctcggaacggctcctgcggttggtggagtagaaggcgtcctcctgctcgtcgccgggtccctctgagcggctcctggagtctggcagatacgtcttgccgctgtccggctcggagctactggaactgctgctgctgtggtcgcggctgccactgggagtagcaggcaaccaacctccgttgccactggctggacccctggcggctgacgctggagagaaggagagagcggacgccggagctgacactggaacgggagccggaaccggagctggagctgcgagcgctgcgggaactgcgggaggtgctggaggagctacgtgtcacgcctggaatttctatccaaaattccaaacgcttacatgtgtgttaaatcctcgtccaggaatcagccgaggcacacaataacaaattgataatagagtactattaaacaattaattaatattcgcaaattaaataattattacagaggtggacaattcctctcgaaagaataaaattctacgcagcggaaataaaaacaaaagactaaacagctatggcgactccactccacaagcaacttgacccgaacaaagcctaatcctcctgatcatcaccttcattgaagtactcctcctctgatgaatgaatattgcaagaatgagcatatgacatacttaaaaagccacacagcaaatatgcaagtgcataggataacaaaggatgacattatatagcttatttgcatcaacaacaattaataaacatttgagaatagtaaaacagttgagtaattaagcaatattaaataaacactatacaacacacccgtgttgcataggcccaacctcatctgaacaaccaaccccggttgtacagatcaaacctccataccaggaatataccattccaaaccaagagtcaaattaattatcacagtattatcattaatgagtagtgcgatactaatcacgaaaaacattgttaaactcacccataatcgcgggcacggctattcgaatagttttactctggccagagatgtannnnnnnnnnnnnnnnnnnnnnnnnnnnnnnnnnnnnnnnnnnnnnnnnnnnnnnnnnnn

SEQ ID NO: 36308 - DNA, 899 bp, Oryza sativa
atataccattccaacccaagagtcaaattaattatcacagtattatcattaatgagtagtgcgatactaatcacgaaaaacattgttaaactcacccataatcgcgggcacggctattcgaatagttttactctggccagagatgtaccactatacccacaagatacagctccacaatatgttaccatgcgcctcgataccaccacgataccttggaaaggaaccgtgacaatacctctcacacaacacaactcaccacagtgcgccattcctggatcataatctccccctcaaaaccagaggcaatggactccccagcgacccctacggacttctcgccgcttcacagtctggcaccccgtaatgaaccatgctatacaaaaggtaaagccgttgcccacgttggcttgtggttggcacgattaatgtttcacaacagtagctcgcgaatcggtccttaattgtcatgagcacaaccatcaaaaccatatgctcacaacccacctttaatcagcttttaattatcaattaattatcataacaagattaaccatcgtgagctaccattagatataaccataattaataatgtagtatgattcatcccattaatgagctaatgtttctaagcatggctaagcaattatacatatagcatttagctgaaccaaaccaatatataaggttctagctaatcaaattataacccataggaaaaataaagtcattttcggccattaattaattgggaaaggctcaccacccgatgacattcgaaaataatgcataagttgaaataaaacattagctttaaacgggttcaacatgctcaaagggttgtttgggatctgtgtgacttgccttaagcttccgcaaacgcttctgaaccttcctcaacg

SEQ ID NO: 36309 - DNA, 4756 bp, Oryza sativa
  unsure (1)..(4756): unsure at all n locations
nnnnnnnnnnnnnnnnnnnnnnnnnnnnnnnnnnnnnnnnnnnnnnnnnnnnnnnnnnnnntgtgggtccatgaacaacatgtcagtgacttgttatggaaaactttttgttggagtcgcttgtagttatttggtgcatcatgagcaaataatatttatgtagttataaaagaatttcttagcacgtcatctagttttgaagatatagaagttgcgatgttatattgagcacatggttatgtctattaaaatataatgactctatcattcatctttacgtaaattttaaatttatttaatcatatgcttgatcttgttaacatatgatagtctttggtttattgatttgcattacctaatgttaccatagcgttagcaggagcaagttactagttaggttggtgcgctgttactgtgcaatacttttttcctagtaacttgacactgttatgctacaagaaaattttctttacaggataagtattaacaaacaggcactatacattttcctttaccattgccttgatttatggaacaaaatatatgatttagccaaaagcgcttcttgctacataacaattgatacgatttggccaaaaggcgcttcttgctacataacaattgagctacattgtttgttgagcgtgtgctttgagatatcagagctacataccagtgaactttgataaaggatcctcacgatttcttacggaatcgttggcgctttgtgcctcctgaattgttattcccatcccaagcacttccccagaaaaacagtgccatccagaacagaactgcaaagaatatgcgtatcctatcctgtaatcttgataacctctcttgccaacctgtcaaaaggaagaaaagactagtacatatggttaaatgcatgcatccattaagcatgaactacaatcctgagatacactagaaatatgttgcgcatgaaagtaataggtagaaccgtagaactagagaagaaaatacaaaaatgattgcactgctctactggctaaaagttaaaatgcatacaattattaagaactaggagtataaagataatgtccacaaagttcaccagagattgactgttcctagacacaattccttgatagcattgtgaaacaatctcgttttggttgttgcaagcaagtgatacacatgatgtacataattcataataaatttcacacaaatgttgatgaacatcactaaccaactaatgaagtctctatatttatgatttaactaaaagttgcactgacaaagtaaatcaaacaagtagatacaactctaactatgatgtctgaaattaaaatagcatcaagaaattaagcattcctaagtatacaagataacgattatagtttgttgacgatgctgcctcaagttcaacacaaaccccacaaaaaagaacagcacacagagtcagccctccaaaagtttctagtgggatggcaaacctaggcagctagtgcttgccggtgttggctgggtgtgtgggtgtgttttttcggtgggagggctttggttctcctactttgttttttttttctttttcttccttccccttaatgaatgaaacacatttctcttgcattttcgaggaaaaaaatcactacggagtttttcccattgttgatgagttccctttgttgcgaagaatgctgaagaccaccaagaaaactaaaaaccaaagttttgtgagatttatgtgcaagatcaatgtacgtgaggaacaattatgataatattgcaatgattgaaaatttgtgtttgagaggtgaagtgccatgtgcttagtggtctgaccagtatggtaccgtagtctgactatggccctagtggtcaaactggggacgactcattttagtttgacttttggtcgcctcgggtttgcatggttggacaggtcacataacaacagtctgactaaggccagctaagattgggttgattaggacttatgtccaagttggttttgagttggatggctattgcaatattcttagtgatttacacacattacatatgatgtgtaaacgctaatttgaatcaagttcagaagaacttgtggtaaaaaaattgtttcttggtttggttatgacgttatgtacagttattacttgagggtgagcgtggtcgatgaccttagataggaacaagacagatgggggtgttgaggttcagtcattcagatagtcaatgagttcatgtgggacacacgggtagataacagtgcatgcgaaggtgagatttccatatggaattcatgggagatgtgcatcttatggaaaagtataataatttaaaaatagtccaagtttggcgaggacaaactcggttatgcgagtctttcctctacagctacgagccctagataaagaaagatttgtggcttgtgacagccatgttgcgggtatataaacactcggggagagcaaaattgttgaggatttttagagaagaattagggatttagacattttccattttcatctagggttttcccatgtggttaagggtgccaaggatacaccttgtaaacattttaaagcaacaaagataaaattcataaatccaaaggtgtaaaatccttttgcttttcctcactgttcttcatttttgtctatttttgtacaagttgatccatccaaaacttgctagggcagaaagaaatagttctgaaaattttcattgttcctttctgatgtttgaaaatgaccacattttcatgttttttatgatttcagggtcaatatgttcagatctataagtcgaagtgcgaaagttcttcttggaacagtttctaaatagataaagtttatattagtcgaaaagttccaggccaatagaagttagggggttagaagacaccaattttacatttggtttgacagattgcaaacagggctcgtggtctgaccatgactaagccactaaggacaatccgacctaactaacagggcctaagtgtgattgcagtggtttagtgatttcagtcctacaattgcagcattaagtagctgctgtttgcaaatcaggccatccacctgatattctaatttatgatttgtactgttttacttctactagggagggcaacatactagtaactatatattacatatgttgcagcagtttcaacttttaagatataacaaatatatttcatattttagtttcctaggcaccaaaagaaaacatggtatatggacagctaacattctcatgatattgaagcctggatgtctggcctgcatgaacaccataaaaaaatggccaacgatacattgttcccctacatctatgtgctctgctgcaaactaacacactacggatgaagaggacactttcttcagcaattcattttgtcccacaacccttttataaaatggaacatgtataaaaaagcatacatttgccgttagacaaaccgacaatcagcatttggtatctcaaatccccggcaaatgagtctggatcggacacaattagtacatagtaattctctagtacaacacatcccaacctcaatcgattaatcaattacttgggagcacggcataaaactgcggaagcaaaaagggaaggggacgcacagcagccttaccgtggggagaccgtggcggcggctcagaggagggcggagaggggccggcggctgcacggtagcggaagccgggccgagaacggtagccacggcccacagctgctggtaatcgccggaagcggagaccggaaaggggtaggaggtgccgcagggcggaggtggaggaggggatggtggcgggtggtgcgagaggaggggagctcgccgccgtcatcggggagaggcgatgggtccgggacgtggcggaatgacctcttcttcctcttcctctgccggttgggcgcggcgctctgcaacaagaaagagacggtttgtttggcaactctcgaccgaattgacagcgagatggaaatttgatttttagttccaatttcttgtttggtagtgatgttgaaattaacagagtttagttcgagattaaatttttaaagaaaatggatggattaaatcttccatgaaaatggatggttcagatttgtttaggcaaaataaaggaggaattcccctaattactatccctatctaggtattgaaaaggatgaagttctttcttcaattctccatcctcatcccatcgaaactctcatgtgttacaaccagttgacgtaaaacacgaggcctgggagatcttcttaactccagtgcaggtccaaaactcgccttcgggtatactagtgtgccagttgatttgatcctgcaatcaacaagaaacaaggacaaagaaaccgtggttaaatccataaacgatagacgatcggctaggtgccgatgacatattatttatctttgagccgatgtcatatatgcatcgatcggcaagtatcaataaataaaacagaactaaatctactcgatcggctatagatattaatgatatatgatccttatatcgatatatacttaaaccaagtgattgggatagatcggtcgccatgccgagacagtataaatcacttagatcgaaatatatattaataatgagattatatatattcatagtatagccgatcagatagatctagcatgtatcagctaatactctgataccactctatactaagatatcaaagcaaatagaatatatcaaacaaaagcctaatattcctaaatgcagcaagatcttaacataaagggcagatttaa

SEQ ID NO: 36310 - DNA, 9023 bp, Oryza sativa
atgcagcattaaatatgaaaagaagaacaatatctagacaatcaagccactagatgcttcatagagtggtaaatatcctatataatctaagccaacgtcgctatttaacctaatcggctaccttctactaacagatgttagccgattgtaggttagataacgatattaccgaagattatataagatatatgataactcgacgaattacataaataagattagagtatcataaagatggaagcactaatcccgagaacgcaagctgctataacaagtttacctcttgttgaagatcgaaatcgatgcagctcaacccgaaagcaagaacttgtcgaaacaaaacgaaagcaacaattcttaaaccggctccaccagtaagatatttttaatcctttcactagttgatctcagccgattttgtctaacacttgtctcttttacagcctcctcctcctccttcttctcctgtacgaccatcatcgagtgaccatactccgtcggctgtagggagccatcatgttgaagaagaagaacaactagctgctcctaccattccagtaagtttccttttgacacaagaatttagatcggctatgtctacttagctctaacttcctttaaataattattgcaggtcctagccgatcttttctgctttgacattagagactatcttgatgagacagaagaggataccacaagcaaagctttagcccccttatccgatgatgtgaagaaaattcttgaagatatctcatcggctagaggcatcatcgttagacagcttagtggttgattgtggctcaattaggactcggctacatgaggttcaagctctgatcccagatgagctagccgatatccttactccggccgtatatctcgagcaacatcaattcaagctagagaaagccaagctgagactagctgaacgtcgggagcgcaaagatatcgaggctacaattcaagccaatcgacagcttgttcatgaagagaaggccaaacttgatcagctatctgagggcccgatcaaatctaatattgatcggctcgaaactcgtaagactgagctcttggcacaacttgaagaatgcaacgccgagctggacatggaacataaaaagctagccgatctcccaaattctgttgaagagcagaaggcaagactaaaatcggctatcaaaaatgttgctgatctgaccaagtttttaaaagtcatccctgtaaccgatgctcaaggtgcccatgccattgaagaagtagaaaaaatcaggcaaagagctatttcagctttccagcaatatttgtcttagtgatatcttatgtaataggtcttagaaatttttttgcaatcggctaagaaactctgactctttatgtaactcatctcaacaatctttaagccgatttaatatgaccccatatttggctcaaaaatatgcaatttttcatatatatatgtgccccccctaattttacaatgtcacaagcattgataaaattataaaagcggctaagggcgatacaacaatatcggccattatacatcggcaaaccataaccgattacaatatgaaaaacaactaagggcgatataacaaaggaggaactgattaaacggcttgctgattatcagtgatcaagggccgataattcgggaaagtacctccttgaagataaaccggtcccgtagtctgatagtcagctattgaaccatcaaccatcgacttcaccatgtttgacaaagtattgactaatatcccagattgattgatcaaagcatgatgtacggcatagtctacctgatcttggaagttattaaactgtagctgtgctgcgttactaacttggttaagattagcacctttaaatccctgagaaccatcaccttgaactccttgagagccaataccttgaactccttgagagccatcaccttggtctcattgaaaaccatctgcagcacctttatcagtcggttgagccgagccatctagagcttgtttcacttctccatccttagaagaaccggtcccaggaacatcagcaactacctttactttgtacttctgaactaatgttcccttgcgagtctccgtgaatgagctcaagaactgattccgtgcttactgcatcattgtatcaagatctttttgctgctcaagtgtcaatttatcaaaagtgatgggcacaatgttggcttcatcaatctcagatagacccagcttcaggatcttttctttaacagagccaggaccagccgaggacggcgatgctactagtttctcggccatgaggaaagctgctgttgtgattctgacttctgataggtcccaccaggcgtgccaaaagcgtgttgacgtaaaacacgaggcctgggagatctgcttaactctagtgcaggtccaaaactcgccttcgggtatgctagcgtaccagttgatttgatcctgcaatcaacaagaaacaaggacaaagaaaccgtggttaaatccataaacgatagccgatcggctaggtgccgatgacatattatttatctttgagccgatgtcatatatgcatcgatcggcaagtatcaataaataaaacagaactaaatctactcgatcggctgtagatattaacgatatatgatccttatatcgatatatacttaaaaccaagtgattgggatagatcggtcgccatgccgagacagtataaatcacttagatcgaaatatatattaataatgagattatatatattcatagcatagccgatcagatagatctagcatgtatcgactaatactccgatacaactctatactaagatatcaaagcaaatagaatatatcaaacaaaagcctaatatacctaaatgcaacaagatcttaacataaagggcagatataacatatcaacgaagcatatagagtaaaactagttaaatcaggtaagatcggctgaaaccccgatgctaccctaatcgtcaaccagaaggcaggctagagattgatattctaagcacgacttaatagatcaaactcaactgatgcagcattaagtatgaaaaaaagaacaatatctagacaatcaagccactggatgcttcatagagtggtaaatatcctatataatctaagccaacgtcactatttaacctaatcggctgccttctaccaacagatgttagccgattgtaggttagataacaatattactgaagattatataagatatatgataactcgacaaattacataaacaagattagagtatcataaagatggaagcactaatcccgagaacgcaagctgccataacaagtttacctcttgttgaagatcgaaatcgatgcagctcaacccgaaagtaagaacttgtcgaaacaaaacgaaagtaaaaagagtggcgatgcgccgagattgtattgaacgtgtgttaaattgattacatggggctcggggtctatttatacccgagaattacaaaacatgtccgtatcggacacgactcttatctctaacaaactctaagataccataagtctttgcggcagacttttgcccgaatatatctctaaggaaattacataaaatatcctaattaatatatacaattgccttctcaagactctatccatgtgtggcaatcatcacgaagcacattaactcaacccgatgatgtataccgagtcgtattgtcggaatcggctgtatcagcttacccaatctgactcggactcagccgatcctgattgtagctgatttggattccagccgattcttactctgttcccgaatcgatcttcgtctttgattccgcttcgatctaatcttcatcttcgatactgacactggtggagaaaccctttgtagtcccggttcgtaacccccctttagtcccggtttccaaaccgggagtaccaatccgggactaaagatcgctatctttagtcccgggtgaaataaccgggagtaaaaatcgatctttagtcccggttggtaacaccaaccgggactaaagatcgagctaaccttttttttttgcatggccctgttgctgcatggtttatatatatatatatatatatatatatatatatatatatatatatatatatatatataaaccatgcatatatatgtttcaatacatatatatgcatacatatatatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaatcgccgcgataaattccttgtgtgtggtcaggttatccctcatgcgaataaactatatgaatgtatgaaattgattagtaattaaacaagaaatcgctacgtaatgaaattttgaatttatttgtacatacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgtaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacatatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagaggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactagtttggactttccagaagatgctttcttcagcgttcgctcatagtccgatagcttgatggtctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagtggagcttgcgggggagtaggtgtaggagcacgaggaggagtcggtgcaggatcctgaggaggagtcgatgctggagcctgaggtggagacggtgctggcggagcatgaggaggagacggtgtaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcagaatggctaaatcttacctttattgataagttcttgaaaggaatatgcagctcacatggtgtccgctgagtgatgtcatcaacgggacaggtcgattcgtcctgtgtttgcatatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccatttccctcgagttcgtcctggatgctctggagtctgcagggcgagtgtcagctcgtccctatctctgtctggtcggaacgtgccctgagaggaggcttccactgcatctgttagtcgtcgcgcagcctctcgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactatcactagcctcctcctcctggttcccctccacatccctttccacgtgcccctgctggttcccctccgcatccctctccacgttcccttcctcgttcaagtactggtttggatcctcgtttccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgacataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtcatgtatgctaagtgtttcgggcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatatattaggataaatgcgaagtaacatatatatatatatattgcatttcacgttaacgttcgtcctcgttcgttcgctcgttcacgttccctagctcgttcacgttcgttccctcgttctcgcttgtcttcgttcgatcgttctcgttctcgctctcgttcgtt

SEQ ID NO: 36311 - DNA, 1596 bp, Oryza sativa
  unsure (1)..(1596): unsure at all n locations
nnnnnnnnnnnnnnnnnnnnnnnnnnnnnnnnnnnnnnnnnnnnnnnnnnnnnnntggcggcgaaggagagaggccgagagagatcgatcggccgaaaacgtttaagtgttggtgaagaagacgagggcgcaccgggaatatatatacccccggatctttactcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattgccaaggacaaaaggttcgtccgagtatccaaccttgttaaggtcaacagttgtcatcccactgtcatcaatcattacgcctccactagtcaacctaacccattggcaccggaacagaggaaccttgagaggaccatagtcaagttcccatatgtcctcgatggcacc

SEQ ID NO: 36312 - DNA, 6608 bp, Oryza sativa
  unsure (1)..(6608): unsure at all n locations
nnnnnnnnnnnnnnnnnnnnnnnnnnnnnnnnnnnnnnnntcaacagttgtcatcccactgtcatcaatcattacgcctccactagtcaacctaacccattggcaccggaacagagaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatcaatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaactggtagcagttgtatcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgagtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatggagttctttttccacatcgccgcgtgaccatcttcgctctctatatgctggcttccaggcccctttccgaacactactttaagatctttaaccatatcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacatggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttctagtcctaacgggcagactatcttcttagcctcgtacgttgtctcgggcaatttgtttccccccggaagaatgttcttgacgagtttcaataaatcgccaaatgccttgtcactaaccccattttttgccttccattgcaccaactccagagtggtatccaactttttgtgcccccgctcgcaacctgggtacaacgaagttctgtggtcctccaacatcctgaccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccactttatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgctggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacatacattttctctctcatcaacttacaactaaattttggagacaaaaaaagtgtgcaaaacataggtgcaaatgtagtatgacaaaaaaaaacattggaggatgaagttgcaaaccttttaggcacctcgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgagatcattagtcccggttggtattaccaaccgggactaaagttaagatctttagtcccggttggtgctaccaaccgggactaaagatcccgggggggcctgacaggtcctgacagcattcgacgcgaggatctgttagtcccggttggtaacagaaaccgggactaaagatcaaatatgcccgttacccttttgaaccgggactaaagatcatctttagccccggtttttattgcatccgggactattgtggaaatcggccgaccgacgaaagatggtttctccaccagtgtgatattaccaaatttggttgttaacacaaccaaacagaataattaatagcatcatccctctaaactctcaatctctcctaaaaactcccccaaccaaatgacccgagaggggttgctgaatttttttatatataatagtccctccgtcacagaatatagacagttttagagttggacacggttattaaaaaaatagatagcattaaatagaaagagattgtgattggttgagcagtggaggtaggtgggaaaagtgaagggttgtgattggttaggaaggaaatgctgatgaagaagttatattttgggacaaatcctaagagcatgtacaatagcaggctataagtcaactataaacatattttaaagagataaaggaagagagagaaaagtagcgggctacagatctgtagccagctgcagcacggactacaagacataatgtgtgtatgacaggtgggaccaggtattaatagtatagtaagcaactattgtatgaattggctgttacattggctatagatgattttgagctaacggtgggctatactattaaaattgctctaagtgctaaaaattgttatattttgggacgaggagtaattaactagcataatgcctgtgggttgcaacggtttctaaataatatttattgacataaattaaaatccaaaatcatatattatagttgggataaacgacgaaggaaatacaaacatacaaataacttttgtccggaacgataattcaatatcatgaaaattacataacttaatccctattttttcatttacctataaagaattcaatacaaagaaaaatataaattatgataatttttaatggatcaaatagtgctaaaactaatactgtgaaaaaacaacttaaattagttagaaattgaaaaaacttattttagcccacaaatgaaaaatccaatacattaattctaaaacggtgcatgtttcattgacataaattagaattttattgttctattcatagtcctatggtctgtgagtgttccatgagcatctttgggctagaccaagaaggaattgtgtcaaaaaaaaacattgttcattgccttccctagctgaagacgagaaacaaaagaggaggggaaatgggtgtcggtgctcctatgaccaaacagtggcgaggaagatggtaggatgtgtctcacgatgtgactcgtccatagatggtggtggtcggcaatgaagaaaaccaaaacagcaggaattgggcaagcaatgtcatggtcttggtagagggagaaacgataatgacgagctctggtggcgaacacgaccggataagtgcgtcaaaacacattcctgaacgagaggattctgttttccttgaactcgcggaaagaatgaaagatggagatgtgtattggtcgctaaggtacaacgtaacgtcttgtacggttgtagtcgggtcatcaacgtttcttctaaatcgtagttatctaaactcatcgaaagattgggccaacaacagtcttgagtgtcgagtggaactcagggttcatcagtgccatgagggagagagggaggcgggagaggagaggcgcaagggagaagagggccgcgagggtgggggagcgtgcagcaacgaagagatgggggcgtcggaaggaagggagagaggcggaagcggagatgcatgggagggctggcggcgtgggggcagggggggtggggggacggactaaagcggagggaggaagccttccgtattttttaattaggtatatagataaccatgaaattgtttcctatatataataattaataaccatgaaattaaatcattagtaattcattggcattatttagcaaaatagtaaggacgctatttggaagatcgtccaggtgtggtcactgttacgagcagcgtctgggtatagacgtagcaaaacggcgtccaccaggcaaatgctgcccgataagctcccgcccaacttagaaggtttctaggtttctcgacaaaaggataccagcgctgctctgctttcttttcctcaattgttgcagcggtgtagccgcgattgcctgttgtagcggcgaagcttgatgtcgtcttggttgcttgttagctgcgctgcggcggagtagcctcctccagagtttgtaaactccacaccacctcttctatttgcggcgcgcaccatccaccccggtcgatgtttgactccaaaccacgaggcgaggtgacgtcgtctagctccacgactccacacgcaggtagacaaggtcgcctttgaccggccgcctccacagaatttgcaccacagcccacaaggctatggccaaagcctctgcctactatggatccttttttttttgggaaaattggaactatgccattataattttgcaaaatttgagatatgccatcgtgacccacatgtcattgactcatgtgggtcctacatgttattgagataccgatggcatatctcaaactttgcaaaattataatggcatggttctaaattacccgttttttttctagttctatgggtccacatgtcaaagaatttaatgtcatctgacttaaggaagaggatctcaatccaaaagagagtggccccagaccatgcacgcggcatcactccctcacttattttttagatnnnnnnnnnnnnnnnnnnnnnnnnnnnnnnnnnnnnnnnnnnnnnnn

SEQ ID NO: 36313 - DNA, 8951 bp, Oryza sativa
  unsure (1)..(8951): unsure at all n locations
annnnnnnnnnnnnnnnnnnnnnnnnnnnnnnnnnnnnnnnnnnnnnnnnnnnnnnnnntccaagcaaagattagtgttgatatttcttaaacggcattactagaaatataattcccagcaatgacgaagaaatattcatggtatatttatggtcacaaatatgatccgtaagcgcacggatataccattttagcatttcaccccggagtattccaagtatcatatttgtttaatcccaagggaagatatgataagagagtactatgctaatagtttatatattacttgtatacatcaaggtctatgttggggttaagtaatttaaagggtaggtgacacacagaagaaagaactatgatactctcgctaaatataatctaagctaagtggaggaagaataagaaaagaattcattcttgtacttctaatatacaaacatctttagtctaccacttgttagtatacagtcgtacaaccaatactccctaatagtgccctcctggtgtttcgagagaccaccctgtattgtcgagttccttacgacaacctgtcatggccgtctaaccggggctaaatacggaggagtatcctccccaggaatttgtcttaggaatatatactaacatggaggaatacatgtactgagttgtcaccatcagcggcccacctctactgtcccgcagcatatatgcccagatagtgatacttaataatttagacaccacatctacattattaaatactactatatatcccccgagatgacatagatcaactgagtaatcggacactaaacccacaccattgcacctctctggtaggctagctacacaactatattgatacaagtataaaatgaagccggcactcagataatataaatggaataaaataccgaagatgtataaagaagaatattctattaattccataagtcttacaaaagaagagaggaaagctactagagacataccaaaattctcctgaagacccgaggactaagaatacttttataatttctactccactagcactaggatactactaaacttgagagagggagagagctcttcttcttgagtgtgtgcagagagtgaggatgtgaggtccttacatagggcagttatgacggttaggtgatgcaaaatgttcattctgccctccaactgtcgttgagggaggcatcctggacatccacaccccaaaacctgggatcaacggcggagatggggaggctggcccaaacagcccaattttcggcaggccgtctccctgttgtctcgtcagtccagaaggcctagtggatcgtgtgaattctgtgttctttgcgcattcatccataagtctggatctcgacagcgtatgattgattgaccatttactttctgtcgattcttctccatttatatgtgcttctcctacatctatgttagtagtatagtatatagtggaagttgatattttatttgcaaattatgcattgcaagcatagctagtctttattaattgagtaatattgatggtcgaaattggtcgataacgaccgtcaacaatcagttctctagtagtgattcttttcggtgttcgcctgcacgcagtaagctcgggttatcttttgggtattactttctccgtccaagaaaaatattaatcctatctatcaatccgaatgcatgcgtatctaggtcggtagttaggattaagtttttttttataggatggaaggtgtagatcagtgtttggcaatcagctcggtttttgtttcttgttgttttaacactttttctgttactagctaattaaatgaggatagtgttggagacctaatgaaggccgacgggttaggggtgaagaagggatactgtcacataagatttatccgtgtactccctccatgctaaaataagttaatgtaggtgtgttaacttattttgcacagaaaattccctgtgtacccctgaaagttcgcccaatcccttctatgcctctgagatttgctcattctctttcatacccctaaatttcagtttgaatcccttctataccccttttgttagttgaccattaaattcctatcataaagttcattttgccctttggtattattggtatttcttaacgacattactagaaatattcattcctagcaatgacgcagaaatggtcctggtatattttctggttacagatgttatccacaagcgcaccgatataccattgtagtatttcacccaaaaatattccaaggtatcgtatttttgatcccaagggaagataatatgagtagactatgctaatactctttatacatatattacttgtatttatcaaagtctaagcaggggttaagtttaatatacgggcacagtgacacgaagctaagctatagtttaacatctaccctatagttgaacaaatggttttactcattacacattcatcatgtcacacatccaacagcctaaaatcatctgagttacatccaacgtctcccagatcgcgccctccctccaagatccctccctctctcgcgcacctccctctcccttgtacaactgccgcatccccccaacgcatcgggccccacaaatcacgccggccggggccaccccttcctttccaatagcattccctttgcctcgccatcctgctgctcgtgcccctccgcccatcacactgatccgcaccggagtcgcagtcgccacccccgagcctctgcccatcgcatcgatccccgccgtccctccacccattgcacctatccgtgccgccaccgatgacgatctcgtccgcaccgcccctccgcccatcgcaccgatccgcgctgccaggccagtttgccctcgccgcccccgatgtacgccagggcgcccgcctccacgcccccatatcaccgtcggccggagtcgccgggctcgtcctcaccaagccgatcccctccgccaccgatagaaggtacaaaaatcctcctcccctaccagatgatttgtcttgctttgtattaatgggtgcatggactggtggtggtgcggctgtcaggctcttctattatgttgcttgcaaatcagctattaagtttgaagatgtacacattttgtgattagtctcttgtgattaagagaaaattatggtgatttgccactgacactttaacagaaaattatggaggggattcttttgcagtaccagtgacatgagaaacttcagttggttcatgagatggagctgcctgactcccttctgctgggctggttttgaccctgaacctgttgtttctctgaaaaatgtgtcattttatttttagaatgaggggttgccatatttgcttgttatgccgatgtggacaagcttgtcctgttttatgcacaggaattattggtttatatactaagagcaaaattaaaatattttctacaattatatatacatagagaggctcgatttatgggcacaaacgtcctaataggtcaatttaatctctttttgggttaagcaagaactttgtattgatgggtgcatggactggtggtggtgcagccgtcagctcgctctgaactctgaggtggtttgtttttttttctcaggcgcttgcaacactacatcatttccagaacgccttcaccaaaattcactgcatgcaatcaggcgcaagggttgtgttagtgatatgccctaggggcaatcatagagatgattgtattacatactatgtttacatatttatccaactttgttccttgaaatagataactcattattagttaatgaatatgtgattctttcatgagactctttatgttgtttgttactatttctaaaagatccctgatcaaacatcatatatggaacaaatatggttaaatgatcagcacatatattaattgatgatcatgtctcatagatcatagtatctttactacttaaaaaatacgtggtggtgttggtgagtcctgtataatccaagggccgatattcctcgcaggatcctcccacagatcgaagggatcaaataacctcctgctgtcccgcaccacccccacctccgtatcgcactgtcctcacactgccccctccatcgcacgcccccgtcactcctccttcgtaccgccttcgccgctttcccagcgccgccgtcgcgccctcggcggctcctccgccgcgctgccgccacatcagtcgcgaccccggcagctcctccgccgcactgccgccacctcggtcgtgaaccccggcgcctcatccgccgcgctgctgccacctccgtcgtgaaccccggcgcctactccattgcctcatagcccctctcctcctccaaccctacggatttctcctccgtccggtgcaccgcctcttccatccccatatactattcctacttcatctctccctaccgctgtcactgctcaaaccctaagatccgaagggagggaagagaacctaagatcggaaggggagggaagagaagagcgcatatgcggtggcaacggcaacctcagcaggcatgctgtcgacttccatcatccctgtcatcctccaggtaattgattctatttttatttgatttgttggattgtctgtagaagatcgagctgctgctaactcaggatacatacacaaaaaaaacttatgccccaatcaagcatttgggtgcttggctgctattgtgctattgacggaattgaccattcttttttctcgctttgctgttcaaggatccaaacatatgttgatgaaaccggcatcacaggccaagcccaaggcaacagtggggtttgaacttcgaagacgatttaatccctgtctttggtgaaaacacaaatcatcatgattcaccatggtattaggaggtcttgattctgaaatttccaattttgcttttgttactactttatttacatagtttctgtgtagcttaccttatcgttgttaagtatggttgaactagccattttagatgctaaaattctagaagttggaggcttatccatgcagttttagatttggttggatggaatttggattcttcgaacattcttaaactatggctctttttccattaaaactttacattttccatattgtcttcgactgcttgtagacgaacaactacaggggaatatctcatgcttttatggaaccagctaatgtgagagtatcaaggggagtcttggccgaatccgttgctcatggctggtaggagtgaggagtacataggattccacactacgaggtaatctacatgcatgattcatgtgcctgttggtctctttgtctaaaatgatagttcattttggtataccacctgttgaaataaatgggctaagcccaatttaattcaattaaaatctcaagaacccacaagtaatgttagagagaataatactaccttgaaaaattaggtgaaagaacctcaacttaaatatggtgatattggagattccctgttgaccggttgaggtgatggttggactgccacacacatgcgcgcgcgccgagtcggcctcggccgtaggcgtagcgaggcgaggcggccgaccgagccgagcctgcctgctgctcttccgttttgtaacagatgagaataaagtcaccattaacaaatgaaattcattgtgttgtagcctccacaacaaatgagagattcattgtgttgtaacctccacaacaaatgagagattcattgtgttgtaacatccacaacaaatgagatttatttgtgtggtaatggagatctctctctctatatatataaggatgtgactacacagctagtggtagctgtattgtctaaaccagctgagaccctatccacctatgcttcaaataaaaatttatcttaaactacttatccgatctacgatccgattacaccgttgtgttcgtaacaattaaatctttataacaagatctcacatgattatattttgatgaaaaaacataaattacttttatagtatatctaaattacttttaaatttcactaaattacttcttagacatataaaaataaattcaataaaacctaaaattaatttgcatatattatagaagtaacttataacaaaaaagagtgtaactttaatgtatgtcttttttcattggacgtgactacacagctagtggtagctggtttgtactccatctagtctctcctttgaacttgaaaaatgcaatagtatgtatccttttttaatctctttaataacttatatcttttaaaaaaggtacactgtgggcaaatgtctggtagtattcatttcaaaaaaaagcttatatcttttagatcacatattacttctaatgtcgtgacaaagttacttccattttgttttaagttacttttataatatatgtaaattacttttagaccttattgaatttacttttatatgactaagaaataatttagtcatatctaaaagtaacttatatatatatgataaaagtaacttacatatataataaaagtaatttataaatataaatattttttcatcgtaatataatcatgtaagatcttgttgtgaagatttaattgtaacgaacacaatggtgtaatcggattatagatcggataagtaatttaagagaaaactttatttgaataggaaaaagatatacatgtctattgagaaacaaggcacacactgtgtcaatccttctcattgtgccattacagcgcggccacgtggatggacgataggcgcgatcgatcggctatgagatgcgtcgcgtgatacgactaaagcgagaagcctctcagtttagattttacgtatatataacgcaaggcagaggctctcaaagtgtgtgtcttcctcctgcattgttccttggcgatactctccttctgttcctgcgctgtctctctgtttccccggttctgttcatcccgcgcacatgggtgattggaacgagcaggtgcctccgaaactccgtccgcttgagaacctgcacgggtaggcgggcgatcaagtttttgagtagcgcttcaagcgcgactactctgcatcatcttcaccaacatgtcgacaaccggcgacaacaacaacactagagacaaggaggagcctcccgtcaacaccaacggaggcaatactgtctcaaactccagcggagggccattttcggggtataacgtttcactcttaccgttcgttcttcgtttcctacaactgtcggtcgcaatattattgcgttctcttgtctatgttgatgcttattctatattaagcacactcaagttgtatacatctagcactgtcactagatctactcatattgcaaatgtcatgtttattgtcttaatattttggattaaaatatgtcgaattatgaccaaatttccaacaatccaaaaacttgataggtctttttcggtagttggctttgctgcatcactaaaaccacatgctttcgatggttcaaattataaaagatggaaagcacgtgcacttttgtggttgacggcgatgcaatgtttctttgcttcacgaggcaaaccgagtgaaccgcctctctccctgaggaggaggctaagttcgaggctgcggattgcttgttccgtggagcattgatcagtgtgcacgccgacagtattgtggacgtttatatgcacatgccttcagggaaggacatgtgggattctcttgaggccaagttcggggtttccgacgccgacagcgagctgtatgtcatggagcagttctatgactacaacatggtcgatgaccgttctgtagtggaacatgctcatgaaattcagatgctggcaaaggaacttgagaacaacaactgcgagttgccggacaagtttgtggcgggtggcattattgccaaattgccaccttcttggtcagactttggtacttctctaaaacacaagaggcaagagttcagcgttactgatctcattggctctttgggtgttgaggagaagacgagggcaaaggacaaccgggacaaaaagatcgagggaggttctagcgctaatttggtacagaagaagaaccctcacgcatcccacaacaagaacaagaaagtcaaacctgacgtcaaacccaaggctacaatcaattttaagaataaagacaagggaaaggcaaaaggagattgctttgtgtgtggcaagcctaggcattgggccaaggactgtcctgagtgcatggacaagaagtctgcaaacatggttattagtgagggcggaggaacatcggggtatggtaaattttatctacagttctctctgtctgtcactcccctgattggtgggttgatactggtgctaatattcatgtgtgtgctgacatttccctgttttcttcttatcaggtcgggagaggttcctccttgttgatgggaaacggatcgtttgcggttgttcatggtgtaggtacgatcgatctgaagtttacttcgggaaagatcgtgcagctgaagaacgtgcagcatgtcccttcaataaagaagaatctagttagcggctctctactgtgtagagatggttttagacttgtgtttgaatccaataaatgtgtcgtatctaaatatggcacgtttattggaaaaggttatgacagcggaggcttgttccgctttatcttggatgatatgtgtaataaagttgtgaaccatgtaagcgatgatgatgatgagtccaatgtgtggcattcgcgactttgtcatgtgaactttggttgtatgacacgcttagccaacatgagtttaattccaaaattcactttagtcaaaggctctaagtgccatacttgtgttcaatcgaaacaacctcgcaagcctcacaaggcatctgaggtgaggaatttggtaccactagaacttgttcattccgatctgtgcgaaatgaacaacgtgttgactaagggggaaagaaatannnnnnnnnnnnnnnnnnnnnnnnnnnnnnnnnnnnnnnnnnnnnnnnnnnnnn

SEQ ID NO: 36314 - DNA, 1286 bp, Oryza sativa
ctagattctgctatgtgtacctattgaaaacaaaggacgaagcattacattactttaagatctataaggctgaggtagaaaaccaactagaaaggaaaatcaaacggttgaggtctggtaggggtggagagtatttttccaatgagtttacttctttatgcgaagagtatggaattattcatgagaggacgcctccctattcaccccagtcaaacggggtagccgaaaagaagaaccgcactctaactgaaatggtgaatgccatgttagacactgcaagactttccaaggaatggtggggtgaggcaatattgactgcgtgtcatgtcctgaatagaattcctactatgcataaagaactaacaccattcgaggaatgggaaaggaagaaattaaatctccctcacctgcgcacatggggctgtttggccaaggtaaatgtatctatagccaaaaagcgtaaacttggaccaaagaccgtagattgtgtgttccttggttatgctatccatagtgtgggatataggttcttaacagtaaattctggagtacccgacatgcgtgttggtataattactgagtccagagatgccacattttttgagaatgaatttcctatgaaaaatgcacctagcacttctagtcaagaacctattttatcccctgagcactttgtgccgatagaacacattgatcaaatgcttgaggaaaattctgaggaggataacattgtagcaactcaaaagagtaagagacaaaggactgcaaagtcttttggagatgactacgttgtatatcttgtggatgatactccaagaaccattgaagaggcatattcatctcctgacactgactattggaaggaagcggtatgaagtgagatggactcaattatgtctaatggtacttgggaagtcatcgagcattcatatcggtgcaagcctgtaggatgcaaatgagttttcaagaaaaagcttaggcctgatggtacaattgaaaagtacaaggcaaggcttgtggccaagggttgttgtcacaccctgaagttttcccccttttgcttgctttaaaaattggttaaataaattgcttgaagaaattatcttaattaacctagagctaaatccctagttaataaatgcacttaataatcggaaatagtgtggtggaatttttcttgagttccccatgctccaatgcattaacaggatttttagtggaattttcagagccttggaaataattttaaccaattaaaaatcactaaagtgccattttaaatccca

SEQ ID NO: 36315 - DNA, 8775 bp, Oryza sativa
  unsure (1)..(8775): unsure at all n locations
ccgccttcggccatgagccgccgccgctagagtcgccgccgcgccaaaccgccgccgccgttagcttcgccgccgcaagagctttcccggccgccgcctcgcgtcgccggaatcccactggagcgcctctcccctcgcgagccggtgagtttttccctcccctccatctccggccggcaattcaagctgccgtggtcgtcgtctcctctcctaacgcctctccatcttctcctagggtgtcgccgctgcccgtccgtgcctccgcgtcgccggtcatcgccgccgtcttcatccttcgcgccggccgccgtgctcacagtgaggagctcctctcctccctccttccctctgtcccgcacgcgctgccgctccctgcgctcgccatcgccttcgtccgccgccgccggtctgtgcgccgcccgccgccgcctcccacgccgctggttgccgtcaccggcgaccgcatgccgccgccgttcgccatgcttgccggccggcttgaagccgaggccgagcccggtggctgctcccttcaccgtccgatcggcttgggccgatccggacccttggtcccgtggaccggccgccttgagccgctgacatgcgggccccgcttgccggcgcccccttcctctcccctttaagccgctgacccgtgggccccacctgtcggcgccgccccccccttcgctgacgtcagccctgggctttattgcgcaataattaattaaggactttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtagatttcggccttttcgtcgatccgcggtctctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccctatgccattgataacttgggtatcaaaatgactagatgttggctaaggaaatgcttagccatgcttagttcaactagtacacaaatggggatcacattattacatagactttgtcttttggcatagctttagattggtgccaccgcaatggtattagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcggagggtcttgtcacgatttccccctttgcagtatcatggtgatacttcggggcatggcgacatgtgtggaaaagtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttcggcctgttgcaacgtggtgtagcgttggacagtgattggttaatattgattaattactacaactgttttactgccttcaactactacttttgaatgctagctttatgcaaaagaacctctagcctcctttggttatatcctgcatcatacctcctcttccggtatgacttgctgagtacagtgggtagtactcagtcttgctctcttttcccccacaccagagtagaagttcttctcaattggagccgtctcagagaggttggtttcgtcgctgccgtcaagggttgcctgtggaatggaatcgcccgctgcaggagtcaagtcttcaggcttagctcgcttttaccttttccgctgcatttgtaatcctttatgtttttgtaagacgtggatctgtatgtcaacaattgtcgtttgtgtaccctggctggtcctggataggggtttaatacacattcagcttagaaattctggttcgtgaatttctgggcgtgacagttgtacccaaaaagaaggcgaggactttttcgacacttattcaccggttgctcgcttgaccacgattcgagtactacttgctctggcagcctctcatggtctacttgtccatcagatgaatgttaagacagctttcctcaatggagagttggaggaggagatctatatggatcaaccagatgggtatgtactagaaggtcaggagggaatggtgtgcaagctgttgaagtccttgtatggtctcaaacaagcgcctaagcaatggcatgagaagtttgacaatacacttacatatgttggctttgttgtgaacgaagctgacaaatgtgtgtactatcgctatggtgggggagagggagtgatcttgtgtttatatgtcgatgacatattgatctttgggtccagccttaatgtgattgaggaggtcaaggactttctatccaaaagctttgaaatgaaggatttgggagtggctgatgttattcttcacattaaactactgagaggagatgagggtgggattacacttgtgcaatctcactatgtggacaaggtcctgagtcgctttggttatagtgactgcaaggcagctcctactccttttgatcctagtgtgctattaaggaaaaaccgaagaatagcaagggatcaattgagatactcccagattattggttcattgatgtacttagctagtgcaacgaggcctgcatctcatttgctgtgagcaagttgagccggtttgtttcaaatccgggagatgatcattggcatgctcttgaaagagtaatgtgctatctaaaagggacaatgagctttggagttcactacgctgggtacccaaaagtactggagggctatagtaattcaaactggatatctgatgctgattagataaaggccacaagtgggtatgtgttcacacttggaaggggcgccgtttcctggaagtcttgcaagcagaccatcttaacgaggtcaacaatggaagcagaactcgcatctttagatactgccacagttgaggccaaatggcttcgtgagctcctgatggacttgccggtggttgaaaaactagtaccagcaatcctgatgaactgtgataatcaaacagtgattattaaagtgaacagttcaaaggacaacatgaagtcatccaggcatgttaaaagaagactgaagtctgtcagaaagcagaaaaactccggagtgatagcattggactatgtccagatggctaaaaatttggcagatcagtttaccaaggggctaccacgtaatgtgatagactgtgcatcgagggagataggcttaagacccacttagagttgcacaatggtggaaacctgtccattgtgattggagatcccgtgaatttggatggcgaaacaaactattgggtaactgagagaagagacccaaaaatgagcttatcttcatgatgcacttctcttctaatctgtatggtaggatggtatacaccttaatgtgatccgagtggcttttcataaagcagagatgttggcctacagaacatcttagaaggaacacgcctatatgactccgactgctagtcacagtctatgagatctgggtgatctctagatactcatgaaaaggccaggagtatgacttatacgctccaaacagaggggatgcaaacgacagcccaataccagttaagggtttgagtgaaacctgaatcgcacaaaactgacaattacaaggcataatccattgttcagttatgatctggtgtaactcttttcctaggtggaagttcaacctaacagtctccatcaaaacactggtataactaacaggttcagttttgagaacatttcttgtgagccatgaaatttggtggggattgttgaaataaatgggctaggcctaatttaatttaattaaaatctcaagagcccacaagtaatgttagagagaataatactaccttgaaaaattaggtggaagaacctcaacttaaatagggtgatattggagattccctgttgaccggttgaggtgatggttggactgccacacgcatgcgcacgcgctgagtcggcctcggccatggacgtagcgaggcgaggcggccgaccgagccgagcctgcctgctgctcttccgtttccgttttgtaacaaacgagaatgaagtcaccattaaaaaatgaaattcacaacaaatgagagattcattgtgttgtaacctccacaacaaatgagagattgattgtgttgtaacatccacaacaaattagatttatttttgcggtaatggagatctctctctatatataacgcaaggcagaggctctcaaagtgtgtgtcttcctcctgtattgttccttagcgatactctcgttctgttcctgcgctgtctctttgtttccccggttctgttcatcccgtgcgcacgggtgatcggaatgagcaggtgcctccgaaactccgtccgcttgagaacctgcacgggtaagtgggcgatcaagtttttgggtagcgcttcaagcgcgactgctctgcatcatcttcactaacatgttgacaaccggcgacaacaacaacactagagacaaggagaaggagcttcccgtcaacaccaacggaggcaatactgtctcaaactccagcggagggccattctcagggtataacgtttcactcttaccgttcgttctttgtttcctacaactgtcggtcgcaatattattgtgttctcttgtctatgctgatgcttattctatattaaggatactcaagttgtatacatgtagcactgtcactatatctactaatattgcaaatgttatatttattgtcttaatattttggattaaaatatgccaaattatgactaaatttccaacaccaccgtcatttaggaaacttcaattctcgagttgtggagctaggttgagggtatttgattatttaatctttatagggttctgtagcgtgcactcagcccttaggacttaacatgacagtacatgagcaaatgggaaagcagtgaatttttgcatcaggctggctcaactaaatgattgttatgtccatttggttattaaaatagaattttctgttgtataccacctcacatgctattaagatacattttgatttacatagcaattatgtttctatgtaaagatactaaatatatatttggtcattttggtaactgttagtatctcaagcagtaccacccccattcacttcccacagataatcactctccactgtgtactccatttccttctttttgatctgctctgctcgcttaacttgcatggcatgttggctaacccagaattggcaactggaggggggcagttgctgttcagtggctgacttggctgaccgtaggtacacgtatctatagtcaactaataaacggtatacatctcttcatgctaaatgtatatccttttcatgacagaatttattcaagaacgaaatgaaatctgcctatagtcagtagcaactaaatttacatttttagcatgtaattaataatgtattgtttacaggattcgctcgaatgctactctcaagttgtgggcattcgctacaatgccattttcgctgtctgttgcatttgcaaaatactatttttcatctaaataattatttcttggccctttttgcccctcactgccatctctctctctaaaccacgcactcacaactgagaccgagccgagtgagaggataaaagggcaaagggaggggcaaccatgctggcgccgccgccttcccctaccatccacgacattgagggcggttagaatgaggagcaggcagcagcagttgcgatggcgcggctcggtgtggggaggcggcgcaaccgggaaggcggcggagcaggtggtgggcggccccggcgaggttggggaagaagaagcggcatggatggtgggttaaggcgacaccacggatggcgagaaaggcggcgcgaatagcgggggcaggtggcgcggtcaggaaggtggcggagtaggtggtgggcggcgccggcgaagttgaggaagaagaagcgacacggatggtgggggaaggcggcgacgcagatggcgggggaggtggcagcaccagtgtggtcgcctctcccttcgctaggggtgcaagtgggcctgtctgccacatcctgattttcactttaggattcataaattatttaataaattatttttagaatttatattaaatgttcattaatttacaagtaaagttaaatgtgggaaataaaatttcctaaatataaagtatggctggatttaatttttattaagttcgcattatactctctggaattttctttgattttttcggagctcaattcttaattttaataatacaaacaacatttaagtaattattcacatattaaattaatcattaaatggtctgattttaattttgttaaatacttatagtgttcaagtactttcaggattttttttgaaattatttgagcaatagaagtatttttaacaattcaaggatcatttcagtgattaatttaattggaaaagtaattaaaatccccttttccttttcgggccgaaactggaaaggttcacctttagttctcggcccattctccctccctttcggctggccttatccctcctccgaagtccatttcaggtccctccttcaatccggcctagtagaggatgctctcggagaaagtctgctttacgtccctcgctactgttcatcttcaacctcaggacagccgaactgagaccgagttggctcggtttttctcctccgaatccggccttatctctcgtgttttccgaaaattagttgaggggacttgtttccttatcctcctctatctctttccccaaaaatccggttttatccctttgaattcgacgcgaatttggattcgttttcgagtttatctctccaccaaaccctaggttttcccgacgcgattccttgcgttccaagcccgatatctctctcccgtggctataaatagaacccccaagctctcctctttcgtttccaacccctagctcgagctcccgtgccctagccgtctctccctgcgagtccctctctctccagcgccgccaccatctccagcagcgccgcgccgcctctctggtcaacgccgccttgagccgtcgcctccctcggcttcgcaagggtcagctctaccccggccaccggttcttttgcgccaaatcccgccgggagattgccgtcaccgtgaaccagtgggttgccgccttgttttgatctccggcgaagcctcctcatcgaccccaaggtcgccggacctcgccgcagcctccctcggcatcgcagctgcgaggagaaccccgtccacccctcggttgtcgtctcccgtcgctgaaactccgccgccaccatcgatcggtaccccgtcgtcactcccgatctcatcgccagccgtttttcatcgtcgtgccgcccctcagtgagttcccctcgtcgtgctctttcttctggtgcctcggcttggccgcctaaaccctccatcgccggcaatgatgtcgtcatgacattgttaatcctgttctgtataaggctaaaatcatatttatcttgtaaaattgataactaattcatatgaagtcggaattaagtggttcaagtctctaaattcatctaaaatcatgatctacatgtttgtctactttttatgtactgtttatttggtttttattagtctttttcttcgtttttcgtgttagcttgttgtttccgtcgttgcgaaggttcgtgagtgcgtcggaagtgttcaagaagattaattgaagaccgattattgcaaggcaagtcacacagatctcaaacaaccctttgagcatgttgaacctatctaaagctattgttttatttcaacttatgcattattttcgaatgtcatcgggtggtgagccattcccaattaattatggccgaagatgactttattttcctatgggtaataaattgattagcttggactttatatattggattggttcagctaaatgctatatatataattgcttagccataaatgagatgaatcacactacattgttacttatggttatatttaatggtagctcacgatggttaattgtgttatgataattaattgataattaaaacttgataatggtgggttgtgagcacatggttttgaaggtcgtgctcatgacaattaaggaacggttcacgagctattgttgtgaaatatttaccgtgccaagcacaagccagcgtgggcaacggatttacctttcgtatagcatggttcattgcggggcaccagactgagaagcggcgagaagtccatgagggtcgctggggagtccatgcctctggttgtagagggggtgattatgatccaggaatggtgcactgtggtgagttnnnnnnnnnnnnnnnnnnnnnnnnnnnnnnnnnnnn

SEQ ID NO: 36316 - DNA, 1247 bp, Oryza sativa
ctatattatgccatcttttggtatccttgtgcacttgcatatttgctgtgtggcttgcagagtatgtcatatgctcaccttgcaataatcaatcaacctcagttgaagaaaaggatccagaagaagacgtttggcttataccccagttgagctgcctgtgggagtggagctgaagccatcgctagaccgttattccgctgctgattttcttttgttttgtaagtatgtaacgttattattatgatggatttctatattaaattgtcagtttgtgtacctcggctgattcctggacgaggattctatacacaaattagttcggaaattactagtgaatttctaggcgtgacattgtccacgaacccgcttataggcaaaattagtacgtaacctgcaggtttgaccaacgggttacctatcaatttgatctataaatgagttttcatatctatgatgcggtaaactggaccgacgcgaaaacccataaaatatgatttatttgacctataagtgaactcgcgggtcggcccgcttgcatccctaccctggcggggaagaagatgccagtaagcttcatttagttccttttttattcaacttcttttcaaatggatcttcagtaacatatcatatgatcatttgttttgaatggttcctctcttttttgacatgaagttgaaactttgaaaacaccctatggaaaaaggtaagattctgatctacagagggaactcaattgcaagctgatagaatgtacttacgaactgtgttctcttgtatattcatacgtagttgtagcatatatttttcgcttatgaattctattggacttggtaggccagactagagtatctgtgaggtgtcttgatttactcttttgttttgcacccgtgctagcaacctttcattatcaaaactgagatgtgccatctatagaacatcagaactatgttacacattttctagctatgaatatactaaaatgttctaccagccaattattttcttttttttcattcataagccttattttgtttctgtttatccataagttctgtagaaattggcaatatatatttttaaaccatacattgtacaagttctgacctacatttatgtgtagtaaaaattaattgatgtcatgtggcaccatctctacaatgttggatccgccctcatggtttcttatgagtttgatctcctcaataatatgaaaggagcgtggtactcacgtgttcgaaggaact

SEQ ID NO: 36317 - DNA, 641 bp, Oryza sativa
agcgtgtcgagtggtaacgatttatgatctaatacttgcatggtttctggtttacgcggtagaaaattttgatttatgctatcgtagcctacgcgtattccatcaggttgtgcatcactgcctactccgctgatagctgctccacttccacgaccgtctctgaaccaacgcagctccacgccctcggctaatcatctggaacatctgcctgaaagcaaggtaatccctgtagatattgcgatctactaagacataagtgctaagcctaacatgatcaccctaatgcggaatttaggattactgaccgttgtttgaagccattgcaattgttctcgcttggtccggagtggatgtagaggatgcagaacctcgaaccacctcgcgaattgtcggtgtaggagaagtggtcgtagcagtgagtacaccggcttaatcccgaagaggtcgccggtgatcacctgcggggtggcggcggccttccggtcggcctaacatgatcaccctaatgcagaatttaggattactgaccgttgtttgaagccattgcaattgttctcgcttagtctggagtggatgtagagatgcagaacctcgaaccacctcgcgaattgtcggtgtaggagaagtggtcgtagtagtga

SEQ ID NO: 36318 - DNA, 1540 bp, Oryza sativa
tacacattttctagctatgaatatactaaaatgttctaccagccaattattttcttttttttcattcataagccttattttgtttctgtttatccataagttctgtagaaattggcaatatatatttttaaaccatacattgtacaagttctgacctacatttatgtgtagtaaaaattaattgatgtcatgtggcaccatctctacaatgttggatccgccctcatggtttcttatgagtttgatctcctcaataatatgaaaggagcgtggtactcacgtgttcgaaggaactgcatatacaaatgaaagtacgcgttgatgcgtcctggaggaatggtggtcttgcataccgctggattaggaggtcaaataataggtggcatgagttaaagttagatcattttcggctatttattctactccttccgttccacaatgtaagtcattctagcattaacattaatataaatgtgagaaatgctagaatgacttacattgtgaaacggaggaagtagatgacaagcctttactgcgactagattggtttttatggttcatgttatattaaggtttttgttacaacaaatttaggctcaatgattatttaacagcattttacgcattttacgcaatgtaatttaatatgtctgtttatttttttcccgttgcaatgcacgggcacccaactagtagagataccaaattaataatgtgaacacatgttggggaacatgttgttggatagacccaacatgagacaccgcaagagccatatgtgttgtgtcatcagtgatctcatttagtgttggtgttgaatccttagacctgagattatcatggttcccaacatgtgtagtagcttacttagagactgataaacgctactccgtaattgggtagttataaaagtagtttccgggtatgctgtgaaacatgtagtgtgatatgaataatcaagatgggatttgcccctcctatggagagatatctctgggcccctcgatgttgtagattatggaaatgcatggccatgccaaaggtgattgatgagtcaatcacaagttatataatctatcacaggttcgagtgaatgattgagcgattagaggatagcacatatctagccttgagcttaatcgatatcgtgaggcaaagtggatcatacaagtatacactagaggttcagccaatatgatctttatgtatgcccggtaggtcaatacgttctgctagggaccgctattgtcacgtggaccgaaaggagttttcgggttacagccgagtgtacatgaatctacagggtcgcacgcttaatgggccggaataaggggattggatggagatccaatatgagtttaattcggatagggattcaaataggagtcctatgggccttggaggcccgaatcatggatcctatatattcgtgaggggtgtgatcggcggaggtattgcatcatgtgagaaactctagccgccactcccctccccgagcaaaaccctagccgcgagcgggtgctagcacatctgcgcgtgg

SEQ ID NO: 36319 - DNA, 720 bp, Oryza sativa
  unsure (1)..(720): unsure at all n locations
nnnnnnnnnnnnnnnnnnnnnnnnnnnnnnnnnnnnnnnnnnnnnnnnnnnnnnntaagaggcaaaccctacattgattttgcgtatgttgcgtgaaggcgacggctcggtttatatagagataggtcgcttgatcagggcgcccgcacgatctctactccgtgtaaccgaaccggataagtcgcgcgtaacttatccggactccacgctgttttcacgcaccggatttttcggaatgtttctaaaacaaaaacaaatccaaatttcccgcagcaaaacaaaactgcaaaaggaggctacatctgcgcaagagtgaggagctaattttgcggaccattcgacgcgtaacaacgtgcacgcgcgccgcctgcttggccaggtgagcgtgcgcgtgtgttccccctcttctctccaccacacatgcttcaagtggctaggagggcatcctcccttttaagaaggtccccctctcctagaataagcaaggtggtactaaactccacatgcatgccatcccatgaggtgggcttttgtgatttttcaaagaattaatcttcgaatgggccttagcccatctattaattccaacattgctttggtccgataagtatgtggccctaaaattttgagttatcaatatacaaaatgcattaccgatgatgtagaacagggttaggtgctgcagctatcaagacagaaactgttccatttagcattcta

SEQ ID NO: 36320 - DNA, 617 bp, Oryza sativa
ggattttgggttacctctcgggtattttaataagttccataacccatccttgtatggaaacataattctcctcacttttagtctagatttcctcccaacatcaaggtttatcacttgctgacggagcatgggggtcctcaccggaagcccgcgcaggcccccctttgccggttcggccgggggcgctaagtaaggttcttcgccctcgatctgaggaacgtccgcgagagagtaagtgcacaagacacggccgacgtagacaggttcggtccgctggaaagcgtaacaccctactcctgtgttctggtggatctgtgcgtgaaggaatacagagagctggagagcgagccagagttcagggtctagcacccattccccttttttctcctccctccagagtcccctttctttttttcttttctcttttctctccagagtccccccctcttaggcctgggcaccattaaagtttctcctgtgcaacctatgagtaggcaatggttacaaagtataaagttccctgctccagttgatctgttctgtctctcaattgcctaaggtggtgagaagcgggtgttctacaatttttaggcgtaagggtaagcctccgtggggta

SEQ ID NO: 36321 - DNA, 695 bp, Oryza sativa
  unsure (1)..(695): unsure at all n locations
taannnnnnnnnnnnnnnnnnnnnnnnnnnnnnnnnnnnnnnnnnnnnnnnnnnnnnnnnttcagtgcatcccacaactccttagcgtcagtcaaatgcatatacacctcgaccagacgatcgccaagaacgctaagaatgcatcccacaaagagagtagtggcttcctcgaattgcttctgctgatcagcagtaagaactccttcaggtttgccagtactcacccagaagcatttcatagctgtcaaccacagagtgaccctgatctgccatctcttaaagtgcacaccggtgaatttatccggcctcagtgcatcggcaaaaccagccatagtaaaatcacagcgcctataataaggtttttggattgtagaaattataagcacataatgatttaatttattccataaataaatcatgacattgcagatgtaaactagcatgaacacatcattagatctacacatgtaaactaagcagtaaaacatgaacggatcaaatatgcacaacatgtcgaacacgtaccgaggtggcggaaaaaccggttgctcggcaggtactactcgcggttgcgggcgttgacgaaggcgcgcagcacgcgagcagagaggaaggcgagccgtagcgaacgaacagggagcagtcgcgcgaagcgcttccaaaaaccttattgccgcttttcccgtgcaagacat

SEQ ID NO: 36322 - DNA, 679 bp, Oryza sativa
  unsure (1)..(679): unsure at all n locations
caggcctcggggcccaaggggagcgctcccagctcccctagattgattgcttggatcactgagatccaggcgtacctcgcagataagactctaccccaggaccgcgaagagagtgaacgcgtccggcgcatctccaagcgttacgtgctggtggaagggaccctctatcggcgcgcggctaacggagtcctcttgaagtgcattcctcgggaacaaggcgtcgagcttctcgccgatgtccatgaaggcgagtgtggagcccactccgcctcacgcaccttggttggcaaggcctttcgccagggtttctattggccgacggctctcaacgatgcggtcgacctgatccggcggtgcagggcgtgccagttccacgccaggcaaacccatcggccggcccaggccctgcagaccatacctctttcgtggccgtttgctgtctgggggctcgatatcctgggtccgttcaggcgggccccgggcgggttcgagtatttgtatgtcgctgtcgacaagttcactaagtggcccgaggcttatccggtcatcaagatcgataagcactccgcgcttaaattcatcaggggcatcactgttcggtttggggtgcccaaccgtannnnnnnnnnnnnnnnnnnnnnnnnnnnnnnnnnnnnnnnnnnnnnnnnnnnnnnnnnnn

SEQ ID NO: 36323 - DNA, 408 bp, Oryza sativa
gcatgagcggcgacgtgggcgacgtggcctaagaaacgtgggagcgaggggtggcggcggttgcgggatgcggcggcgcggctggaggtgggagacgggcccgacaggtgggccccacctgtcggtgaccccgggaaagaggaggggctcgggcggccggctcagctgggtcgtggccttcggtcggcccagcggggagggggaggaggaagagaatgggccggcggcccattcgaaaaagaataaggggaaaaagaaaaagaaaaaggaggaaatgaattttcttgggattaaatattgcttgtgctcatttttgattggttaaaattatttctagagctatgaaaattccactaaaaatcttgttagcacatttcgacatgtagagctcaagaaaaattccacatg

SEQ ID NO: 36324 - DNA, 513 bp, Oryza sativa
  unsure (1)..(513): unsure at all n locations
nnnnnnnnnnnnnnnnnnnnnnnnnnnnnnnnnnnnnnnnnnnnnnnnnnnnnnnnnngctggcacaaatccttccaagagtggaccgacgcgggtggcaagttcattagccaaccccacgcctgacccttcagggccatggggaagaaattcgccatgaccctgtcgtcacccccggcggcctcgatcccggtcgtgtagatctggagaaactcggcggggttgacgcttccgtcgtatttttcggtgatggtggggccggaaccttggggccaacggacgttccgaaggctcgccacaaaggctcgacagccggcaccgccaaccggggacacggggggccggcccccgtgcccggaccgaagtggcgctccggacgaggaagcgccctccgttgcgtgggcggcgcgcgtcgcgccgacgctcgatatcgaggcgggcatccggccccccacgcacatcttcttgggtcggaggcgttgacgaggggggtaccgagctcgaattcgccta

SEQ ID NO: 36325 - DNA, 542 bp, Oryza sativa
  unsure (1)..(542): unsure at all n locations
gaattcgagctcggtacccgcatttccgacaattcgcattgtataaccgtcatacctacccctaaatagggtcgccaatgatcgccttggtcaattggaggctgctcaaattgacaccaactccaagttttcctcctcattggagaggtcccttgtggctgtgaacacttctcttgcaggtatcttgaatacattggagagaatgagcaaagatggtcatgatggatcggctaggcgcaaccacaatggccatgatgctaatagcagcatcgcagcaagggaagaactagagtacgctgctgacaccgagcatgatgaggaggtacttggtcgtcaacgaagacaacagtgccggtagcgccatggcatgggcgctccaccacggcgggaggcacgtgataatgatgattctttaggcaagatcaagtttaccattccttgctttgatggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36326 - DNA, 492 bp, Oryza sativa
ctcgaatttctttgggtagccagataggaagcaatgttgaggcctatgttgatgacttggttgtgaagacgcgcaaccaagagaccttactctcggatctagcggaaactttcggaagtctccgctccacccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcgctacccctatttaagctcctcaaacgctccgggccgtttacctggacggaggaggctgagcaggccttcactcagttgaaggcgtacctcagttctcccccagtcctggtcgccccggagccagatgagccgttgctactctacctgg

SEQ ID NO: 36327 - DNA, 635 bp, Oryza sativa
  unsure (1)..(635): unsure at all n locations
nnnnnnnnnnnnnnnnnnnnnnnnnnnnnnnnnnnnnnnaattcctcttcatacattagtattagtggtataatgctaagtgtagtagtatagaatagtgttcggagtcctcggagtcttcggaagagttttcggtatggctctagcagctcttgtaatctcttctgtaatactttccgtattaatgaaatactcttctttatatatcttcggtgctttgcttagtcttagtactggtcttactttatatctgcattatatgaattgtgtgggtagcctaccagagaggtgtaatggtgcgagtttaatgtctaatttatcagttgctctatgtcgggtgcacggctatagagtagtatttagtaatgttagcatggtgcttagattattaaatatcattaattgggcatatatgttgcaggacattagaggtgggccgctgatggtgatagctcagtatgggtatttctccacgttagtatatattcctaagacaaattcgaagggagggtactcctctatatgtagccccggttggacggccatgacaggttgtcgtaagtatctcgccaacccagggtggtctctcgaagtaccaggaggacactgttagggggtattggccacatgattgt

SEQ ID NO: 36328 - DNA, 497 bp, Oryza sativa
  unsure (1)..(497): unsure at all n locations
ccgggttcccaattcttcttgtaatttctgccagaactttgaagtgaattggcttcctcgatcatacacgatcttattaggtacaccatgtaaacacataattcttgccagatagagttttgctaatttcttccctgagtaggtagtgtgcaccggaatgaagtgagccactttggtgagtcggtcaacgactacccaaatagaatcatgccccgataccgcgtgggcaaaccggtgatgaaatccattccgatttcttcccacttccattctggaatctgaagtgtctgtagcaaacctgctggcctttggtgttctgcctttactcgttgacagacgtcacagagtgctacgaattcagctatttcccttctcatgctgacccaccagaacttttctttgaggtcttggtacattttggtactgccgggatgaatgcaatactgagtttgatgagcctnnnnnnnnnnnnnnnnnnnnnnnnnnnnnnnnnnnnn

SEQ ID NO: 36329 - DNA, 514 bp, Oryza sativa
tgaatggctcaattcggagttcgaatgaatagatatgaattttagaaggttttgagccattaaattaatatctataattattaccaaattattgcgcaattattaaatattttcacaaaggaaaaggactgccgctgacgttagcaagagagggggccggcgccgacaggcgggtcccaggcatcattggctcaagggggctcggtccaccatggaccgggaccacaagggcggtccaccgcccgtccacgggatggacggcccagatcggcccaagccgatcgggcggctgatgagagcggtggccgggcacgggcacagccggggctggcccgaccgaccacagagggcgggggcgcgcagtcaccagcaacggaggggggcgggcggcacagggagcagcggcgcgcagcgcgggaagcggcgagaggaaacggaggcagtgaggaaaaggaaggtggcggagctcaccgaggggcacggcgacggcgagagcagcccgcggagggaggcg

SEQ ID NO: 36330 - DNA, 680 bp, Oryza sativa
tacgtagttgtagcatatatttttcgcttatgaattctattggacttggtaggccagactagagtatctgtgaggtgtcttgatttactcttttgttttgcacccgtgctagcaacctttcattatcaaaactgagatgtgccatctatagaacatcagaactatgttacacattttctagctatgaatatactaaaatgttctaccagccaattattttcttttttttcattcataagccttattttgtttctgtttatccataagttctgtagaaattggcaatatatatttttaaaccatacattgtacaagttctgacctacatttatgtgtagtaaaaattaattgatgtcatgtggcaccatctctacaatgttggatccgccctcatggtttcttatgagtttgatctcctcaataatatgaaaggagcgtggtactcacgtgttcgaaggaactgcatatacaaatgaaagtacgcgttgatgcgtcctggaggaatggtggtcttgcataccgctggattaggaggtcaaataataggtggcatgagttaaagttagatcattttcggctatttattctactccttccgttccacaatgtaagtcattacagcattaacattaatattaatgtgagaaatggtagaattacttacattgtgaaacggagga

SEQ ID NO: 36331 - DNA, 17579 bp, Oryza sativa
gctggtcaacgggtggaaaacaggatcgcgtgattttctctcggtttccttagccgagagattatttcccaacaatcccttgatatcatcttgtcacatacaactatatatgtaaaaatgaaaattggatggtttgcattaggtcctttgaataaaccatgtttcttgttaggtcctgtagcataagttgtactttaattgtacttcaattgatctctgtgttgtgctttaattgtactttttattggaaagaacatgctaccacaatttttagtagatctaaaattttgagcattgtcaaatcgtgctacagatattggccttcatagactgttggcgctagatgtctgtgactttgatcaaacagagctcttgtttccaatgttactgatggcaaaattttattttattttattttttccttggcaggaactttgcaaaccattttcaagtttcagaagcttctgaagatatcattgtgtgggaatagtaatgttgcacagatcgacacctgttcactcttatcatctgaattaagatttggtactactctaatcccatgataaatacttatatgcaatactcaacctaaggttcttccagctgagagcgttatactgaaaattatgatcagactaaccctgaaaaaattaatgaaattttacctgttgtggtgtttctgggagctggttccatttgctcgtacgcttgtggcctccggtggcagcgcggttcaggtgttcagctacgcgtggctatgttgagttagtacggtgcgatatcaaccagtgcctttgatctgtcgcattttgatcagtgatgctcatttagtgagttcttacctgtgctagattgctagaatgctaaatggtacagtttctgtcttgatagctgcagcacctaaacctgttctacatcatcggtaatgcattttgtatattgataactcaaaattttaaggccacatacttatcggaccaaagcaatgttggaattaatagatgggctaaggcccattcgaagattaattctttgaaaaatcacaaaagcccacctcatgggatggcatgcatgtggagtttagtaccaccttgcttattctaggagagggggaccttcttaaaagggaggatgccctcctagccacttgaagcatgtgtggtggagagaagagggggaacacacgcgcacgctcacctggccaagcaggcggcgcgcgtgcacgttgttacgcgtcgaatggtccgcaaaattagctcctcactcttgcgcagatgtagcctccttttgcagttttgttttgctgcgggaaatttggatttgtttttgttttagaaacattccgaaaaatccggtgcgtgaaaacagcgtggagtccggataagttacgcgcgacttatccggttcggttacacggagtagagatcgtgcgggcgccctgatcaagcgacctatctctatataaaccgagccgtcgccttcacgcaacatacgcaaaatcaatctagggtttgcctcctactctgtgctacgccgtcgctcgtagacaactccatcccgctcgccggcgtgcaccggcgatcaggagagcaggtctccggaacctctaccttcgatgtcctgcacggggagaaggcggcaataaggtttttgggaagcgcttcgcgcgactgctccctgttcgttcgctacggctcgccttcctctctgctcgcgtgctgcgcgccttcgtcaacgcccgcaaccgcgagtagtacctgccgagcaaccggtttttccgccacctcggtacgtgttcgacatgttgtgcatatttgatccgttcatgttttactgcttagtttacatgtgtagatctaatgatgtgttcatgctagtttacatctgcaatgtcatgatttatttatggaataaattaaatcattatgtgcttataatttctacaatccaaaaaccttattataggcgctgtgattttactatggctggttttgccgatgcactgaggccggataaattcaccggtgtgcactttaagagatggcagatcagggtcactctgtggttgacagctatgaaatgcttctgggtgagtactggcaaacctgaaggagttcttactgctgatcagcagaagcaattcgaggaagccactactctctttgtgggatgcattcttagcgttcttggcgatcgtctggtcgaggtgtatatgcatttgactgacgctaaggagttgtgggatgcactgaatactaaattcggtgctactgatgctggcaatgatctgtatatcatggagcagtttcaagactacaagatggctgacaaccgttctgtagtcgaacaggctcatgagatacaaaccatggctaaggaactcgaactccttaagtgtgtcttacccgacaaatttgtggccaggtgcattattgcgaaactacctccatcttggagaagtttcggtactgcactcaatcacaagagacaggaatactccgttgaggggttgatagcgtctcttgatgttgaggagaaagctcgggaaaaagatgctgcgtctaagggcgatggtgggcagtccagtgccaatgttgtgcacaaggcccagaacaagagcaaggggaaatacaaagctcaatagaccaccaacttcaagaagcagaagaagaacaataacaatcctaatcaggatgagaggacttgctttgtgtgtggccaacctggtcatctggctaggaagtgtccacaacgcaaggggatgaaggcacctgtagggcagacttctaagtctgctaatgtgaccattggcaacactggagatggaagcgggtatggtaatttacctactattttttcagttaattagtctactaattggtgggtttatactggggccaatgtacatgtttgtgctgacatctcattgttttcttcttatcaggtcgcacgaggttccaccgtggatggggaatgagtcatatgcaggtgtgcatggtattggcacggtagatctgaagtttacttcaggaaagatcgtctagctgaagaacatgcagcatgtctcttctatagataggaatcttgttagtggctcccgtctaactagagacggatttaagttggtttttgagtctaataaagtagtcgtgtctaaacatggatattttattggtaaaggttatgagtgcggaggcctgttccgcttttccctttctgatttctgcaataagtctgtaaaccatatttgtggcagtgtggatgatgaggctaatgtttggcactcacgtttatgtcatattaattttggcttgatgtctcggctttccagcatgtgtttaattcctaagttttccattgtcaaaggttctaagtgccatagttgtgtgcaattgaagcaacctcgcaagcctcataaggctgccgaggagagaaacttggcaccactagaactcctacattcagatctttgtgaaatgaatggggtgttgacgaagggtggaaaacgatatttcatgacgttgattgatgatgctactagattttgctatgtgtacttgttgaaaacgaaagacaaggctctagactattttaaaatttataaggcagaagttgaaaattaacttgatagaaagataaaaacacttaggtctgatcatggtggagagtatttctcaaacgagtttgacttattctatgaggaacatggcattatacatgagaggacgcctccatattctcccgagtctaatgggattgctgaaaggaagaaccgcacactgactgacttggtgaatgccatgttggacatcgcggagctacctaaggcatggtggggggaggcattgttgacctcgaatcatgtgttaaacagagttcctaatagaaataaggacaaaacaccatatgagatatggattgggagaaaaccatcactttcttatttgcgcacatgggggtgcttggcgaaagtcaatgtaccaataacgaagaagcgcaaactgggacctgagattatggactgtgtctttctgggatatgctcatcacagcattgcctatagatttttaatagttaaatctgatgtacctgacatgcatgttggtacaattatgtagtctcgtgatgctaccttctttgagagctttttcccaatgaaggatacacatagtagttcgagccaaccctctgaaataattcccagttcgatcacaccaccagaacaaactaaacatacacacgaacatgtcactaaggaggatgtcagtgaagctcctcgaaggagtaagagacaaaggacggctaagtcctttggtgatgatttcactgtgtaccacgtggatgacactcctaagtcaatttcagaagcatatgcatctcctgatgtagactactggaaggaggctgtccgtagtgaaatggattccattatcgctaacgggacttgggaggtgacagagtggccctatgggtgtaaacctgtagggtgcaagtgggtgttcaaaaagaagctcaggcctgacggtactattgaaaagtataaggctcggcttgttgctaagggctatactcagaaagaaggcgaagatttctttgacacttactcatctgttgctagattgaccacaattcgtgtgctaccttccctagcagcctcacatggtcttctcgttcatcaaatggacgttaagacagattttcttaatggagagctggatgaggagatctatatggatcaacctgatgggtttgtagttgaaggtcaagaaggcaaagtgtacaaattattgaagtctttgtatggtctgaaacaagctccaaagcaatggcatgagaaatttgacaaaacattgacatctgcaggctttgcagtcaatgaggcagataaatgtgtgtaccatcaccatggtgggggtgagggagttattctgtgcttgtatgttgattacatactgatatttgggacaaaccttgaggtgataaatgaggttaaatcattcttgtctcaaaattttgatatgaaggatttggaagtagctgatgttatcttaaacattaagctaattagaggtgagaatgggattacactcttgtagtcccattatgtggagaagatcttgaatcgctttggctacattgatagtaagccttctccaacaccttatgatcctagcttgttgcttcgcaagaacaaaagaattgctaggaattaactggaatactcccaaatcattggctcgctgatgtacctggctagtgcaactaggcctgatatctcctttgctgtgagcaagttgagccggtttacctctaatccgggagatgatcactagcgtgcgcttgagcgagtaatgtgctatctgaaaggtactatagaattggggcttcactatactgggtatcctgcggtactggagggttatagtgattctaactggatctctgatgtggatgagatcaaagccactagtggatatgtcttcacactgggtggtggtgctgtttcgtggaggtcttgcaaacagatcattttgacgaggtcaaccatgaaagcagaactgacggcactggatactgctactgttgaggcagaatggctgcgtgatctactaatggatctgcctattgttgaaaaaccggtgccggctatccttatgaactatgacaatcaaacggtaattgtaaaagtgaatagttctaatgataatatgaaatcgtctagacatgtgaaaagacgattgaagtctgttaggaaattgagaaactccggggttataatgttagattacatccaaactgctagaaacctggcagatcccttcacgaagggactatcacgaaatgtgatagacaatgcatcgaaggagatgggtttgagacccatgtgagttatacaatggtggtaacccagtctatgtgatcggagatcccgtgaattagaacctgggaagaacaaaccattagtaaactagaggagagtaccaatctataccctctctaagtgaagatgcatgtactctcgtgagctgcaaggtaggttggttatggcttaatgagttctgttggctttaattagcgaagatgttatcctgcagagcattcttgaaagaactcacctttgtaagcttgactattgatcgcagtctatggagattttgggtgaatcttctaggaagcttactaaagacctaggagtatgacttatacgctccacccgaggggtagtctacagacggtatagtactagataagactctgagtgaaacttgcttgcacgagacttgcaattcaaggcgtagtccattgttcaagttgtgagtaagtgtagtttggagttctaggtggatgttcaaccttaatcggtctccatcgaaccgctggtatataaacagtacatttgaaaaggcaaatctcagtgggattttgagatttggtgggggattgttggaattaatagatgggctaagacccattcgaagattaattatttggaaaatcacaaaagcccacctcatgggatggcatgcatgtggagtttacgaccaccttgcttattctaggagaggaggacctccttaaaagggaggatgccctcctagccacttgaaacatgtgtggtggagagaagagggggaacacacgcgctcgcctcgcctcgcctggcagggaagggcaggcgcgtcgtgctcctcatccttgcgcagatgcagcctccttttgcagttttgttttgctgcggaaaattcggatttgtttttgttttggaaacattccgaaaaatccggtgcgtgaaaacggcgtgaagtccggataagttacgcgcgacttatccggttcggttacacggagtagagatcgtgcgggcgccctgatcaagcgacctatctctatataaaccgagccgccgccttcacgtaacatacgcgaaatcaatctaggatttgcctcctactctgtgctgcgccgtcgctcgtagactactccatcccgctcgccggcgtgcaccagcgatcgggagagcaggtctccggaacctctgccttcgacgtcctgcaccgggagaaggcggcaataaagtttttgggaagcgcttcgtgcgactgctccctgttcgttcgctacggctcgccttcctctccgctcgcgtgctgcgcgccttcgtcgactcccgcaaccgcgagtagttcctgctgagcaaccagtctttccaccacctcggtacgtgttcgatatgttgcgcatatttgatctgttcatgttttactgcttagtttacatgtgtagatctaatgatgcgttcatgctagtttacatctgcaatatcatgatttatttatggaataaattaaatcattatgtgcttataatttcaacaagcaaatgtacatgatacagagagaccatttctgaatttaacaaatttagaaaccaatgtagccatggtccagaagaagtcaaagaaccaatctgactgtatggaggtgtagatgggatcgtgtttgctgcaccaatttctggggaggcatgcgaaggaatgaaagggtgcaaaatggaaaatagcaagaggtggttaaacaccatcatcatgttgccgtaagtatgtaattaggatgctaagcataatttagcaaccgacaactgcatgttttcttagggatttctactactctcgagggatctgtctaagcatttaatggctgaggggtttggctaccatacaggtagcctagcaattaaattgggttagtggagtgtatttggatttttcattgtgctctgatttaatctgcactaatagcttcaatttttcacttttgaacttttcaagcaaattgtttgttttcatgcttctatgtaattggaccccgattaattaaccattgaatttatgccgaaagtacatggcaaagattgtgaaaaagaaatggagtagtactatttgtagatttaaacatatataatttataaacaatttatatgtagcctctgtaagttggttttcttttgaattcaggtaaggtttatctctccagtctagacatcagttttgctacactacagtgtattattcctaatggtatatattacaattgtctatcagaattacgatggtggcatattcaataagatcgttgcttgaggagagaactgggagaatccaaaggttcctaacgaataagttagcttgttttttatttactaagataggcatatggttgcctggtagtgatgatggttttgatgggtaggttttctctaagatggaagacattaatgctccataagcacgatgcaatagtattgtatctaatttagttcttaacgatgatgtcgatgctaaggctccagaacataatttatttatttagatttttttctttcttttacgtttttgtgcttaatacttgtgatcttgtttgaacataatgtcagaaaacttttgaaacatatattgttacttttggttgtttgctttacattataaataatgtcgtagcgttagcacggacatattactagtaaaataagtttaactaagtggaagaaacataaagcactctattactattcttctaatatacactcaaatcttagtttacatctgctaatatacaatcatgtggccaataccccctaacagtgtcctcctggtacttcgagagaccaccctgggttggcgagatacttacgacaacctgtcatggccgtccaaccggggctacatatagaggagtaccctcccttcgaatttgtcttaggaatatatactaacgtggagaaatacccatactgagctatcaccatcagcggcccacctctaatgtcctgcaacatatatgcccaattaatgatatttaataatctaagcaccatgctaacattactaaatactactctatagccgtgcacccgacatagagcaactgataaattagacattaaactcgcaccattacacctctctggtaggctacccacacaattcatataatgcagatataaagtaagaccagtactaagactaagcaaagcaccgaagatatataaagaagagtatttcattaatacggaaagtattacagaagagattacaagagctgctagagccataccgaaaactcttccgaagactccgaggactccgaacactattctatactactacacttagcattataccactaatactaatgtatgaagaggaattgagcttgcttgagtgtgttgagaagtgaagtgaactcctccttttatagggtcggtatgacggttactgatatgcgaaatgtcgattttacccctgtaaccatcatcagcaagcaatcttggatatccacgtgtaaggctaggctgattggacgccgccagggttcggccgaacctgggctggcccaacaggcctccagcttcggcagggtggctgacaggtgggacctcatggcgattttggcagttaaggctgtttccggcggttacacttgacatgtgggccctccgtatccatttgcttgtttaggagtgaggttttctccaatttctctttattttatttgataaattcctgcaacatgttattctccaagtacaagtggaaatatattatttgaaaacaaacatgcattgtaagcatagctaattcttcattattttagttctattggcagtcaaatattgtctgtaacaaccgtcaacgaaacccccaagcttaaacctttgctcgtcccaagtaaaggacgaaaggaaaataaacttggttgttgatcaggagttgctaccattgttatatttaaaatgtacaagtgcatagtttgagtactctctctctcatgttaagtaaatgtgcacggaggcttacccttacgcctaaaaattgtagaacacccgcttctcaccaccttaggcaattgagagacagaacagatcaactggagcagggaactttatactttgtaaccattgcctactcataggttgcacaggagaaactttaattttactagatgctagggcgcgccattgcgcgctgcctgcatacactaaaatacgtccatgtactaaatcaatcaattgataaatatattagtaacatcatatattctatattaactctcctgtgtatatcaatgacaccagacttgagtcagtaatccattctatgtaacaaatatcccatgtaactacaaagtaatgggcactttattatcaatgcaaagcatcccctactaaaacctcagtttgttacactattagttcaaacatgaacacaatgctttcattatataaaaaatataagtaattccgcgtacaaattgctttggtacatacaccaagagaatgcattggtgtcataaataattgatgacaaatttaaaggtcataatctttgcaaataggacaattgaagaacaaagggctcgactttccaatattagattcagcatcgcatcacatcctgaaaaatgtaaacaggttgaaatgaaagcaaacattagctaattaaatcacattcaaaagaacctgcagacctgcaggtacatactaataccctaatagtaacatcttatcatagtgcgcacacactaagggaaaaaaggacaaccttgtttctaggcctatcagtgctagaggaacattgatccatggatgtatttttatgaggtagcagcaatatataggagtattttgcaaaatcacattcatcaagttataaaccaaaaaaaaaaaggattttacccttgaagtaatgccattctatcttctcacagctgcagttttgtagccatatacaggatagtgtaagtggagccaaaattgtagcatatctattgtgtcatttgtggaattactaatattagtatccttcaagctgaaagtgagaaaagcataagtaacttaataactaataagtctccaaaggctcatccatcttttactaatataaaaaaacatagtggcggtgatggtagcattctatgatgaataatattgtactatctttttggtaaatgagtgaatcattccattagatactcatctgtatatgcatgaggccatttcatttaacgtgaactcataaggaaatattttagatttggggataccattttttttctagtttagaacttttgatatatttatgacaaccatcgacaaaatactgatttcaaccaagtataacttcccaattttttgctgaaaactaatcaacgtctagcataagatgcagggatacgcaaacatgatttacatatttataaaaatagtcatgtgcagagcacccacacaataccaagtgaccgctggcccttttgaaagcatgaaagagcagggaaaatagatggctaaatccacaatatatacatgcattttttgcgaggattatatacatgtaatccatacacctttcttaaatgaaatacataaacaacttgcaaaccaaaaataaaagcacaaagggacgcttaaatacataaaaagaagatatattgacatttaaaagaaatcttaatcgtatgagtaaaagctagagaaatactacctccgttttttaatagatgacgctgttgactttttctcacatgtttgaccatttgtcttattcaaaaaatttacgaaattataatttattttgttatgagttgttttatcactcatagtactttaagtgcgatttatatcttatacatttgcataaaatttttgaataagatgaatgattaaacatgtgaggaaaagtcaatggcgtcatctattaaaaaacggagggagtatgtatataattcagcatcaatccatgtatcagtattatatctcagtgctgacatgagtaaaaaaaattgaggtagcaaattcttatattaaaggagaaaaacaacactcaccttcctggttaatgggactttttagcccacagtgcacaaccttttctgtaagcttgcaattcatatctacagcaaagcatttgtagcttgcaattcatctgtaggacaggcatataataaaatctgtcagccatcggcaatggcagtgtgagcatttctattttctttacttaccaaacactgtgaggctctcaacagaactggatagggctctctcaatcatttcatggccaaggtacaacaatcctcatctaacttagatgcttcactttcctgattacaagtttacaacatctccttaaaagttttgaaccataagcaaaatttatgtatatgctatatggaaccaaaaccttcaagatcaaactaaaaggtagtctaaggaacaaaatctatgccaaaacggtaacgataactactatatttgaaaaaatacttgataattccaaaaaaaaatatccacgagattcatttgagtaaataatgagatggaaataaaatgtagccttgaaagctattgtaccaatcaacagcattctgtttactcatgttcaaatgaaaaggagcacataccatgcccagagatttggaagtataaaacaactgaagcatcactcaccatggcttccacaatgtccttgactgtttcaaggctgaaatatttttctatagcctccagcctatagtaacacagaacaaatgagatatacatgaacaaataatacatttttcctaatcagtgacatgaacaatgtggatgctatacatacattcacatgaaaattcatcattatttaagaatataaaaaagcatgcaaggtgaccccattctcagcacattcaaagtgcaaccaatgtatattactaccagtcaattatattaccaagcgaacctagctcccaaagaaatatataaaccacagctttacaggtaatgcaaagattcatgaaccacacaaaatagcactcggcttgattaaatgaattaagaactatatgccttataaatatagaactatctattccatatttccatgacagttttgtgtgtctttctgcagaataatgtaattacactgaaatagatgatggtctgagttctgaaatgcagtccaaaacatttttaccaagcaaaggaaagcatcttgattctactataattcccatgctatgtttaaaagaggacaagattatctagcattccagcaacttctgcatatgacatgttaaagcacttaataatacattctcagtttataaattagaaatatatttacttcttatatgtcttacctacaaataatgctattcttatccggatacacaatatcctcatgtatagaaataatgctgtcatcatgctgagagagagagagaggtcatttgtgaagaagagcaatactgattcagaactaatcatcagctgagaaaaataaatcatattatagtttcaggtttgtcactctatttagtaaataatgttgttccacttttttttgttaatgcgtaagttccaatcttagcatacctttgtcgagttaaaatgataactacacaagtttcttctgtctttgacaccttggtctccacagtttcatttcacttttcaaggatgaatacaaattaccaaaggggtccgtgattgagccctcaagagaatcaagacatgtgcttaaaataagtagtaagctctatcttcaccatttcttccctttctttgtcgtttttttattgacagctttgtagttgatttgagacagtgcagatagtatttactttgatggcatgaagaattttgagaatcaaactgaaatgttgttagaatgaatgggcatgtgtctgatacagtttcccgatacctgggactattttctcattctattcatgcatttggttagcattgagtgcatgaagagtagcaaataagtcaccacagataatgctgtagaaaatccatggccttttcataattaaaccaacttctatcctgttttcattttatcatgccaaaaggaaaagaaagaagaaagaaacatcataatcatgtaacactgtgaggtagcatttcaatgcaatgataaatccctgtcacgttttattgctgcttatttcatttcatattagttccaggtaaaatttaaacaggcacactccgctcttcattataagcttatcttctgtgtttttgtgtagttgaaggagaagaattggggagcatacacaacatgcttttgtgcaagtctattttagatctctagaaaggagacgatccatttggcagaaaatcaaaagaaatccaagaagacatggcttctactcttaaaactgaaaggggcacttaaggtttaaatggcatatatcatgtttcgaagagcttgacgttttatttctgggagttcagacttatgacttatgagagcattcttagctctgatcaagtatattctttgcatcatttttatttgcttactaactttactcttctagccttgaactctctcaaaacagaatgagcggagtaaccttgaattttaatcttgcaagacatttcaatgtctggaaattgacctaagtaaacatgttcagaggggaaaaaaggaagaagagagaaacagctggctgctgggttatgcaaatgatctatagaatagttagcagaaactcgtctggggaagcaaattatgtgcatatttcacgcaggatcatttgcacaaggcccagcttgcgaagccaataatctaatgcggtaacccagtaataaattcgaggttcagagagcattgacattccaactcgatgtaatcgaagtaaccaaatcaccaaataccccccatgaaagcaaggacagcggtattgatttcagtattttacaccccaaaatcagaacacgaattcggccacagtaatccagatcttcagatgcatgaggcccgtcaaatacagcagaataaaaattatcatcagaattaatttagagcctcaactgacctgaatatattgatcaatacagcagggcctaatctggaagctcaggacgacattagcatgatgcatgtttgcatggctccaactcctggactcctgagaaaccaaacatggccttagatattttctcctttaaccacatcaaatcattgaagcaaattacattcaaataaaaagaaataacagaaccagccatagaatatatgcatcacatcattagtaattagaagtcatcagaacactgcaacttaaaatgccagagaaaacacatgtttactgctatcaaccaatagcacttggtttcactggatatattggcatgatttaatttccatatagataccaattaatagtgatgttatcgtgtaataaaaatatactgcatatatggaaagcgagtgattcctttaaaggagcagcttggaatatgttgctcatacaattgaagatgattctaaggaacaaaacctctggaccgatacaatgtaaacaagaccaaaaatcatctggctttgcatcacttgaaacaaaataaagtaaatacatagtctgaaatatacacttcctgataatcttgaaaaatctaaggcttgatgacatattttatatccacggatagtttaacctgccatatttatcttcgccctagcttatctgtattccacaaatttatgaagtagaagaagtatatctgcatatctgacctcatagtactgaatacacataggtaaaagagaaatgcattcttcagtcttggtgagacagaatcaacagttaagaagacactacagatggtcgacatataaaaccactcagacattgttgtggcttggattaagaatgtacgtaccctgaaattagtgtcaggttcaagaaaattaccagcataactggtgcccgtcgcaatctgtcaaattcttcacttacaaattttcctcacttccctttctcctctacacaagccatagaacaaataaatttacatacttttagtaaaagaactatagcagccacatcgaacagtacactgggggaggttcggtttggaattgtggcgcttatgacataggtttcactagactactctagaccttgcaacacatcacgagcttgcaaataagcattgtggtagctaaagcgacaacccataagaaagatcaatgttgcagtgctgatcaatttattttcaccccttgatgcaaatcatctaaaaacctggactaccatcatattacctgaagatgaattattgagagctgaagaacatggaaaattctggtatgcaatccaaaggtgtcaaacctgacatgaaaaaggaaaatgatcagatcaacagaggctcatcataccacaccatcctcaattttaagtcaaccaatctcatattatttgcaattgactgaaacctctgcatgaattaattatttttgtctctcttttccttatggctatcaagcaaccatcagtgaccaactgcagtcccattttaagtatttaacatttaagaaacattaagtacagtaaaatgggagattgagattaacatcttttgaataatagtgccaaatataagctcatcctcctaccagttgtactaaaaaaatttgactgccaataaccaatacgctaactactaaaaaaattcatccagtatgtgaagcttctaaatttttccacaaacacactccaaaatcctattctataactaagtcccaagaaaacctaaaataccaagaaaaatactaagaaagagaatagattaatgcatctagaaatgaatcataacagattgctagaagtgattcgctattgattgttcagagggcaacgagtatgaaatatagctaaccaacctggtcctctgtgttttcagatgtcatggcatggtcacagcaagcagaacaaccagctatggtggaggattgatcagagtcgtttatatgatcctcaagcacaacactggaatgaaaaggtgccacatgtatagaaatacaaatctgaaatattaagtaaccatggggaaaaaatggctcactcattggggaagcatgatatattgcagattccttcaaccaaaaaagccgaaaccaccaaatacaaaacaaattttgagacattacccaaatgcattggctctgaagtgaaatgataggcatgttactgcagatttattcgcggcaaaagagtttcaactttccaatcacccctccacaaacccactccaaaaccctattctataactaagccccaagaaaacctaaaataccaagtaaagtactaagaaagagaatagattaatgcatctggaaatgaatcataacagattgctagaagtgattctctattgattgttcagagggcaacgagtatgaaatatggctaaccaacctggtcctctgtgttttcggatgtcgtggcatggtcacagcaagcagagcaaccagctaaggtggaggattgatcagagtcatttatatgatcctcaggcacaacactggaatgaaaagcccagtcaaaaaaacactagaatgaaaaggtgccacatgtatagaaatacatatctgaaatagtaagttatcatggggaaaaaatggctcactcattgggtaattgcagatttttgatgggatgtctccatctctaaagcagcttctagtattagtgcaagactgcttcactatggaagacatataatcctttgaataagcattg

SEQ ID NO: 36332 - DNA, 664 bp, Oryza sativa
ttggttaatactgattaattactacaactgttttactgctttgaactaccgtctttaaatgcccgctttatgcaaatgaacctttctagccataccttgattataccctgcatcataccccctattccggtatgacttgctgagtacggtggttgtactcagccttactctattttccccaaaaccccagagtttgagtacatgtcagatggtggcttctccgaggagtaggcttcgtccgtgccgtcgaggatgcctgtggagtggcgttcccgctgcagttcaagtcaaggcttagctccatttatcttttaattttccgctgcatttatgtaagacttttataatgtttgtaagacgtggatctgtatgtcaactttgtcgtttgtgtaccccggctggtcctggatgggggttttaatgcacattctgcttagaattctatcgggaatttctgggcatgacagcaactatagccacgaagggcaattttttccattaccatgtacaggtaaatggtctatgatactcgagtataattatgattataattctaaaccctgattgagatgacgtgtaatggataaggcttaactcggtgctcagtctagtcctgaataaaaggacacggatagagatggatgaagtcgttgcgacgatggat

SEQ ID NO: 36333 - DNA, 354 bp, Oryza sativa
ggccaaccaaaaggccaccgccgaggacatcgacgatggcaacaatgacctggggttccagaagcctgaggccaccgtcgccaccgtcgatgggggagcgtgcgctcacgcttctcgccggacctcaaggacatgaagcgagagcttctggccgcggcccctacccatgaggcaacgcggcgggcccggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagccttt

SEQ ID NO: 36334 - DNA, 739 bp, Oryza sativa
ctaatcacgaaaaacattgttcaacctgcccatgatcgcgggcacggctattcgaatagttttactctggccagaggtgtatcaccactgtacccacaagacacagctccacgacatgtcaccatgcgcctcaataccaccacggtaccttggaaaggaactgtgacagtacccctcgcacaacacaactcaccacagtgcaccattcctggatcataatcaccccctctacaaccagaggcatggactccccagcgaccctcatggacttctcgccgcttctcagtctggtgccccgcaatgaaccatgctatacgaaaggtaaatccgttgcccacgctggcttgtgcttggcacggtaaatatttcacaacaatagctcgtgaaccgttccttaattgtcatgagcacgaccttcaaaaccatgtgctcacaacccaccattatcaagttttaattatcaattaattatcataacacaattaaccatcgtgagctaccattaaatataaccataagtaacaatgtagtgtgattcatctcatttatggctaagcaattatatatatagcatttagctgaaccaatccaatatataaagtccaagctaatcaatttattacccataggagaataaagtcatcttcggccataattaattgggaatggctcaccacccgatgacattcgaaaataatgcataagttgaaataaaacaatagctttagataggttcaac

SEQ ID NO: 36335 - DNA, 424 bp, Oryza sativa
gtggtagccccttggtaaactgatctgccaaatttttagccatctggacatagtccaatgctatcactccggagtttttctgctttctgacagacttcagtcttcttttaacatgcctggatgacttcatgttgtcctttgaactgttcactttaataatcactgtttgattatcacagttcatcaggattgctggtactagtttttcaaccaccggcaagtccatcaggagctcacgaagccatttggcctcaactgtggcagtatctaaagatgcgagttctgcttccattgttgacctcgttaagatggtctgcttgcaagacttccaggaaacggcgccccttccaagtgtgaacacatacccacttgtggcctttatctaatcagcatcagatatccagtttgaattactatagccctc

SEQ ID NO: 36336 - DNA, 673 bp, Oryza sativa
  unsure (1)..(673): unsure at all n locations
nnnnnnnnnnnnnnnnnnnnnnnnnnnnnnnnnnnnnnnnnnnnncaacatactgagcaaagtccggaatattgtcgtcttccactttatcttcttccatttcaacaccgtgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgctggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttggtttctattatttaagattaactttcactagagttttccttctcaactattttataaaaccttgttaagcaaatgaaccaaatttctatatatcctttcttccccacatactatttctctctcatcaaattacaactaaattttgga

SEQ ID NO: 36337 - DNA, 188 bp, Oryza sativa
  unsure (1)..(188): unsure at all n locations
tagaacttgttcattccgatctgtgcgaaatgaacaacgtgttgactaagggggaaagaaatatttcatgacactgatatatgattgcactagattctgctatgtgtacctattgaaaacaaaggacgaannnnnnnnnnnnnnnnnnnnnnnnnnnnnnnnnnnnnnnnnnnnnnnnnnnnnnnnnn

SEQ ID NO: 36338 - DNA, 750 bp, Oryza sativa
  unsure (1)..(750): unsure at all n locations
annnnnnnnnnnnnnnnnnnnnnnnnnnnnnnnnnnnnnnnnnnnnnnnnnnnnnnnnacagtttaataacttccaagatcaggtagactatgccgtacatcatgctttgatcaatcaatctgggatattagtcaatactttgtcaaacatggtgaagtcgatggttgatggttcaatagctgactatcagactacgggaccggtttatcttcaaggaggtactttcccgaattatcggcccttgatcactgataatcagcaagccgtttaatcagttcctcctttgttatatcgcccttagttgtttttcatattgtaatcggttatggtttgccgatgtataatggccgatattgttgtatcgcccttagccgcttttataattttatcaatgcttgtgacattgtaaaattagggggggcacatatatatatgaaaaattgcatatttttgagccaaatatggggtcatattaaatcggcttaaagattgttgagatgagttacataaagagtcagagtttcttagccgattgcaaaaaaatttctaagacctattacataagatatcactaagacaaatattgctggaaagctgaaatagctctttgcctgattttttctacttcttcaatggcatgggcaccttgagcatcggttacagggatgacttttaaaaacttggtcagatcagcaacatttttgatagccgattttagtcttgccttctgctcttaacaaaatttggga

SEQ ID NO: 36339 - DNA, 827 bp, Oryza sativa
  unsure (1)..(827): unsure at all n locations
nnnnnnnnnnnnnnnnnnnnnnnnnnnnnnnnnnnnnnnataaaggattacaaatgcagcggaaaaggtaatagcgagctaagcctgaagacttgactcctgcagcgggcgattccattccacaggcaacccttgacggcagcgacgaaaccaacctctctgagacggctccaattgagaagaacttctactctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaatcactgtccaacgctacaccacgttgcaacaggccgaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccgcataaccctcccctaaccatccacaccacgctaaggtttcacccccacccctcaaaaggcagtgggcggtcccctcttgcgccacggtgaatccggcagctggacaaccggacaccccggccgacccaactccatcacgcccaccctcgccaccggtgcctaggaaagggtcgagctatacttcagatc

SEQ ID NO: 36340 - DNA, 1992 bp, Oryza sativa
ctatagggcgaagtcgagctcggtaccctgcatgcgcgcgggcgggaagggcggaggagtggggcggcgacgtgggcgcgcggcacgggcggagtggggcgtggagaacggcgggaaacggcggcggcggcatgggcggtttctacggcagcagttggagctccggctccaacggctggaggtgggagaccaccgacaggtggggcccacctgtcggcatcccagagagaggagggaggggcgcatgggccggcccaacaagaggaaggccgagcgggagagggatgggccgacggcccaacaaaggaaaaggagggaaaagaaaaaaaagaaaaagaagaaaggatttttcctgagatttaaaattgcactttggtgatttttaattggttaaaattatttccaaggctctgaaaatttcactaaaaatcctgttaatgcattggagcatggggaactcaagaaaaattccaccacactatttctgattattaagtgcatttattaactagggatttagctctaggttaattaagataatttcttcgggcaatttatttaaccaatttttaaagcaagcaaaagggggaaaacttcagggtgtgacaaacctaccccccttaaacggaatctcaaccccgagattcggaagagctggcgaagaggtgcgggtgggtggccttcaactcatcttctctttcccaagtggcctcttcttctgagtgatggctccactgaaccttgcagaatctgattgctttgtttctggtccttctctcgctggtttcaaggatacgagtcggcttctccacatacgtcaagtcttcctggatttcgatttgatccggacttgcctgttcctcaggaactctcaaacatttcttcaactgggagacgtggaacacattatggatgccaagcatgttggagggaagctcaagctggtaagcaacttcacccctgcgttccaaaattcgatatggtcccacaaagcgtggtgccaactttcctttggtttggaagcggtgtactcccctgagcggagtgacacggagatacacataatcccctgcttggaaaacgagctcccttcggcggttgtctgcatagcttttctgccgagattgcgcgattctcaatctttccctaacagctctgactttctcttctgcctcatttaaaacttctgtaccaaacaactggcgttcccctgtctgatcccagaagagcggagtacgacaccttcgtccatacagtgcttcaaatggtgccatctgcaaactagcttggtaactgttgttgtacgagaactcagcatacggtaagcttttgtcccatgctccaccaaagtcaagcgcacaggctctcaacatatcctctaggatttgattgactcgctcggtctggccgtctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtgtctgtagcaaacctgctggcctttggtgttctgcctttactcgttgacagacgtcacagagtgctacgaattcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttatcccatccagattgttccttgttcgtcctcaaca

SEQ ID NO: 36341 - DNA, 3991 bp, Oryza sativa
  unsure (1)..(3991): unsure at all n locations
ttggtgttctgcctttactcgttgacagacgtcacagagtgctacgaatcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttatcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcagatgttccaaatcacgttgaacctcacaacatagttgctctacccatgcaacattgcactagctcttcctgctcaaggcatctgcaaccacattagccttgccgggatgataatgtattcccatatcataatccttgatcagctccaaccatcttcgctgtctgagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcatgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacttgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacacctagaggatcccctcatgaagaaggcaggtgcattagtgagtccgaaagacataactgtgcattcgaacaacccgtaccgagtgatgaatgctgtctttggaatatcctcctcgcggatcctcaactggtgatagtctgatcgcaggtctatcttagagaacacagtagctcctttcaactgatcaaacagatcatcaatccttggcaaaggatatttgttcttgatggtgacctcattgagtgcgcggtagtcaacgcacatcctcttggttttgtctttcttctccacaaagataaccggagcaccccaaggcgatgtgctcgggcggatgtatcccttctgtaactgttcatcgacttgcttcttgacttccgccaactcgttggctcccattctgtaaggcctcttgtggatcggtgcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactgatccctgacttctgcggcactggagactggaaggttaccacctctccttttgcattggtcaacttgatggtgcggctggcgcaatcaatcactcctctgtgtcttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgagcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcacggttgttgtgactgccactatggtggttcttgttgaagctacccgggtggtagggacggtactgccggataatcatggtggaaggtccaccgtgatgtcccatcgtggaacgaggcttctgactcttcccctggggagtcctgaactgagctgccttcctcttacggtttactttgttacagtgctcctcctgacggatagccttatccaccagcttctcaaagtcctcataatctctagagatcaactggttaatcaattcatcatcaagaccagacagaaacttctcctgcctcttggcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagttggacgggtcaccatgtagttgtcccaccaaatagaagcgggaccttgtagctggtgtgtagcaaaagcaaccttctcctgctcattgcattgcaaaagattcagcttcttctcaatggcatgaagccagtcatgggcctcgattgggttggtggtgcttgagaaagtgggcggcttgacacgaagaaattctaatagtttggactgaggaggtggaggaccaaactgcaggttctgttgctgctgctgtgcttgctgctgcacctgttgcaacacctgatggtactgttgctgcatctgttgcatcatcattgtcatcatctgagtctgattgtccaacacctgagcaattgttgggttcttaggcggtggggacggattgttgtcagatgcaccgttggcacgtgctccatcgatcggctcttcgctgccactggcattgttggagtcgcgtgaaccattccttgtctccatctgaaggggataggtagaaatatgagaaaaggaagaaaacaggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacagaaaactagcaagcaaacagactaagaaggcaataaagctaagggcggcgactctgaagctcggagcggcgcttgcgatcgaggaataggactgacatctaaagtagacaagggataggaaccaattcatgctcaaatccaaattaaacaaagcaacaaatgactcaaataaatactcgagcatgatgatttttatgcatagaacatttttcatgaactcaaatgaggatactgatgcaactggctaatcaataaattaatgcataaaataaatgcatagctataatgannnnnnnnnnnnnnnnnnnnnnnnnnnnnnnnnnnnnnnnnnnnnnnnnnnnnnnnnnnnnnnnn

SEQ ID NO: 36342 - DNA, 727 bp, Oryza sativa
  unsure (1)..(727): unsure at all n locations
ttttttttctaaaaccctacactgagctaaaaaaacccgatccgaatgaacgaccaagatttttcccacaagccaaagaggcaaaaccccaaattttcctgaaacaaatccaagcgcaaaagggcatatgcatatgaaaaaaaaaggggttcagagggctcttaggtttccagttggcttgtcctacggtcaaggtcggctctgataccaacttgtcacgcccagaaattcgcgaaccagaatttctaagctgaatgtgtattaaacccctgtccaggaccagccagggtacacaaacgataattgttgacatacagatccacgtcttacaaaaacataaaggattacaaatgcagcggaaaaggtaaaagcgagctaagcctgaagacttgactcctgcagcgggcgattccattccacaggcaacccttgacggcagcgacgaaaccaacctctctgagacggctccaactgagaagaacttcaactctggtgtgggggaaaagagagcaagactgagtactacccactgtactcagcaagtctaccggaagaggaggtatgatgcagagatataaccaaaggaggctagaggttcttttgcatatagctagcattcaaaagtagtagttgaaggcagtaaaacagttgtagtaattaatcaatatnnnnnnnnnnnnnnnnnnnnnnnnnnnnnnnnnnnnnnnnnnnnnnnnnnnnnnnnntt

SEQ ID NO: 36343 - DNA, 711 bp, Oryza sativa
  unsure (1)..(711): unsure at all n locations
nnnnnnnnnnnnnnnnnnnnnnnnnnnnnnnnnnnnnnnnnnnnnnnnnnnttttgggtactccatccaaacacatgattcttgagagatagagctctaccaaccttttgcctgtataagtagcgtgcactggtatgaaatgagcaactttggtgagtcgatccatgactacccaaattgaatcgtggctagatgatgtcctgggcaaacctgtgatgaaatccatcccaatctcttcccatttccattccgggatctgaagaggttgaagcagtcctgcgggcctcttatgttctgctttgactcgctgacaaacatcgcagagtgcgacgaattcagcgatttctcttctcatactggcccaccaaaatttctctttgagatcttggtacatcttggtactacctggatgaatggagtactgagtctggtgagcctcggtgagtatcagatctttcagctctttgtcatcaggtacgcacaatctttctcccaaccagattgtgccatgttcatcttcgtggaaatcccgggcttttccgaccctcatattctttttcagttcagctatctcaggatatttacatgagctgctctgacttgatccacgagcgtaggccgtgcctctagagcagccacaaacccgtgttctacgattcccaagttgagatgtttaagctcctgctgcaattccttacacatgcccttaat

SEQ ID NO: 36344 - DNA, 6674 bp, Oryza sativa
  unsure (1)..(6674): unsure at all n locations
tatnnnnnnnnnnnnnnnnnnnnnnnnnnnnnnnnnnnnnnnnnnnnnnnnnnnnnnnnnttgtaagcaaaataagcaatactaaattatctgggtttctatggttgaattatgcatgtgaaagtagagtattgagtagaaaggttataaataaataacttgtaaaatataggcttaaacgatcaaaatgtgtatagtaacttgccttgctcgatgtcctgagattgactgatattatctaatgtgtcataagattcctcaagaccaagggttaaacatgtaaaattcaaattcaaaagggattcaaataaaatccaaaaataggtaaaaataaaataaaatataaaaatagcaaaagtggtctcaaaagatagagaatgattttagaagaattttggttcaagtttcactggaaatgaatctatattttaaaatatatgggcttctaaagtttgaaaatcaaattaaatgttaaatggtattgtgtgtgggtcccaccgatcagtctctccctctcttctcttcttcaacctccaactgttccccatttacggccggcggcgctagggttagggattatggcagtaataaagggggaaaggtgttgcggccgaagaggggaggtagatagggttccccggcgacggcgagcggcgccggaggggttaatttggtgtgtgagtaacctagcggctagggtggcggtgacatggatgagctgagaaggtgatcggggtggtgagagttaggcatggctcagggaaggttcctagagcatctatgaggtgtctagaaggatttaagtagcttgccgacgttcggcaaggtatggaagatacttgctgacttgcgcctccattggcggtggtcgagctcacgtcggcagtcaagagggtgatgttagtgctaaccaattacgaaaatggaatctaaggagtatgtcgatggttaaaatggaagaactcaccgagataggttgaaccgacggattgcgaccgaaaaatcctctcgccagcaaagaccatagcagagcatgggcgccagtgctcgcctcggtgtcactaggtgtcaacccagagcttcggttagcctttagtatgctagaacatggttgaatataggtgttctatgggttggtcagggtagagggtgcatgaagtggtgtgaagtcgctcgcgcacaaggtgttcgaccggcgggccaggatggttgatcagatggattggtaaagcagagctttggggttgtggggttatggttggtgatactcgatgatggacaaggaaggtattggggtcatacttatagggtcacaagatgtcgatgagctcgggcgccatcaacgccattgatgagctcgaaaattgggtatggcaggggtggtagaggttatgcagcaacgggggttcccgatcttttgatgagaggaggataaacttcgatttggggaagggcacgacgttggcggtccgactacaactaccacaggggtgatgcgccttagcaaccggtacaccgactccacgttgttgctgttcttgccgtgccaagaacaaccttgaacctgtaagcaatcgaagaacaagcaagaacaagatgataaggaaacagctcatggcacctatcctttctcaaatgcaaccaaaccaaatcaccaggttcaaaagtaacatgtttctttcctttgctcccagcaagtttatacttaatattcatgcgctctatgttctccttagtggtctcatgcagttttaacatcaattcagcgcgctgttttgcatcaaagttcactctctctgaagttgggaggggcaaaagatcaattggagtatggggcagaaggccataaacaatctcaaaagggcacttcttagtagtagaatgttgtgaacgattataagaaaactcaacatgaggcaaacattcttcccacattttaatattctttttcaaaacagccctaagcattgtagataatgttctagtcacaacctcggtttgtctatcagtttgggggcgacatgtagtagaaaataaaagtttagttcccaacttagcccacaaggttctccaaaaatgactaaggaattttgtatcgtgatcagaaactatggtgtttggcactccatgccagcgaacagtctcatgaaagaacaaatcagcaacatgtgtagcatcatcactcttatgacaaggtatgaaatgcgccatcttagaaaatctatctacaacaacaaagatactgtccctccccttctttgttctaggcagccctaaaacaaagtccatagaaatatcctcccaaggcacactaggaacatgcaaaggcatatacaaactatgagggttaaggcgtgacttagctttttggcatgttgtgcagtgagcaacgaacctctccacgtctctcctcatcttgggccaaaagaaatgatcagtaaggatatccttcgtcttcttcacaccaaagtttcccatcagccctccaccatgtgcttcctgcaataatagcatacgcacggagctagctggaatgcataacttattagctctaaacacaaacccattggtgagaacaaatttgttccaagtccttccctccttgcaatttaacaacacatctttaaaatcatcatcgtgcgcatattgctcttttattgtttacaagccaaaaattttgaagtcaagttgggatagcattgtgtaacgtctagacaaagcatcagcaatgacattttcttttcccttcttatgtttgatgacatatggaaaaaattcaataaattcaacccatttagcatgcctacggttaagttttgcttgacttcgaatgtgtttcaaagattcatgatcagagtgtataacaaattctttgggccataaataatgatgtcatgtttccaatgttcgcactagagcaaacaattccttatcataagtagaataattcaaactaggcccactcaatttctcgctgaaatatgctacaggtttgtcttcttgtaacaacacaccacccaatccaatcccactagcatcacattcaagctcaaaagttttgttgaaatcaggaagttggagtaaaggagcgtgtgttaacttatctttcaaagtgtcgaatgcattcctttgtgctgcagaccaagtgaatgtcacatttctcttggtaagctcatgtagtggggctgcaatggtgctaaaatccttcacaaagcggcgatagaacccagcaagtcctagaaagcttctcacttgtgtgatagttgttggaaccggccagctatgtatggcttcaaccttggcttgatctacttcaattccctgcggagtcataacatagctaagaaaagagactcgatctgtgcaaaatgtgcacttctcaaggttaccaaataaacgtgcatctcgtagagcatcaaaaatagcaggcaaatgaccatgatgatcctctattgatctgttatatatgagaatgtcattaaaatataccaccacaaatctgccaatgaaagcacgtaaaacttcattcattaatctcatgaaagtactgggtgcattagtgataccaaagggcatgactaaccactcatataggccgaatttagttttaaaagctgttttccatttatctcctaacttcatgcgaatctagtggtaaccactacgcaaatcaattttagagaacacaagtgaaccactcaattcatcaagcatatcatctagcctagggataggatgaggatatctgattgtgatgttgttaattgctctacaattcacactcatgcgccatgagccatctttcttaggaactaaaagcacggggatagcacaaggactaggagactcacgcacataccccttgtcgagtaactcttgcacttgacgttgaatctcctttgtttcctccgagtgggtcctgtatggtacacggtttggcaaagaggccccaggaatgaggtcaatttggagctcaatccctcgaattggtggcagccccaatggaacctcctttgcgaaaacatcagcatactcctgcgaaatgttagtgaccggagaaggcaaagaaataggagtatcctcaattggaaataaagtttgtttgcaaaccaaagcatagcaaacaacagtgtcagtgtcaacttcatccaaatctgattttgtttcaatgaaacaagatcccttcagcttaatctcatttttattattttgaatagagttggtggatttcttcttatgcttctcaagttcattagccacaatatgatgctagtatgctcctgtttttttgtttgctagctctagcaagttcattctttaaaataacttaaagagacataggatgtaacacaagtttttttccattatgcacaaaggagtattgattggatttgccaaagtgtaaggaatctttatcaaactgccatggcctacgtaataacatagaacaagcttgcatagacacaacatcatagttgattgaatcatgataagaaccaatggcaaaatgtactcttaccaatcgtgttacctttaccttgccgctgctattaagccattgaatatagtagggctgcggatgtggctgtgtgctcaatgcaagtttcttcaccatttcagcactaaattattgcagcttcatccatctatgatcatgcgacaagagcgttccttgatcacacacttggtttgaaacaaggtgtggcgctgattctgttcagccccttccatttatgcgcttagcactcgctgcaccacgaggctctcatagtcctctgcagcctcggccccaatgtgttcctcatcttggtggggcgcgtcgccttcccctgcattgttagttgcaagcaaagcataggtttcttcatctaaatcactagcggaggagtacccaccatcagctctcacgatcattacacgagtgcttggccagtccttgcgcacgtgaccaaagcccttgcagcgtaggcactgaatatctcttgtccttcctgataatgccactgatgatgagctcttggaagatgtagcagcaacccctcttgtgggttcactcgggcatggtgtagagtttgttgtagagggacgcaacttgttgcttgaggacgatggtgctgctgctcgagttgacggtgcagcagcgttggaaggggtccaagagctagcacgacctgcagaaatgttagtcctgaagccagctcttcgtccctgcacttccatttcagctttacaagcaagatgaaacaaacgatatattgaattatattctttgtaggctagaatgtcctgaatttctcggttcagcccacccatgaatctatccataccagcatcatcattttccaccaatccacagcaaagcattcctgtttgcaaagcttgataatactcttctacagatttgttttcttgtctaagttgttgcaatttatgcaacaaatcacgtgcatgatatgaaggaacaaatctagatcgcatgaatcttttcattgcatcccaggtttggggagtgttatttggattggaacaaacaaattcactccactaaatggatgcaaaatcagtgaactcactagtagcaaccctaacacgtttattctcaggaaaatcatggcaagcaaatttctgatcaatggctaactcccaagtaagatatgcatcagggtcatattttccatcaaagcaaggaatggtaaacttgatcttgcctaaagaatcatcattatcacgtgcctcccgccgtggtggagcgcccatgccatggcgctaccggcactgttgtcttcgttgacgaccaagtacctcctcatcatgctcggtgtcagcagcgtactctagttcttcccttgctgcgatgctgctattagcatcatggccattgtggttgcgcctagccgatccatcatgaccatctttgctcattctctccaatgtattcaagatacctgcaagagaagtgttcacagccacaagggacctctccaatgaggaggaaaacttggagttggtgtcaatttgagcagcctccaattgaccaaggcgatcattggcgaccctatttaggggtaggtatgacggttatacaatgcgaattgtcggaaatgccccgcaaccgccatcaggagatgatcaagaccgtccacgccaaaccccagcctggatggctgagattgtggttcggccgaacctcggctgaacctgggctagtgtcacgcccagaaatttagcccaaatttccagactattttgtgtattaaatccctgtccaggaccagccagggtacacaaaacaataagtaatatacagttccaaacgtaaataaagcgtaaaatacttacagaagatgcacttagtcctcacaccgaaacaaaagcagcagcagtggaaaaaggcgatcctagcggggcttcagctccactccacaggcaaaactcgactggggtctgagccttggtcttctaacctcgtcttcagctcagaagcactacacttctgaaaagggggaataatagcaagactgagtacaaccaccgtactcagcaagccacaccaacgatgcagacgtgcaaggggacacaaggacggtttgtggctatttgcataaaggcagttgtaannnnnnnnnnnnnnnnnnnnnnnnnnnnnnnnnnnnnnnnnnnnnnnnnnnnnnnnn

SEQ ID NO: 36345 - DNA, 5269 bp, Oryza sativa
  unsure (1)..(5269): unsure at all n locations
nnnnnnnnnnnnnnnnnnnnnnnnnnnnnnnnnnnnnnntccagactattttgtgtattaaatccctgtccaggaccagccagggtacacaaaacaataagtaatatacagttccaaacgtaaataaagcgtaaaatacttacagaagatgcacttagtcctcacaccgaaacaaaagcagcagcagtggaaaaaggcgatcctagcggggcttcagctccactccacaggcaaaactcgactggggtctgagccttggtcttctaacctcgtcttcagctcagaagcactacacttctgaaaagggggaataatagcaagactgagtacaaccaccgtactcagcaagccacaccaacgatgcagacgtgcaaggggacacaaggacggtttgtggctatttgcataaaggcagttgtaaaacattttattgagcaaaatactaaaactgttgagtaattaaggtaatattaaatctccactgatcaacgctacaccacgatgaacaggcccaaccaacccacctgaactacagtgcattgagtcgattcattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggtcgtgacaggatccttcgcataccctctctagccaagcacaccacacctcaggtttcacccccactcctcgcaaggcagcgggcaatcccctctcgtgcctaggtgaatccggaagcgacagaggccgtcgcagggcccgccccgctccatcacacccacccttgcctggatgcgtcggctagaggaaagctacactacaagcccagccgttgcccacgctggcttgtggtaagtacgagaaattcttccagggtttcccgtgaaccggtccttaattgccatgggtgcgactagcaaaaccatgcacccacagcccacccttcagtcgcattttagttggataattatgaccatgaagcatggccagatgtctcgagcacgcagctcattctgatactaaaaggtctaatattgtaattatcccatcaactgagctagtggtaattaagcatggctaagcatatagttctagctaggtcacataagtaacatgagctagtcgatttattacccaatgttgacaaaggacatatatcaagtaaatatggcacaagcgagcagataggtaaaccctgatcccatgtaattagcaaaacacgcatatttatttgcaaatagtaaaacatttgtaaattgggatcaacatgctaaaggggaatgtgtgacttgccttgcttcttcactttgatcttccgaactcttttcctcgtgaccgcggacttccgaaacgacgagaactacacgctggcacgcaaaacaaggaaaaactctaataaaaaccaagaaaacggtatataaaaagtaaacaaacatgtagagctcaattttagatgaattttgcaagttgaatggctcaattcggagttcgaatgaattagatatgaattttagaaggttttgagccattaaattaatatctataattattaccaaattattgcgcaattattaaatattttcacaaaggaaaaggactgccgctgacgttagcaagagagggggccggcgccgacaggcgggtcccaggcatcagtggctcaagggggctcggtccaccatggaccgggaccacaagggcggtccaccgcccgtccacgggatggacggcccagatcggcccaagccgatcgggcggctgaggagagcggtggccgggcacgggcacagccggggctggcccgaccgaccacagagggcggcggcgcgcagtcaccagcaacggcggggggcgggcggcacagggagcagcggcgcgcagcgcgggaagcggcgagaggaaacggaggcagtgagggagagggaggtggcggagctcaccgaggggcacggcgacggcgagagcagccggcggagggaggcggcggcgctccacaggtcgacaatgagaaggggctcccggcggcggaaggcggcgatcgggcggcggacggggaagagcgggacgcggcgaagccgggggatgcgttgcggcgacagccagggtgaagccgaacggcgaccggaggcggaaaaaggcggccggtagggtggtatggcaggaaggtggttctggtggtggaggggaaaaatggatgggcggccgagcttgccctcgcggtggtaaagctaatggcggccgcggggtggctgagagcagtgaggtgtggccggaggcgacgaccggagtggcggaggatggtaacggcttgggtgggtggtggaggtgatgactcggccacggattggtggaacgaggcagtggccggtgctctgcttggagcggcgaagccgacactggcggtggtgcggcttggcggtggctagcgtggcgaggagagcggccggagttcggcggcaagcggcggagagaggttacatggtggggaggtggttccgatggcggttgaaggaaaccgagtggaggccggcgtgcggcgcgggatggcgaagctgatggcacacgcgatgaggcgcggcgacggcgggagcagcggcggcgcgcggctggagatcgccggcgagcggcggcgatggggatcgacgtggagagctcggtagagggcgtgggggactcgggaaaacggggaaaaaggaagaggaggccacgaggattgattttacagctcaagggggcgaggagagggccggggagcggcggatttcgagggggagtggggcggcgtcttgggggtggtgccggcggtttttcgcgggacggagtgggggaggggagcggggtcgtgggtgacgaggtcccacggtcgggcaggagtggtgcagggtggaggaggtgggcggggaaagcggtgacgtggggcggctcgggcggccatggcggttgcagccggctagccagaggaaggaggaggaggggccgtgggtcccacctgtcggccaaagcaagagggggccggttaggggaggaaaagaggacttgagggagagggaggggaggagctgggccggcggcccaaaggagggaggagggcggccgggccggaggtgaagggggaaagaatttgggccgagcccaaaagggaggaaggggaagattattttattttctttttatttaaattgattaaatgaactttgtattattataattacttcttgagctccgaaaattcacggcaaaatttcagagaatatttagggcacaaagaatattacaaaatattctcgcccaatgatttttaaaggaaatttttaattccctcaatatttcacttgattaaattgctttaacttttatttaatttctggaaaatacattatttaatgatttttaatcccaacgaaaatcggggcgttacagctaggcccatctggcctggctctttgcgcatcttcccccctgaccttctctacctatttctcaggattttgggttgactctcgggtattttgatgaagttcataacccatccttgtatggatacataattctcctcactttagtctagatttcctcccaacatcgaggtttatcacctgctgacggagcatgggggtcctcaccgggagaccgcgcaggcccccctttgccggttcggccgggggcgctaagtgaggttcttcgccctcgatctgaggaacgtccgcgagagaggaagtgcacaagacacgggcgacgtagataggttcgggccgctgggaagcgtaacaccctactcctgtgttctggtggatctgtgcgtgaaggaatacagagagctggagagcgagccagagttcagggtctagcacccattccccttttttctcctccctccagagtcccctttctttttttcttttctcttttctctccagagtcccccccttttaggcctgggcaccctttttatctggtcaggggtcaccacaagggcctccagctgcctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggttctgaccgggactaacataccaactccaggagttagcacgccggctccggctagggacgagagccaggaagctctcatcattccgacgggacggggcgaggcgtgtgacaggccgcctgttgccacctaacccgtgatctgaccggtctgtgaccggtcacacaccgcgactggtcacggaccggataagcgtgcgctgcgtcgcattaaatgcggcgtggcgcgctcgtccaacctgttataaatgcggttaggtgagccccgcagtgctcacctaactcacacacgtggcgccaaaaccacagggggtcggggcgtcgcagccctcggggccgaaacgggggcgccccagccctcagggccgaaacgggagcggcccgacccctcggggagacagagggaggggtggccacttcaccctagggcccgaccccccccccccccgagggggtcaggccacgtgggtgaccgcggctacccaagcctctagtcacgatacccctggccccatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcagcaagggaaaaccgaccgacaataatgagcggcttctttaagactgctacattactcgagcagcgcgcgaatcgggacgagccggttcgtttcgcctggagacatgatgatggcgcttttcacggttggcgagcgtagttaatgcgcgcacgatctgccccatctcaaccgccacggccgcacatttgccgcgtgcgccgcaaacgagcgagtgggttagtggaggcgtgggcgcgagaagccgggtatagcattggcaagggcctaaccacgtcgagtaaggaatnnnnnnnnnnnnnnnnnnnnnnnnnnnnnnnnnnnnnnnnnnnnnnnnnnnnnnnnnnnnn

SEQ ID NO: 36346 - DNA, 1861 bp, Oryza sativa
  unsure (1)..(1861): unsure at all n locations
aacccagcggtcgcaaatcgcgcgcatcagcaaagggaaaaccgaccgacaataatgagcggcttcttttaagactgctacattactcgagcagcgcgcgaatcgggacgagccggttcgtttcgcctggagacatgatgatggcgcttttcacggttggcgagcgtagttaatgcgcgcacgatctgccccatctcaaccgccacggccgcacatctgccgcgtgcgccgcaaacgagcgagtgggttagtggaggcgtgggcgcgagaagccgggtatagcattggcaagggtgtaaagacgtcgaggaagggattcgttcctttcctctcgccactctcccccttgccttcgccacttgtgctctaactcttcgtttcctgtgccctacccttgccgcactcgctcgctctcaagctcctcctccgccggcgtcatggcacggagctccgcaccgctcgacggtagcgtgctgccgccttcccgcatcgtgagcgagaggcaggccgggctgccgcgccgattcatgccagaatccgccaccggccgggaggtggtcgcgctgggcgagggacgcccgacaccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttattggggtgcgcccatctctccggctgttccggtggttcttcaccgtacagccggtgtcgccgccgacggtagtcggtggctgctactttcaaccgcgggggcaggtgctgaaccggtacattctctgcgtncttcngaaaaaagtgggatgacttggaaaagcgantgggtctacaccccccctcgccgaccaagcgcgccctccgactttcgaggccagcccccggcgcaggcctccagctggcgggcgacggtagatctgggagacggctacgacgccgttcttgaccgcctggcgggtctgcgatcccaggggctcacgggggccatggtgttcggcgactaccttcatcgccggatcgcgctgctccagcggcgcgcccggggcgcctgggtgtacaccgggcccgaggactacgtgaggacccaccaggggcgcaaatgggacttggaccctgaggacttcaggatggtggtccaacgggtgctgaatctcagctccgtggaggcatccctcatcccccaaggggtcctccccatctgctgcgatccagagcgcgccaagatcctggccatcatgtaggtggtcggggcgtcggggagcgggccccccgaggccacgatggcgcgggcgggagccgcaggagggaacaatctaccccgggagggggtcgtgcttctgggccccgcgacgggggcccgggggtatccgccctaccgacgcccgggggaagaggaagcaggagggtacccctcccccatctcctccccgagggggcggggcggtgcgtgccagcagcaggcgcccggagggtgctgtgtcgacgccgcagcccgagggggagcgaaagaagaaacggctccgcaagatggggggaccgagccatgccgggagagcctcatctcgcccccgaggtggtcgtttagccgacatccccgcaggttcgtccccgcgcccaccgcgagttttcaaggcgagttttcactcacccgtttctttttgtcttctggtttttcttctgcctaagcgagatcccgtcgcgccctccccgccattccaagtccagccggtctgaggccgaggagacggcgaccgcggagg

SEQ ID NO: 36347 - DNA, 3304 bp, Oryza sativa
  unsure (1)..(3304): unsure at all n locations
nnnnnnnnnnnnnnnnnnnnnnnnnnnnnnnnnnnnnnnnnnnnnnnnnnnnnnnnnntttttcttctgcctaagcgagatcccgtcgcgccctccccgccattccaagtccagccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggctagactccgccgggccggggagtccgtccgggaggcagaggcggcgcgcgcacgccaggcggcctgccaaacccccgacccgactccggccgaggcgacgccgacttccgaggccacccacgacgaggccgcgggcgcgccgctcgggcccgacccctcgggcgacgcttgggacgagccaggttcgggggacgcccccgagtccggcacgtcgatcggcgggccgagccgcgcggcacccacactgaggcggctcttccctctgccttccgctgccccactgagcgcggagcccctcctgcaggccttggccgccgcgaacagcacggtgctggacgggttaagtgcccagatggaggccctgcatgcggagcgggcggagctcgacgcggcgtgggcgcacgtcaaggagggccggcgctcggtggaggccatggtggaggcggcccgcaaggcacaccgccggcacgcctcacagctcgaggcccgtcgtagggacctggcggagatcgccagggaggtggagaagaagcggaagactgccctcatcgccaccgccgtgctcgacgaggcgcgggacgacctccgcctccaatacgggagccgggcggcggagctagaggagaagctcgacgctgcccggggagtccttgacgccgccgctgcccgggaacggcgggcggcggagaacaaggcggcgtcccggcagcgcgaagaggcccttgaggctcgcgccacagcgctggaggagcgcgcccgcgccctggacgcgaaggagagaaacctggcggaccgcgaggccgcctgcgctaaagaggagtccgcactccgcctccgcgaggacgcgctcaccgagcgggggcgaactctcgaagaggccgagcccgcggcgcagcgactggcgaacagcctgttcctccgcgaggcagcgcgggaggagcaggcgcgccgcaatctggaaggcgcccgccccgagagggccgcactggatcaacgggccgctgagctcgaggcgcgggccaaggagctggacgctagaagccacaacggcggggcggtcgcgggccaccgcgacctatccgccccgcttctagccggcgaacacaccatctgcgagctggagggcgcgctggactcgtccgccggggaggtcgaggccctccgcttggcgagcgaggtaaggccccgccatgcttcgggcagcaggcgggcctctggggcgggcggtacgcgaagtacaccgccaaccaggggggcctcgcccagcgcctctcagagatggccggggccctcgagcggctccccgaggagctcgaggagacgatcaagtcatcctcgagggacctcgcccggggggcggtggagctcgtactggcaagctaccaggccagggaccctgacttctccccgtgggcagcactggaagatttccctcccggaaccgaggacggcgcgcgcgcgcaggtccgggattccgccgaccacatcgtccacagctttgagggtacggcccctcggctcgcgttcgccctcgacttcgacgaggagggcggtgacgacagtgcggacgacagcgacgacgaggccggcgacccgggcgcgtcggagtgagcccccaaggccccgccaatcttaataacttttccttcttcttccgaggccttcgggccccctttttgtatagactgatttaatctgcaatcaagtaaagaggaaatttctgcgtcagttctgtttgttgtgtgtataagacgaggatggtctgtgccgcggtccttctgtgtcttggcttgaacaagggctagtgcccaggtcccagcctcaaacggcgcgggtcggggctagtgcctggggagatccacgtgtcgagactggccaggccgggagagcggtgaccgagggttatggatgacccgattgtgggcctttgccgattcccccccggagttcaccacgccccgggaaacggctcggttctgggccccatttggcgattttagccggcccgggccaccgagggcagggtcgagcacgagcgtgctaattcaagccaagattcttcaaaaggaaacgatggcacagacacagtcctcaggaaatcgaaaatgcttttattgaaatacggaagagaaaaaagataagtatatgcatgtggtagcccccggccaaccctgcacgcccgggggggtgcggggttggcccgagcccgagacatgacacccgacccccactaggggtagaagcgacgaaggtgttcgatgtttcacgggttaggcagctctgtgccgtcgcccgtggccagccgaatggagcccggccgggggacgccgatcactcgatacggaccctcccacattggtgagagcttgctcagtccggcacgcgtttggacgcggcgtaggacgaggtcgtcgacgcagagtgatcgggcccggacgtggcactgatggtagcgccgcaggctctgctggtagcgcgcgccgcgcgccgccttcgctctttcaaatagtcgaggtcgtctcggtgaagctgatcttgatcagcctcgcaatacatggtgacccgaggggacctcagggtgagctcagatgggaggaccacctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcattggcgcgctccacttggccattgcttctagggtgggcggggtaggcgaagcagagcttgatgcccatgtcttcgcagtagtcaccgaagagctcactagtgaactgggtgccattatccgtaatgatacggttgggcaccccaaaccgaacagtgatgcccctgatgaatttaagcgcggagtgcttatcgatcttgatgaccggataaagcctcgggccacttagtgaacttgtcgacagcgacatacaaatactcgaacccgcccggggcccgcct

SEQ ID NO: 36348 - DNA, 2316 bp, Oryza sativa
  unsure (1)..(2316): unsure at all n locations
gtatggtctgcagggcctgggccggccgatgggtttgcctggcgtggaactggcacgccctgcaccgccggatcaggtcgaccgcatcgttgagagccgtcggccaatagaaaccctggcgaaaggccttgccaaccaaggtgcgtgaggcggagtgggctccacactcgccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggccccgaggcctggactccgacgggcctcgggggccgttcaggcgcgtccgtctcccctagggggtcgggtcgcgccgacggctgggcaagcctttcctcaaaggcgcccggtggggtctgggctcgcgaggaagcgagccttgagagttcgtcggcgaccgcgttatcccgtctgggcacgtgccgaagctctatcccgtcgaaatggcgctccatatgccgcacctggcgcacgtaagcgtccatctgcgggtcagagcactggtactccttacagacctggttaacgactaactgggagtcgcctaacaccaggaggcggcggatccccagtccagctgccactctgagccccgcaaggagtccctcgtactctgccatattgttggtcgcccgaaaatcgaggcggaccaggtatctgaggacgtctccgctcggcgaggtcaacgtgacccccgcaccggcgccctgaagagacagggaaccgtcgaactgtatcacccagtaggcggtgtgaggcagctgcgaggggcccgagctggcctcgggggcggagacgggctcgggagctggggtccactccgccacaaagtcggcgagggcctagctcttgatcgcgtggcgtggttcaaagcgcaaatcgaattcagagagttcgattgcccatctcaccacccgtccagtaccttctcggttatgcaagatttggccgaggaggtaagacgtaaccaccgtgacccgatgggcctggaaataatggcgcaacttcctcgaagccatcagaatagcgtaaagcatcttctgggcctgagggtatcgggtcttggcgtcccggagggcctcgctaacgaagtatacgggccgctgcacctttcggcggggccaatcctcttcgccaggggccgcatctccagggcgctcttcgtccgagaggccacgcggggcgcactcgcttctgtgccgatgacctcggggtcagagggcgacaggcgcagccttcccgcagtggccccggggccatcctgggggtcgggggcgcctggcaccgtcggacaagcagcggagggccagctccgaccgtcgggggccttgggccgccgttcggctcgggggcctctcctccctgctctctcccgggtcgagtcgacacagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcctgctcagcctcctccgtccaggtaaacggcccggagcgtttgaggagcttaaataggggtagcgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggtggagcggagacttccgaaagtttccgctagatccgagagtaaggtctcttggttgcgcgtcttcacaaccaagtcatcaacataggcctcaacattgcttcctatctggctacccaaagaaattcgagtagtacgctgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacannnnnnnnnnnnnnnnnnnnnnnnnnnnnnnnnnnnn

SEQ ID NO: 36349 - DNA, 671 bp, Oryza sativa
cccctttcggggggcccgcgaagcgccctcgacggcgaggacgtgaccctcgtcgtcggaacgggccgaccccttctttctcctcctgtcccgccgccctgaccgagcggcggacccgggggcggccgaagctgccacaccagaatcggaggagttccaggtccaggcctcctccttttgagccacacggtccgcgagctcaaaaagctgcgcggtggtctggggctccttggaggcgatcttctcgagcatgcggttgcgccgtacgccccccctgaacgcgtagatcaccccgtgtgcggggatgcacggtatggtgttgcggacttgacagaaccgctgaatgtacgagtgaagagactcatcgtcccttcgctgtaccgcatgcaagtccgcttcttcgcctgggcgcggatatatgccctggaagttcatggtgaactgctggcacaaatccttccaagagtggaccgacgcgggtggcaagttcattagccaaccccacgcctgacccttcagggccatggggaagaaattcgccatgaccctgtcgtcacccccggcggcctcgatcccggtcgtgtagatctggagaaactcggcggggttgacgcttccgtcgtatttttcggtgatgggggggccggaaccttggggccaacggacgttcc

SEQ ID NO: 36350 - DNA, 617 bp, Oryza sativa
ttgtctaccgacaaatgtatgcttttttatacatgttccatttaataaaagggttgtggaacaaaattaaatgctaaaaaaagtgtcctcttcatccgtagtgtgttagtttgcagcagagcacatagatgtatggtaacaatgtatcgttgcccatttttttatggtgttaatgcagcccagacatacagggttcaatatcataagaatgttagctgtccatataccatgttttcttttggtgcctaggaaactaaaatataaaatatatttgttatatcttaaaagttccacctgttacaacatatgtaatatatagtagttagtatgttgccctccctagtacaagttatacagtccgattcataaattagaatatcaggtggatggcttgatttgcttacaacaactacttgatgctacaattgtagcactcaaatcttttatgcattgcaatcgcacttaggcctgtatatatatatatatatatatatatatatatatatatatatatatatatatatatataaaccatgcatatatatgtttcaatacatatatatgcatacatatatatatatatgtatatatatatatattatattatattatatgta

SEQ ID NO: 36351 - DNA, 696 bp, Oryza sativa
  unsure (1)..(696): unsure at all n locations
ttgctttacattataaataatgtggtagcgttagaacgaccatattctaagtaaaataagttttactaagtggaagaaacataaagccctgtattactaatctttttaatatacactcaaatcttagtttacatctgctaatatacaatcatgtggccaataccccctaacagtgtcctcctggtacttcgagagaccaccctgggttggcgagatacttacgacaacctgtcatggccgtccaaccggggctacatatagaggagtaccctcccttcgaatttgtcttaggaatatatactaacgtggagaaatacccatactgagctatcaccatcagcggcccacctctaatgtcctgcaacatatatgcccaattaatgatatttaataatctaagcaccatgctaacattactaaatactactctatagccgtgcacccgacatagagcaactgataaattagacattaaactcgcaccattacacctctctggtaggctacccacacaattcatataatgcagatataaagtaagaccagtactaagactaagcaaagcaccgaagatatataaagaagagtatttcattaatacggaaagtattacagaagagattacaagagctgnnnnnnnnnnnnnnnnnnnnnnnnnnnnnnnnnnnnnnnnnnnnnnnnnnnnnnnnnnnnnnn

SEQ ID NO: 36352 - DNA, 190 bp, Oryza sativa
ggatatccactgtcggtgtgctcttcgccattgctgccctcaccggctgcgcggctgccattcctgatgttgaccatctgaaggaagagcagacggagggggtggaaaagaagaaaaacagatgctcaggaactaagctttattatagaggaatttaaactgcaattgttctgatctgaattaaaacact

SEQ ID NO: 36353 - DNA, 748 bp, Oryza sativa
  unsure (1)..(748): unsure at all n locations
nnnnnnnnnnnnnnnnnnnnnnnnnnnnnnnnnnnnnnnnnnnnnnnnnnnnnnnnnnnnnnttttccttgttttgcgtgccagcgtgtagttctcgtcgtttcggaagtccgcggtcacgaggaaaagagttcggaagatcaaagtgaagaagcaaggcaagtcacacattcccctttagcatgttgatcccaatttacaaatgttttactatttgcaaataaatatgcgtgttttgctaattacatgggatcagggtttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattacaatattagaccttttagtatcagaatgagctgcgtgctcgagacatctggccatgcttcatggtcataattatccaactaaaatgcgactgaagggtgggctgggggtgcatggttttgctagtcgcacccatggcaattaaggaccggttcacgggaaaccctggaagaatttctcgtacttaccacaagccagcgtgggcaacggctgggcttgtagtgtagctttcctctagccgacgcatccaagcaagggtgggtgtgatggagcggggcgggccctcgacaggctttgtcgctttccgaattacctaagcaccagaggggattgccc

SEQ ID NO: 36354 - DNA, 429 bp, Oryza sativa
  unsure (1)..(429): unsure at all n locations
nnnnnnnnnnnnnnnnnnnnnnnnnnnnnnnnnnnnnnnnnnnnnnnnnnnnnnnnntaatagaaatgccggagatatgtaaatagggtacaatatgatcaaacctatcgcatgacttgccttgctctcaaactgatgagacctcacttgcgtctatcagagaccgaggatcgacaaaaaggccagattgctacgcgacaaacaaagcacacaatcaaaacatgctataagactacagaaacaggaaacaaatccatttttaatggattctttgcatttttcttgatttactgagactngatggacttaaacggacctaggatgaattacttatgaattttacaagataaactgtgtttttactaataaataaaaagtccttatttaattatggctcaatagggtaccgagctccatttctccctatag

SEQ ID NO: 36355 - DNA, 755 bp, Oryza sativa
  unsure (1)..(755): unsure at all n locations
annnnnnnnnnnnnnnnnnnnnnnnnnnnnnnnnnnnnnnnnnnnnnnnnnnnnnnnnnaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaagttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaagatgtgtgttgatgcatgatggcaaagtggtttcttatgcttcacggcagttgcgtcctcatgaaggcaactacccgacgcatgatctggaattagccgcacttgttcatgctttaaagatttggcggcactatctcatcggtaaccgttgtgaggtatatacagatcacaaaagt

SEQ ID NO: 36356 - DNA, 512 bp, Oryza sativa
tgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacgagaggctgcgcgacgactaacagatgcagtggaagcctcctctcagggcacg

SEQ ID NO: 36357 - DNA, 69515 bp, Oryza sativa
  unsure (1)..(69515): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgcggtgacaagtttctgaacacatcaactgtcacatttggagcctgaggatccaaatgaagaaatgggagtttgatggtttccctcaaagcatctaaagtctgtccagctcgagcaagcctatagatatggagaatagcttcaagctgtctcagtacagtttgttgctcagatatgaggtccttgtcttgaacactgtaagaacgtttccaataaattgatcaaaacacagctttaaaaagcataaaggattaatgctcaacttgtgaaaaaacagaagaggataataacctggcttccgaatatctggcagtttccataatttcattaccagaatgaattagagcagcagcacgactttcaccatctaacatactgcgtgccatggcacatattgcatccgacaggcacttatttattgtctgaagtgccatggcaaaagctccaactcttttatgaatttccactgactgagctcatgcagagcgtaaagtgatattagacggatatagaacaactcaacaaagagagtaagaccaaagtgcagaaaacatagacatcttcaaattcatatggtaaatatctacttctgtaccatgtagcttgccatcaatagtttataaaattatagtcaacggttaaaatgcacgcacatatatcagatttgatgaagcatgtgtgatatgtcctacatgtgacaatcaagacgagtttttactactactatcacaagaaaagagcatttacttgtttacttactttgtcatagaggcctgcctcatgacactgatgggcagcttcaagtaagaattgctgcctgcttctccaatccatcatatacttctttaattctccttcttcccccattccacttggaccaagcaaaagttgaatgccaccatcccttagtaatatctctgtcagcagttgcttcaacattagatttcgctgccgctgctgatcagcattccctcgaccaatccatgatacctctcctccacccattgcagcagcagactgtgcataatactccaaggccaaatcaaggttaccattacgcaaataaatagagccatactgccgtattatactggcagcttctgcacaagcatccatgatacccatcttctggcctgacccaacaccatcagggagaacaccatgatcagataaagcaattgaaatatgcacagcatctacatggtatccttcctctccaacttctttagacaaataaagaattgctggaagcaattggatgcttaacagcagaacatatggatagaccaaggggtcttttccattctttgtataatatgatggttcaaatttgtttaagtaactttgcagatcctccagagtataaggcaccaagccttcatttgaaacattagaagaagatgcactggtgtactcccgcagagctgacaatttgaaccacaagaaatcctctatagtattgaaaagtgttggcagatctttaagcaatctgtcgatttgacgtcgacaaccacagatcatggcataaaggagcaacttcttcctatcataaccaggacggccaggtcgatcacccattctcagcattttgtcacattcctcagaagctgtcagagcagtctctggggatacagcaccattagtagtaatccattctacaagctgcaaagaacatattatttgcatgtatggtatcaagaacaagaactcatcgcaatttatgacatgtcaatagtttaccaggggagcaaagttgaatgcagcacgagatgattgggcaacttgtcttgcctcatcatagtatccggttctcaagcagaaataaatctaaaaaaatgtcaaacaataatacttcaatgttagcagtacaagattaacaagttacatgaaaatcaaagagagagaacattccatgaaggcgcaactgagaaatatttgttgataaattagaataaagcacatgtacccacagaaaactttttatgcatcagatatggctttactttagagtattatagcctacacttgaataaagtaagtcatagaataagccgaattgacctagcataggaatgataccatgaaaagcctaagctagagttgaaaaataatgaataataaaaacactcatggccccagtgttgcactatattcaacacgatgttctcataaaagctccagtattcttcagttgctgcacttactgtattttggtggcacggttttatttgaatgtaaccaattgttttttcatgattttaatatgccattactagacagattgaaatggcaccaattgcaattttgtgttaaatacccaaaactaaaaagggaacctgttgccatgttgtgtccactggtggctgtctacgcagatcagttgcatcaaagtctagcacaccatgatcccgcaaacggacctgccagtcataaggacaaagatgcatgaagctcatgtagaacccaaattgtacagcatcatttcacttgaaaataaaatgatgtacagaaacaatgaaaagggagagaagcatcaaatttaaaacatacccgaagaaatgcgcgaatcttctgaagattgccaacagatccaccaagagcagcctacaaccataaagcacaatcacagcttaattaagatctattgatacaacagaaaagctcttgcatgagtaggtttcctaaaacataagccacatagtaaagtgagagtagggaacatcatttgctaaaagactaatggaagatcacaaccatgtgttaaaaaatcaaaaaataatgaactattctgagttgctcactaacattaaatattatcttccataaatatgcacaattggtagaaagcacatatcacatcacaattcaccttcaggacattcaagaaagaaaattaatgctcaaaaatatgaactaaggtgacatgacacaaaagagtggaatacccataggcaacataagaaaacaggtgtagtaactctcaagagttcagttggatcaacaccaaaattattgtcagaatcttacatgttatattctattttcataaggaattttgaaagaaatgtcagaactaaaaagtatgtgaaaatactcactagagccggatggctattgatggtctcaagtatgtacttttcatgaccccactcaaggtgtcgtctagcaccaatcactagtgacatttttcttgaaatgtttcgatgagttgacccttccccaactaatgcctgaataagacaaacaagaagcaaagtatagctatgagggaataatagataaggatatatcatatatattggatggaaaagggccaacagatgtcagcatgagtgctacacaaaaatcaattttattacctgaattaaatgccacactttatgcatggtcactgattttgtcccaatagcaccaacagataaagactcataagcagccctgaatgctgtagcaggctaaccaaaagataactttaataagcattagcagaactacaagtacatcaatagaatttgcttatgctctgatgataacatgtcgaggctacataaaaaaaaaggcacttgatctatttctcaaattaaattatttggagaatagaactatggatagcaaaaaccacaaattcaatctataaatgaataaatgtccatagagggactaagtaacatgttgaatcatagcatatgagtttaacacttacaccaaaaggtaggctgcgccctctagcatcattaagatctctcacaactgcagcataaactgaagatttgttttcaattatagttttgttaggtatgggcatgacttccttagatggcagaccggacgaagattggggactggaagctgaagatggcatcagagcaggacgagaaatcccactggccatgagattagtgtttcttttcggtaatgtagagagtcggcttagactctgcaagaagtctcgcttctccttctgccaatcatcctacaacatagatgttatataagttgagaaccaaaccgtaaaataatttgaaacattcaccactgagcgacataggagtacaagaccaatataacactgaaaaatgtagacatcttagttacctgaaatggtagtactgtactgttcaattaaatcaaatcacaagttcacaaccctatgacaactgattttgttttctaatgtgcaatgcaataatacatataggtaataacatatacaaacccccagatgatacagaaatttgccgagaaacttttaacatataccaagatgatataagaaagtgcaatctgaaaagcacttcccacaggcttgcaacaactaaaccagatcatatatatatatatatatatatatatatatatatatatatatatatatatatatatatatatatatatatctactactacttaaaaaataagaggtgcttccatcgtccgtcaaaaaaaccgggtgaaaaaaaaccggaacgaatccgattcatcaacgcggtgaaagaaaaatcgggaaaaaaaaagaatatgtccgattccacaaaaataggaaacaaactcccatctgttataccaagtcctattcggttagcatcaccaggagaaccgacaccattcacagagagagagagaaagagacgacgccgccacctctcccgcccccgtcggaccgcagccgcctccatgccgccgaatctggcggaggcgaggtccggcccgccgcccctcccacccccgccgggctgcagctgcctccacaccgccggatctggcggaggcgaggcccaaccagcgttccatgacgtccgccaccaccaccactgccgcacctccccaccatgcacagagagagagagaaagagacgacgccgccgcctctcctgccctcgccggaccacagccgcttccatgccgccagatctggcggaggcgaggtccggcccgccgcccctcccgctcccgccgggccgcagccgcctccacgccgccgttgttcggggagagggcgccgcgccgttggttgtgggggagggcgccgccgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaattataagttattgaatgtgtttatttcgaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtatatatatatatatatatatatatatatatatatatatatatatatatatatatatatatatatgtaatgaagttagcagcaggaaagggtaaacaacctcgagaacttgcatcatataattgttaaaactccttaagttgtccttttgtgcttcttgaatggatgagacgattgccatttcatgaagctgaaaacacatgacatgtttcaggatatattccatgaaattaggagaaaatgcatgtaaaagatgtatgacggtatgaagtgtgcacctgctgcaggtactcctcgacagtagttgcttcagatggaaaaacatcctcaaatgtggtctacaaaacctcaattttaatcactatgatgtatattcaagtagtctagcaagatagagtagaaaacagaaaatatacaataagaagctgcagattcacatacagcaacagagttgtaaatgtattaaggtatactgatgaattaggagtgaattttagagaatgggacatggggcatacatagtgaacagtaaagttatggtggatatataaggtgaagtgcgaaaaatcgtgcgctgttattgagtaatgatttccggtcaagttttttatatcaagagcccgctgatccaagcaaaaaatagtagcatttacccaataggaaaggactgattcttacactattattataatgaatacatgctatcgttatattagctgcatttaaatacacaaagagaacattgcatagataaagcatagaaatatgagctatcaatttcttactcaagtagataactgtatgttaagtttcttctacaatttaagtagaaaattgaacgctaatctggagcagtataattgaaagtataggaccaacgagatcttgctgcacctcgaactctagagtcgtttcttgtttcaacatagttcatgggtaactatttcaccaaagctagctcacagatactaactaaacatttcgtcaaaactactgaactaaactatttactagtaagttaaactgctcttccaatttaagaagacatgatgtattggtaacaaacaccaaactatcatcttcacttcttcatttgaaattgtaaaggatgtttttcaacaatttggtgcaaggaataaaacatggcaatgcttatgacttgttataattttattacgttttaaccctactttgtgataaccctaggttttaaccagcagtacagtaaaatgtctaatctcaaaccggacaaactgctcgatctgataatcagcaaatgagattagtataatatcactctatgaaatgggatatccctcgccggccatcaccttaagttcgaaggatttgaggtccctggcgagctgctccgcattgatcccctcgcgcgccaacaacctgcagaaagcaaagcccaaaaccctaagtcccccgtaaacccccaacaaccgcctacccccgacgaacccgacgcggagaaccgcgctgcgagcctcgccgaggcaaatcgaaggggggctccggggagaagacaccgacctggtggcggagagcgactgcacgggcgcctcggcgcgcaccgtcttggccttgagcttggtggagagcacctccagctggtccaggttcctctgcgcgcggggacaagcacacgggggaacacgtcaggcggaagaagctatggcggcggcggaggaggaggaggcaaatgccggggggaggaacgggagaggaaagcggcggcgcacctggaggggagggaagtgcggggtgggggcggcctgctcgaggagcttagtggaggagtggaggagctccgaccacccgcccatctccacgtcgccgccgccgctgctgctgccgccgacgccggccatcgccgccggggggctaggaggagggtttggttggtgtcgtagggcgtggtgcggcggagcggaggggggagtggagcgggtttttcctttttcgggggtagggaaaagagggctttgttcttgttgtagatgggcctgggcctaccggctcttgcgaatttgtgcccgattcaggtcagatcggcccatcttctcttctgcatttttttttaattataaattgtgtctatggtatacgaacttgtgtgatggttggaaggctgtgtttagttccacgttaaaattggaagtttgaagaaattaaaacgatgtgatggaaaagttagaagtttatgtgtgtagaaaagttcaatgtgacggaaaagttaaaagtttgaagaaaaaagttggaatcaaaacaggccctaaatcggtacaataacatgcaaatcgtttggcccggtaaaacaacttgcttcgtcagtgcgaattggggtcaaatctcacagtgaaaattcacttcacgtcagtttccacgtgacacagttcgattgcatattgcttttctcgaatgcgtctattcttgtggtggttgtggcataaaaactactccatccgttttaaaatatagcaaccttatactgaatgggacatatcctagtacaacaaatatggacatactcatgtgcaagattcattatactaggatgtataccatccagtataatgttgctataagataattattatgtaatgcaaaactagaaattaaacatcaccaaaaaaaagtttgagattatttgcaaaagctaccagaacagatgaaaacaaatggaagcaagctgaaactaaattgtgctgcatggaaaccaagtcagcgatatatcagttcatttagattgtgacacccgatttgtcctgaatcttgattcgcatgaattcagcaagttattgtatcggattaaacgattcgcaagttgttataccaatctatacccaccacacaacgcaagttagtgtaccgtggtgtgtaatttactactccctccatcacaaaatgtttgacgccgttgacttttttaaaaatgtttgaccgtttgttttattcaaaaaatttaagtaattattaattattttcatatcatttgatttattgttaaaaatatttttatgtatacatatagttttacacatttcacagaagtttttgaataagacgaacagaagtttttgaataagacgaacggtcaaacatgtttaaaaaaggcaaacgccgacacgcctgctcactatgatattgtgaatgtggtgtatagcatatgcgctcttaaagagatgaagatcagcaacaaataactaaccttgctagattcttaaaattcttattgaaagtagactgggagtccgcattttcgtttttgtttcatttttgaaaagcttctgcatgctactacgatgctatcaggtaattgacagttcacctctctctcataaaaatgaaatagttcaaactatcatatcaaaaatgttgtgtataggttgacgtgaattcaagttcaaattaacaataaactttccccgagaaataagagcaatgattcattctaaaagaaagaaataatattgattataagcattaaaggtgtaccatctttgctgcagtacaactggaaaattcaggtcaccatgcaacagaccaatcaaaacacaagatttgctttggatcgatgaggaatgattacacaggttgcaattgaagaaaggtgttacaatggaaggggatgtcctgaaatgctagagatctaagcttccactcaaatgaatctaacaccaaatgcaccagggctataagaattgaaaaacagaacctaatgtacacaggtaaactacctgagctccctccacagcctatacaaccgatgttcgaaaaataatccaatgacaataagtcaagaagaaatcaagttatcatcgcatgcctcgtttgcgaaacagcgcatggtagctgctgaggagtattttctccataactgaagactctgtctataaatattactcttcagttccttttccttaccgagcacgggcagtggatggttgttttgatgagcggccaaacttgtgtttccatttctgtttcccaactgcagagagatcagccaaaggaccggaccaagtaggaacagagcttttctcttgtgtaaatacagtgctaaacgaagagggatcttggggttcgtataacgggtccatgtgatttgtagaaaccaaagagaccgcaccatcctgatgcggaggaggaaacttttcactcttgctttttgcatttgcatgtgttactaatctccttttctgtaagatataaataaatgggacaaattagagacattgcaaaatttacattaagagagtgccgggctccattttgggccatagtaaatcaaatgagaccagtataggtaagacaagaaaataaagtggtgataaagtgttactgcgacggagatgagactaagcaagtggtttcaccacctccaccttaaatttagatcgctagcctagtctttaagtaaaacagctcaaagaaacaaaaactaaaacactactggaattagtcagggagcaagtatgttcacatacatcgatatttatttgaagttcagcatttgcctctggagccggtactgccctaggtcgatcgcgcgtctttgtcttcttagctccatcattagtcctaccgccagcagctctcaaactgttgatcatgccatgaataggtcaggtagcaatcaaatatttctatacacgctcaactcacatgagagcatggacagaaaacatgaatcaaacatcaaatatactaggatatgtgggcatttggatcacttagtgagcaaaaattctaaatagctgagcccagatggtgagagactgactatcagcccaacgatgaggcatgtgtcagacaaattctgtgaaatccagggacattagtaccacagcagtatgtctacttaaagtttcacctaaatcagcacttgcattgcactaaaattacatttgggcaatgctttcataatttgattatatataactttgctgcatgaacattgtgtgccatctctttaggatatatttctatgctaataatattgcttacgggaaaaaaaaacatccatattaataccaaatatcaacaaacttttggtgaactttactgttttagcacttattagtcattttcttgtaatccgacaaaagagagtggcttccattctttttataaaaaaaacaaaagaaagagagagtggccctgttatctgaagacagcactttgtacaaatgtttctttcgaaaatagtgaaattgtttttagtttattgaactattccatatgcatacccaaatattagaataaatacatgttttttcttgtcgtaggtattaaacccgagcaagcactcaagtatccaacctaggtccccagaaaaataatgtgccatttgataagcaacagttatatgtttaaagttaaagatgctatttctcaaatgccaatttaaaaagaaagtgctacaaccacagagtgtccagtactagagagacagccaaggaccaaagcgaataacaaacaaataataaaactaatgagtatcaaggtgacaaaccgtctggcttcttcatctcttcgttttgcatccatttctttgcttggaggatatgctgggagacttgatggttcacatgcataaggttcagttgtaaagaactgcatagattgtaataagcaattctttagtaaaagtgtaaaacaatgctacataatttcaacaaagatgacaataaacagatctacttcacacattatccagtgagatatgtcattcaaaccaaatgtatgctattgaaattcgaaaatcagacttgcagttatagagtgctactatagcctagattgataatatctggtaggaagatgcttccatgctctttataaatcaaaaaatcatactttattaagcaaatagaaggcctaaattgcagccacctctaaataagatacaatggtccaaatgagatcacaagcatcatagtgtcatattgcacaaaagaattagtcatgtcatacttcttggaatatgggataggatgcagaaaaaatatagtggtcataatgcttgcaagtaaattattggatattggctaaatctacactagtagctacccagaacaaaatctagccaaagcaccatgttctgaaaccccaattgcaaactaagttattgcaatgaaaacgtaaatcacctacacccaagattttctaaaaatattgtgcttatagagggcaatgactttgaggcaaacacagaatcgcagatttcagaacttcaaactgtgtcgtaagacaccaaagccaacttacatcacttcttaatgcagaagtcgctgttaaacgatcagctggatcaattgcgagcagtgtttcaatcaatcgcagtgctgactgtggaaaatctttgtaagtctctgatattcgccttttgtatggttgttgaggcttaaatattgttgcatgaggtagcttggactttttccaatattcttctgtgggggagccgcacagcttaaaaattttatgcagctgttccacctaaaagggacagatgattattaaattaaataaacatggaacataaatacaattggcattcattagattggctggaatgaacaacattacgtgcatgaacagtgcaacaggtcatattggatctagcataatctcaagtacgaataaaaaatatagtacaaaataagggttcctttggaacacgggattgaaaaaacgaaggaataagaaagtcacaagattgcaaaacacgggaatcagatgagtgagatagaatcaaaaagaaattttccaagaggttggagctcttgctaattttcctccgaaatctccataggattgtacattccataggaatttcaaaggaaaagataggatttaatcctttgtttcaaatgccttcctaggattttttccaataggatcgaaatcctccatatttcctatgtttttcctacaaaccgaagggggcctaaaagtgtaatacgttgaacatgtggtactacagataaagttagaacttttggtagagcaacgtttccagtttccacatgaaaagctactggttttatcaaccactatgtttacctaaattgaaactagtttagcactccaaggcctccgaccaaattgaatactgtttcaaggcatttcaaactgataattagacaaatcagcatgctgttgctaacctcagtacggcctggcataataggcctcccagccaacaactcggctagaatacaccccgcgctccacaggtcaacgcccaccccataatccgtggagcccaaaagcaactccggtgggcggtaccacagcgtcaccaccctgctcgtcatcggctgattcttgttgggatcgaacaacgacgccaggccgaaatctgcgatcttcagcatgccattgttatccaacagcaggttcgaccccttgatgtcgcggtgcagcactccattgttgtggcaatgctccagcccggacagcagctggtgcatgtagcacttaacctgcatgtcagcatgccatggaaaacctcaattaatttcacgacattgcgtgctggaacatgaggctgcacaaagatcttggcggggggagacctgtggctcggtgaagctgatgtcggggctggcggcgaggccggcgaggtcgtgctccatgtactcgaagacgaggtagaggctgcaggacatgcgggaggtgacgaggccctcgagcttgacgacgttggggtggtggaggcggcggaggatgaggatctcgcgggccatgaagcggacgctctcgggctccaggttgtcgaaccgcaccttcttgagcgccacgatcttgcccgtcgccgtgtcccgcgccttgtacacgttgctgtacgtcccctgcccgatctgcgccaccgacaacaccgcgcgctgttgatgagctcagctcgcgacaatggcgagcgcgagggcggggggagctcgtaccttgtcgatcttctcgaaggagtcggcgcggcgaggggtccagccgtcgatggcctcgccgacgacggcggagagccaggcgggccagccggccgccacctgctccccgcgcgccctgttggcgaagctccccccgagcccgaggcgggccgcctccgcggcggaccgcgacgaccgtgcgcgcctctccctcctggccggcttcggcggcttcttctcctcctcctcctcctcctcctcctcctcggccgccgccttctcggcggcgacggcgggcgggggcggggggtcgggctgctgggggtggtcgggggagggggcggaggggcggccgtggacgcagcccatgggaggggaggggagtcggggggtcaccggcggcggcggcggcgcatggggtggaggcgagtggggagtggggagtggagtaaagcggaggagtgaggtgtgggggaccgagctggatgcctggctggcttggttggctgggctgcccgtggaggctttgactctctcgctcgctcgctctacgtgactctgtgcaagtacagtgtcagctcagctgtccgtgccgtgcttccaggcctatttttttcattcgtaataatttattattatccttaaattaaataaatagtgatccatccgtctcatgaggagtgtatttttagttttttgatacgacgtttggattttcgtcttatttaaaaaattatgattagtaactttatacgtaactatttttttaagttttttttataattttttaaaataaaacggacggtcaaacgttggacagaaacccaaaaatatgtttttaggacgttggacggaaaccaaaaatatgttctttgtaggacggagggagtaagtattaatatggattttcacaaacaggatggacactgaacgaacgatgtccaggtgtagactatctcatgaatgacaaagggtgtccaggatgatgcggcctttgactagttcagtctatctgtccggtcgccccatctacgatctatgatgaaagaagagaacacgaaaaagtaatgaaacacgttcctattgggatatgtcgatgtggggctataattgattgggtgtcgcgcgtgtccttttacagatccgccttcagtaacgtcatgctgctatcgtaaatttgtacatacatagtgaataatatgatctagctttatccttcatgccttcattcatgcatggcagaagacacttgcaatataagctagcccatgatgtgctcatgagcatcggtcaatctagtcggcatccgccaatgatacaggtggatgtgaaaaatgaaacctatctacatgcaaaaaaaaaaaagaagtgcagtggcaagcctttgacgatgacagcgatgacgcggacggagccatggagggcgtggaggctgccacgactggagcgctaataaacgcactatccatatatgtcggacgtggaagacatgtgaatggttagggcaagcagccactacatgacttgcttgtgatcataagtatgttcggttctgaattgtttgtgatacaacaagtctgacccccgccatatggtggacgccgtcgacaacaacgtccacagcgggacgaaatatgtaatagcatccaagactagacgttgttcgtcccagtatccaacctattttttaaaatgaaaattaaattactatttatttaattcaaggattattatttattataaataagaaattcgggttttgaggtgaacaattttattttctaaggggctaaaatcgtattacttcatctattcgtaaaagacaactagcagtacaggacacatatttgctgacctcacttaccagctagatcgatctaggaatctgaaaggacacaagtttcacggtaatgtgtagcgttaagtacctgggaaagacacaaagaggatacatcctccacaatgtcgccgcacacctctctcctcacagcgcacgccctcatttcgcttggagaatgagtatcccattttagctccatgttcttggcatggaaatggtagatgcgaacatggtgtggaatattttctacgacatgctcaggcaaaatgacacatcgacgcattgtgatgcccaaaataggagtataagcatttttaatgaggtagcaaaagtcttctctctttttaactagaggagtagaagtaaaacaatagtttttggacaccgtttatgtaaaatattgcttcctttaaccgtaaggatgtgcataatttttcatttttgaacttttaattgggtaaaaaagctatatcttttgggaaatgttaaatatgtttaaaaaatattaagaaaagttagtgtgggattgattttagaaaatgaggataattattgatgttgtttctttcctccggctgtttgtttagggtatatttagatccttggtaatttttttcaccctgtcacattctaatgtttggacatatacatgaagtattaaatatagaaaaaaaaaactaattaaacagattgcgtgtaaattgcgagatgaatcttttaagcctaattactacatgatttgataatatgatgctacagtaaacatttactaatgacgaattaattaggcttaataaattcgtctcgcagtttacaggcggaatctgtaatttgttttgttattagactacatttaatacttcaaataagtatctgtatatccgatatgacacgacaaaaaatttcacccttaatctaagaacagccttagccctcctttattcatgagacaatggtgattacgagctcctatacctcctactactagtagcttggtgatgtgaattgatggcagcatcaaaccaggtgaaggtggcatggactcacgcgtagctcgcccttgagggcttgaggaggcaaacctgacttgccccttctttcttaagacccaaagctaatatatgtggttaagtcacgtcacctcaaattaccatagccattagatgaaatagcaacagtttagattgcagtctctacttagcttcccttccattaacagtagcccaatatacatgggcaagcccaatccactgcctaggcccaattcgcccgttcccactacactgccgagcgtttccatctacccgcgccacctgaataacggccgacgcgccggctccctacctcccgcgcgcctccccgcctcctcgaaactgctcgcctccttggtatttggagagacagaaaactaatcgtcgccgcacatggagtaaaatttcattagaaaccgtcttccacagcataacagtcttctcgcattacttcgattggtttcctacttcatctccgtcactggaaacggcctctccctcccatgaaacctggagcagcccctcacctttaagaaatcacacgagtatacaatcttctcccaaaggtctgcttcctcctcttcttgaatcacatatatgttcattcaatttatggcctttatttctttttccatggacgctagatttatttgttcctcttgccactgaagttatcaaagaatagaaaaacagacagatggatttggttttgtcccttctttatgtttctactagcaagattgaaatttatttggtctgtatacttaaaggagtcaattcatggtatttataaggtttctactagcctgttcatggtatgtaaaccattttttcaactttgctgtacctataatttgttgtgtttctaaactcctattgcagttcgtccctacacctattgcctactatcattgtagcagcagctatgggctattactgaggtcagtacccataacattcccatccaaagcagcgactgattgggtttttccatatgattcctctatcaagaaaatatcccaatatattggtacctcatattcgttcatggtcaccggctttcaagatattattatatgatcatcctacgatatcttcttttcaagatattactaagcatttcttctgtaaaaacaccgtcaggattttcatgtatatactatcatagattgcaagtgcaaggttatgtgtgattattttaacaatgaacttaatttaggtacatatattggttcctggatctgtgcatgctatccttccttgctatatgatgtttctactttaagttcagaattgtaagctacagttttgtgattgatgtaactttattcttcggattttgttctgtctgaggtttcaatgtagtccaagaatgtaaatcacatcagccaatgtgatcaaccacaaaacagaaatgcccttgatcgccatcggcagtaatgcatataataatttgattatcccggtgctcaaaactttttctcgccaacttctagatctcagattttttccaaccccccatatggtaagtttattgatattatggtcattaatttctgtttatgctacatattgctttctccttgctttccggagtcatccgtcagatatcacattttctctttagttcattaaaattgtattaaggtacaatgttgtatcaggaataatttcagttatatatctgtttagtcagtaaaatatatatgtggtactcaagcatgaggtaaagctgaccctttcaaaacatgaaaatatttcatggaattgcactttgttttgttgttattgcatatgttctacatgttgcaggcacctactttttgtgtcatcttaacacggtgtttcatctgtagacttgctacattgctccaactccacagatcaaagttagtactttagatggcagcttaattagttttaaggcactagccctagagctaaaaaaataattacagtttaatctgcttattccacttagacatgatttataatataattcacttaaaaaactatttcctttaataatctaatctatatatgcattagattataccacaacatcaccaatcttttgcacccatgaatggtactttgatgcttcagactatcacataatatttctgtactatatgaatcatgtatttttcttattacacaaatgtacttttgatatagtttttaagtttacacatattgcacatgagtattccgcagcaacgcgcggggtatcatctagtattctaaataaaaggtgttaattatctcctgaggtcatactactcttttttttaacaggccaaattatccaataaatttagtgggttacatcccatccaagtgcactttcaagtcaacatagaaatctatttaagggcatttagttttgtgcaaatacaagcaatccggctgagtttgaaaagcaggggatcgagaagatacgtaaaacgagacgatcaattagcacatgattaattgagtattatctattttaaattttaaaaatagattaatatgattttttaaagaaacttgtctatagaatttttttgcaaaaaatacattgtttagtagtttggaaaacgtgcgcgtggaaaacgacgtgttttctcactcaatgtcccctgaacgaacgtgtccgtgtaggagggtgaagtcttactctaaaccagcggcttctttagaacaaaagaaatttgtatggttcaaatcctataataaaattcatacatgcccatttgaaacaaacgaatagccataccaaaatcatacgaaattccttatatttcctcaaatcataagaattttaaagggttttcaacgtaagatccaatctcttgaaaaatccaattgtgtctaactcccatcagatgacaagacttatctttgtctatccatgtgtttctaaattcttacgttccggaggaagctatatattttgatgcatctctatgcattcagcttttgctgttagagtgcgtagcccggcccaccaaccgtgagccgtctaggtcacattgggtctgctacagcataggcctaaccggagccacaactttaggtcttgtgtctacacaacctaaaatactagtctgatgggtaaggactgcccacaccttttaagtcgtgctgtcccatcatcaattaccgatgtgtgactaaacccaacatttgcagccttgaaaaaagtgcatatcaaccatttgcttttttttctgttctgaaataaaccaacctactccctccgtccaaaaaaactcaatctaggaggggacccctcctagtacaatgaatctgggttgagttttttttaacggagggagtatgttctgtctatagcagacttcctttttctgctctaaattttattctttttttttttttgccttttgagatattgcgtttgtcattcatgtgtatcactaaacaaatctaacctgccacgctcctgttgccggtgttcgagaaaagcaagaccacgaacatgttacctacaatagaagtagggttgtgtttagttcaacgcaaagtttagattttagtagaaattagagatgatgtaattgaaaagttgtgtgtgtataacaggttgatgtgatggaaaaggactgaagtttggatccaaactttagatttaaacacagcctactacgaggacttgtgcaagaaaatgtttctgaggtatttgtcacatgtcagtaacttggacttgtgcatttcgaggtatttgtcgctgagaaacttgttacatctgttcccttgcaagaccaagctgttaagtctagtgccacaatatacggctgtcaggcaaagcagttcacaagtaaaggctgtgattttcatcatgcagttgcgtagttgcgtcttgcgtcagacaaaaaaaggctgtgattttcatcatgcagtgtactggtctgctttaaaccaacaacatgtgtatatgtaaaaaatcagttactattggaacttcgtcgatattagagtcatgtagcgaatctacttactattaaagtaaccgctgagataggactcttaacacaacgaattagataggtcctcccagtacgtagtacataacaaatccaaacaagaagttgtctagattcattgtattagaaatcttatctcaagctcggttgctttattttggatgataagggtaataactttcatatggacagtgacagttcacgcatgggatgcttaacaagttgaacctactgttgtactctaaagcctaaaaggcagtagctttttctaaaattgttgtacggagggggacttctgcactacaatagaaagttgttatagctaaaaaaggcaaaacacaatcgagttcactgatgcacgttaatgataaagatttagttagtggtgtactgatctaatgcacatcaatgataagatttagttagtggtgtactgtatttcccgggtttggtttggttacataacatgtgcttaagttgctgtcctgcaagcttctttttgaaacataaggcggaacttcgttccacttttatatttagaagaagagaattgacccagtttataaggataaccggacccgaaaaccatacatccgcatggttaattacaggaaaaccggctaaaacccaccgctacactactaaccatgatggcggagcccaaatgcaggacgtcgtcgccaagctaaacacaaaagccacccaacagctcccacaccgcagaagaggtgttatcgttgccgagctagccgcccaagcgacccagcagcgccgacttcacaaccacagcgacactaaagccatgaaagtcgccaaagcaaaaagcagctccgacatccaacaatggacatcagccaagccaccgaggagccacttcctttacacggccagcaccacaactcctaggaagagactgcaacatgtcatcgttgccaggcgtcaccgcaccccatcagcgagtagctccgacttcatctgcagaaacaaccaaagagcgtgacacccaccacgagaaacaaagcggacccaagaaggcgaaggcctcgccgaacacaatgtatgagagcttttgaaccgaaaaggaccatcaacagtcgtcaatgtgttggaacttctccgaagcgacgccccaaaggaggacacgacgtcgtaactccgccgccgccgctcgtccgaagccggaacaaggttttcacctggagatttgtgggggatatgaaagaaacgccatgacaacgcctccaagaaggaaaacggcgcccacgggcgccgtcgtcgtcgaaccggccaaaggcacggcaaggctttcgccgacgtcttcgtatcacccacacaagcacccccacaatgacggccacagaatagtccatgacgtctcacaagcattcatacctcgaccataacggcaaagacaggccctccggcgcggaggcgacggaactggtcgcggacggccagatccagccagggcggcgcaagccggctcgacatccgcgccgctgcagctccgtcgtcgtcgcaaccaccacgccgccacagcctctatcgccaccgctgtgaccccgcgcggacggacgccgacgccgacgccgcgaccggcgcgagcgagccgccgctgcccgcccaccgtgacgccgcccctgcctgccaccatctccgcgtcgtctccagccccgttgctgacctcccgtcaacaccgcgacctcggcgcaagccgctgctgcccaccgcgaagccacccctgcctgccaccggtcttcgcaccctctccagccccgacgttaacctctcccccgccgctagccgccacctcccagcgcctcgcccggcccggatctggacgggaacctgggccgccggtgacgggagcgtcaccggcctgcgcgcgaacgtcgtcctcctcgcacgtcgccacttccgccgcctcttccgcgctcctcgttgagcgtgcgcctccttcctgtcgccaccggctgagacgcccgatccagccgtgtggggaccggatccggtcctaccgacgccggatctggccgccggcgaccgctgcacccgcgagacctctctccggtcatggcatcgccccagccgccgcgcctgcgagaggaggtagggagcctcgccgccgctgtcattgcgtccccccggctttgccggcgggcgctcgagcggcggcaaggtggaggggagaagaggaagaggttggcggcggcgcgctcgtctggtcgccgcccgtgccgccctggggctgagcggcacgagggccttctcttaattagattatttcacggaaatttttctcctgcaagcttcgactccttcgaaatacagcaataggaaatacagaaataaagtatcgtattggtcgaagcctataggaaaatttggtaaaagacatgtttagctactgcatatgagaatcataggaattttgattcagacgattaaaatagacaaaatatatcagagcaattccaataacatagctttgctattagctccaataatatccacatcaagcatttaagttaactagtaagagtagtatatatacaatagatagctactccatccgtcccaaaatataagcattttaagagttggatacggttattaagaaagtagttagaagtaaatggtggagggttgtgattgattgagtagtggaggtaggtggagagttgtgattggttgggaaaaaaatgttggtggagaagtagttatattttaggacaaatcttgtattagatcatctacacacgtatccgtatgcattcattttttttatttttcttttagtctgttttttttcgggtcatgcttatcctgtccactcgttcttttcgagaaggaagcagtagcccaatgaaaaccatgctgctactagtctttgatcaaatgtctgaaatacttcaaaaagtggatgaatgggagaaattttgaaacatattcttgtagtccaacgagcttcacagaactatattattttataggatttcaatcctttaaaattcctataaaattccatggtcataagagcatccctagcagctcatctatattctatcctccatatgcctatttgaatggtcctacaaaaaaaaattctcacttcatatttatttttactccaacagatcattcatattacatcatctatcctatattttactattatctttcaactgccatctattttatattaactcttctcttctctcttctactcatttctcaactcttctcctctctcgccgaatccccttcacctccaccacccaccgccgccgccatggcctccgacctgcttgcgccggagcaccaggtggcggggcactgcgcgtccaccgacaagctggcaggcgggcaaggggcggcggcaaacgaccggaggcgggcggaggagccgcggaggaggcaggcggcggcgagcgggcggcggtgtcaggcgagcggcggggacggcggcacgggcggctagatccaggtctcctcccctccgctcccctcccctccgttggccgacggcggtcgaacgatcccctccgctcccctcccctccgttggccgacggcggtcaaacggcgaaggtagccaccggtacgtcctctcttctctcttccttcacccttcatgctcgatccaaatgggggcaggagaaccggatgagagcgggcgtttggggatggcgtgaggagaagcgccaaatttggcacttctctctccgtgtttggcgatccgccaattttggcgcatctgatggagcctctgctagagcgatgtttttcccctccatgcaccaaaaacgggatggtggctctaaggaactcaaaagttgagccacctatagcgcatcatgcatactagacggtactgccttggccagcaatctacagtcttaacagatatacaggaaataccaaagaccacttcaaattcagaagaaagaacatgaacttcactgtagggaagtaagaacctgaaagaccttaacagccattgcaatattgcacgaacaagaccctcccggccaaaaggaccaaaaatttcagttcacatagaacgagcaagcacgacatgtttccctattccaaaatttagtactactaggtgcttcaatacagttccactagtaaacaagtctcaagtctcaacagtggtgcctatactatggctaacaggcatggaacagacccggcatgttccattttacagaacagcgagttttcaacccaatgctacccaagattgtctttctccagtgtatccctcattcatcaccatgctttttcttctttttctttttgtctttcttaccagacgcttcggtttccatggcaacatccttagcatcttgtgaatcagatttcttctttttcttcttctccttcttctcaccttcagcggtggctacaggtggctcctcgctctccttggacttctttttctttttcttgccgccatcagcatcggccacaggagaatcctcgctatctttggacttttttttcttctttttcttctgaccctcttggtcaccatcctcttgaatggtttcctctgcacctgcaggctccgcctcttgatgtttcctcttctttgaagcaccttcaggcttctttggtgtttcttcagtggattgtccaagtaccagatcagccgcaggattgtatgtctgacaaattcaggtgccataatcaggttgagatgaattctgaattagatgtttgcccaagtaaaagtaagcaaaatacacaagacagcttttacagtgactggacaaaacgttaggtgcaacgcagtctcgaaaattagtaagtttcttgaagagtggccaagattaacagaaaacattaagcttcctcaatatattttcaagacaaaaatcaagatactacctaccttggcaggagtgattaaagccccagcacccttcttccggtccttttcatacacttctatcttgggctttcccttagtagaacctgcagacctgccaagttctttaccctcaagaacccgaagccgtgtctcaagctgcccaaatggatctcatgtcaatccaaggagtcagacaatattatggataaagaaaaggtatttcagaaagtacataccttgactcgactctcaagaccaatggagttatcttcaccatcaccaagggcatcataccgaatggcaagagcagtttttgcagcaagagaacgagaaatcttccccttgtgctttggagctgcttgaccaattaaggatgcatggtagatgagaccatactttggcgtagcatgctttgtctttagagctctgaacaaagcctggagggaaagattgtgttacttattatttttgtgggaaacaaattataatacaccgcaaaaagctactccctccgtcccataatatagcaacctagtacaggatgggggcatatcctagcattagggaccaagtacaggatgtgtgaaacatattatctcccagacatagactgaaatataagatcaaacaaagtaaaatcacaaacaccacacatgaagcatcctttccccatgttactagaaaacaaacccatacttccatttacctattttgcatcaagtaatctgagtggaaaatggttaaatctttcaagaataacaaatagcaactgaccttctctgcaccaagtatctgaattgtgctgccaggctgcttggccagatttaccaaactgccgccatgtgcaataagtcgagcaccaaccaattcgccaacaagtgcagtcaaatttggtgcgatagtgttcatcctgcttctcagataatcaaacagctgggctctgtactcagaaagagccaacacctgatcacacagctccctgatatttagcaagtcaagttcactaacttctgttcccatggatattactgccgcctcttttagctgtgcttcaacctcatcatctgaaagtatctgaaaatagcatttgcttcttaataaagaaccagttgtggtggatactcacggccattacattctgatcacaaatgtgcagaatttacctcagagaaatcaaggctttctgcgttagtccgatcacccatcatcttcacaacttttgcgtactgtatgttatcagctacaattttagtgagctctggaaagtgccacccataccattcacgaaccctcatggcataagtgttaagctccttgtcaagatcatccaataagccaatggcctgaatgatcatagtatcaacctgtataatcagaaacaatatagtgtttacctcagttaccgtcccatgaaggggttatgtacaaattaaaaatagtaagacctcttgtatatccatttgatgctgaactaaataattgcaggtgcgagttattcgttataaagttaacagaaacataagagtaacaaattgagcatgaaaactaacaaaaggaaaatgattgaatcatatgactcagagccagggagaagtactgaataacatgttcaataaaagcgaacggtaggataaataaaagctcaccttttcaggactgaacttcagcttatatctagacaaactgtgggacaagccaaggctcattggaccaaggtcttgtgcacccaaaccagagataagttcagtgagctggtttcttaaccctctcatgagctccatcacagcactattatgaaggcagtcaattttctgcaaaagcacgtcaaattataagcatgattggttgttctacataaacaaaacaaccaggagcctaactaaccagcttctcctttatagcatttccaagtttagagtcagccacagctaatgtttcaccctcacagtgcttctgcaagaacttgcgcaaacccttggtaggcttgctgtcaataatgagggttgcagcagaaagggcatcagatgtgttctcaaacttgttgaaagccttcagctcaaccacctaaatatagttgatttgttttgtcaggaaagaaaatcaactgaaaagaacaaaataaatagcagtaataggaacaaatggatagactcattgcaattcggcgtaaagtaacatgacttctgtacatgacaatgttctccacataatgtcataaactcaatgtgcacaaatttatttgtcgaatcaatctatagacatcggacggacagaatatgtgcacaataggaggcaaactaaaccattacatctctctcccctgataaccataacacattggaaaggaaattacagttcagaacatggtaggattagtcagtttttttttgtttctcgaaaaccactttgcatctatcaaaatcatatccccaattagcaaggcaaaatcagctaagctaaaacatatgtagtactcaccaacctacagaagccattggtccttgtgctaatttaactgactccatcgacatgtgtcaaatcatgcattaacgctcttaataaacaaaaaaaaagagaaaattttgtgctgtaaggaagaaaagcacaaacctttctcgccgagtcagacgtcgtgaactccttccataaatcctaaaaaaaacaacacaaaatgcgttagcacgattagtccacttaacactccatagaaagtcaaaccaacagctgaagcggcggcggcggcggaagactcacctcgaccttgtcgagcttcccctcgtcgagcaccttgaagagggcgaaccccgcgggcgtctcgaacagcaccagcatctctctcaccgcccgtgtcccgcaactactagataaccccccccccccccaccaaatcaaaaccccaacctcaaacctccacgctcaaaccgagcagcagcagcagcaaaaaaaaaaaaaaaaaaaaaggatggcgcgcgcaaaccttgggtcgattcgattcgacgacgggagaggaaagcgcgaagcgtacgttcccggctgcggtgagacggggatggaggggagatggcaccgccgccgccgccgccgcggcgagggtttagcgcgaggagttcggctgcggcgaggcgggggagaggggagagggagagagccggcgccgcaagggttttagggcttaggctttggggaaatttatagtggagagtagttgagaactgggggcccatctcgccgttggtttggtggggcggagatcgtcagccgttggatggcttattaggtcggggactcagggttgcaatccgtttgattattatggagacagctgtattgcaaaaatggggaacatgtgacgggtgggcaaaagtgaccacaaacagaaaaccagtggaaatgatcgatgccgaaattttcggtgagaaattcgaccaggtttttccactaactgaaactattaaggttaattcggtcatcgctctcagttaattgaatgaccgaatttaaccgaaattagaggggaaagcctaaatagtaagagtatcttagtcttgatggcttggtcataagttgaaagttaaaattgctagattaagaacaacgttttgtgttgcccggtgaaacctttgccgacaacttccttagcctacccctttccatacacaaaccaacgaaggcaaagattcagctaatgatgaacaaactccaagcacttacggggtggaaacccaagatgttatttcgagatgctcgcattgcgttgatcaatcactttcttatggcgctttccctctacttcatgtcagtccttgagcttctagcctggcaattaaggagattgagaagaagtacaaaaggttcatttggaagggtgatgcataagctttcgatgaaacttgcctggtggcacaagagaagttatacttgtcgatagagtgtgatggtcagagcgtctagaatctattgacgcatgggagtcgtgtggcacgctaggtggtgttggatgcgtcaaacattgtccaatcgcccatgggttgcactagcgtcaccgccaaaggttactcaccttctcgcggcggggtcaaatttgatcctcaggaaacgaagacttgcatccgtttggaaggatcgttggttgcccaagggcagctcaatcgagagttggacacctattctcacctcctttgtcaagaaacaggaggccgcacagtggcattcgtgctctaggaccatgcatggtttgctgatatcaaaagcgagttgtcctttcaggtactcgtggagtgcttcaaggtttcgatatgaacgcggaggtggtgttggagcccagcactcttgattcccttcctatgggcagtaacgataaatggcgaattctcgggcaaatcgggctatccgatgctttattgtgggcgaactatgtgtgcactgggcaagatcatctggaactggaaggcctgagcccgaagcgatgcaaagttttcatgttcctcactatgcgtggagcttgcctcaccaccgacaatttgcagtgacacgggtggcatgtcacttggcaaactgctactttctctatggcagagagttagaatcatgtgcacacatcttccacaattgtgagtttacagcgcatgtgtgggagcgggtgtgaagccgtcttggctttccttgcccgccgccttctcctaacctatccgattggtcgattgaggcatggaagaagattggcaaaacaagaccgaataatccttcaatacggatgtaaattcagtaacttggctcatttggaaggagcgaaatgcgcatgtctgtgaacggaagaccacttcggctagggccctatgcacggcgattgcggacgagtgaaagacatgggaggtggttggcctgctgaagctggcggacaccagaaggcgctaaggtaagtctatacttaggtagtggaagcatgtgtttcaacgtgagttgagctacctaggagttcaccgttgctgaccgcagttagcctggtgtaagcattgtaaatgttttttctctcccccttcttaataaacttcggctggtttttgccttcctgataaaaataaactactacgatccatcttggtaaattagtgtgttatatattgtttcctattatgttatttgtttgccaaacaatcataaaagaggaaggtgctgccaaattttgttatggtttatttgatttttcaattatcacaaatctcagttatgaccgaaaacgaacggcttggtcttgagttttgcttaacgtatctggccaaagaagcagcagcagccctgatttcgataaacttgtctatttaaccaacgtgtgtatgtcaccagaagaaaatcagttaggttttacgtacttatcaaatctaataacttccgtacgggcatcgacagttcatgcatgagacgcatcttgaagtattggaccagcagcagcgtagtatatgtaggccgagtttagttccaaaatttatcttcaaactttcaatttttccatcacattaaaactttcctacacacaaactttcaacttttctatcacatcgttccaatttcaaccaaactttcaattttagcgtgaactaaacacacccgtagtcgtagtaagaaaatattaacttccgtacggacattgacagttcatgcatgggatgcctaacatcttggagtattggaccatcagcagtgtaatatacgtagtcgtagtaagaaaatatttagttactggtgtaatgatgtagtccacataaaatgatgctccctccgccctctaatataagggattttgacaattcatgcatgggatacttaacatcctggagtattggaccaacaacagcctagaatacgtagtagtagtaagaaaatatttagttagtggtgtaatgatgccgtccacataaatgatacttcctccgtcctctaatataagagattttgatattttgcttgtatgtttgaccattcaatttattcaaaaattttgaaattattatttattttttttgacttactttattatccaaaatactttaagcacaacttttcgttttttatatttacacatatttttaaataaaacgactggtcaaacagtacaagcaaaatatcaaaatccgggacgaagggagtaacatttagttagtggtgcgctggtgcaattccccgtgtttgatttggttgtccagaattgtttttttttttttggggacggagggagtacatacaacatgcgtagcgttgctgacttgctgcaggtacagagataatcagacaagcagccaaggctttcaatctggttggcaaagttgatccaaaagttccgagtcacccatagcatcatgcatgcgtagtgctgccttggcgaccagcaacattgtcaccacagcacatactaacaaaaaagacaacttcagaatcagacgaaagagcacgaactactgttgggaagtaagaacctgaaagacatcaacagcaactgcgagaacgagatctggccagccaaaaggacaagaaactttagttcacatagaatgagcaaaagcatcatatgctctccaattccaaaattcagtaggcaattgaatacaagatccatgagtaacaagtccaaacttgatgcctatcctacaactaaccggcatggaaaaactcggaatgttgcattttacagagcagcgattcttcaaccctatgctactcaagataacatgtccttctccagtgtatccttcattcatcgctatggtgtttcttctttttcttcttctctttcttgccagactcctcggtttccatggcaacatcctcggcatcttgtgaatcagatttcttctttttcttcttctccttcttctcaccttctgtagtggccactggaggttcctcgctctccttggacgtctttttctttttcttgccaccgtcagcatcggccgcaggagattcctcgctctctttggacttctttttcttctttttcttttcaccttcttggtcaccatcctctttagtggtcttctctgctggtgcaggctccgtctcttgatgtttcctcttcttcgaagcaccttcaggcttctttggagtttcttcagtggattgtccaagtaccagatcagccgcaggattgtatgtctgggatcaagtgcaaagcatcaggttgagatgacttctgaataacagatgcttacacaagtaaaaagagtgccttggtaccaataacagatgtttgctaagtataaaatgttagtaatatacacaagacatctttacagtgaccggtcaaaatgttaggtatctaacaaagaacaactgccttgacaactagtatttttcttcaagtactggttaagaataacacaagacgttaagcttcctgaaaatactttcaagagagaattcgtgataccacctaccttagcaggagtgattaaagccccagcacccttcttccggtccttttcatacacttctatcttgggctttcctttagtggaacctgcagacctgccaagttctttaccctcgagaacacgaagccgcgtctcaagctgtccaaatggatcacatgtcaatctcaatgggtcagaaaatattatggacaaaggaaatgtatttccacaaagtaaataccttgactcgactctctagaccaatggagttgtcttcaccatcaccaagggcatcataccgaatggcaagagcagtttttgctgcaagagaacgagaaatctttcccttgtgctttggagctgcttgaccaattagggatgcatggtaaatgagaccatacttcggcgtagcatgttttgtcttgagagctctgaacaaagcctgaaaaaagaaaaacagatgtcagcacaacacagaaaaattgagttgtttgaatcaaacttacctcccagacttagacagaaatataaggagatgaaaaaaaggaaagttacacaaaacaacaatcaagcatcccttccccatgtgcctagagaacccatcatccaagggacaattttgcataaactacaaagagtggaaaataattaaagagttcaaggttcacaaatagcaactgaccttctctgcaccaagtatctgaattgtgctgcccggctgcttggccagatttaccaaactgccaccgtgtgcaataagtcgagcaccaaccaattcgcccacaagtgcagtcaaatttggtgcgatagtgttcatcctgcttctcagataatcaaacagctgggctctgtactcagaaagagccaacacctgatcacacagctccctgatatttagcaaatcaagttcactaacttctgttcccatggatattactgccgcctcttttaactgtgcttcaacctcatcatctgagagtatctggaaaaaagcatttgcttcatattcaagaaccagttgtggtgtatagtcatggccgttaaattcagatcaggtatgtccagaatttacctcagagaaatcaaggctttctgcgttagtccgatcacccatcatcttcacaacttttgcgtactgtatgttatcagctacaattttagtgagctctgggaagtgccacccataccattcacgaaccctcatggcgtaagtgttgagctccttatcaagatcatccaataatccaatggcctgaatgatcatagtatcaacctgtataaccagaaacaatttacctcagttagcttgtcaggatggggtcatgtacaaataaaaacagtaacgttaacctcagtccatcacaatgctgaagtgctagactaattaattgcaaatggaagttaaatgtaaagttaacagaagcatggcattgaaaaatctagtttggaaactaacaaaagataatgatgttgattcatatgactcagagccaggaagaagcactggatagcgtgatcaataaatatgaatagtggaataaataaaagactaaccttttcaggactgaacttcagcttatatctagacaggctgtgggacaatccaaggctcattggaccaaggtcttgtgcacccaaaccagatataagttcagtgagctggttccttaaccctctcatgagctccatcacagcactgttatgaaggcaatcaattttctgcaaaagcacgtcaaattataagcatgattgtttgttcaacataaacaaagcaaccaaggaacctactaaccagcttctcctttatagcatttccaagtttagagtcagctacagctaacgtttcaccctcacagtgcttctgcaagaatttgcgcaaacccttggtaggcttgctgtcaataatgagggttgcagctgaaagggcatcggaggtgttctcaaacttgttgaaagccttcagctcgaccacctgaatatagttaatttgtttggtcaggaaagaaaatcaactcaaaataataaaataaacagtagtaagaggaagatatggagatgctcatcacaattcaaagtagaaaagtaacacagcttatgtatataatactgttctccacaccatgtcattccaatgtgcatcagggcatttatattataggagactgaactaaccattaccctcttctctcaccatacaaattacacatccaaaacaaaactgcggttcagagcatcagagaattattactcagttgtatttttttattcctgaaaatcactttgcttctctcaaagtcacaaaaccccaaaaagaaagaaggttgtaatcacctatgttgaatcaacctactgaagccatgggtcctggcttatttaactccataaatatgagatatcttgtgcaataacgagattattaaataaaaaaagaagaagaatattttgtcctgggagtaacgtgaaaagaaaaaacacaaacctttctcgccgagtcagacgtcgtgaactccttccataaatcctaaaaaaggatgaacacaaacgcgtagcgcaattagtccaccgaacactccacagcagcaaagcaaacgaagagctgaaaccgcggaggcggaggcggtggcggaagactcacctcgaccttgtcgagcttcccttcgtcgagcaccttgaagagggcgaaccccgcgggcgtctcgaacagcaccagcatctctctcaccgcacgagaacacctacacctggatcacaaacccaaatcaaaaaaaaaaaccacaagatcgaaagcttgggtcaaaccgagcagctaggatatatacaccctcaagaaaagaaaatggcgcaaaccttggctcgattggacgcgaatcgacgatggggggaggagagcgcgaggcgaaggtccggctgcggcgagatggtggggagggggagtaggcgccgccgccgccgccgccgccgcgagggtttagagcgaggtgttgtgggatgcggcgggagagggggtgccggcggcgagagggttttagggcttgggcttggggggagtttttatacgagggagcgggcgagacttggtggcccatctcaccgttggttcggcctggtggagatcgtgggccgttggatggattttttttcattttaggtcgtgggagtgggactctggtttgcggggcccgcatgggcttcttcctcgcaggagggaactttagaattagaatggagctgagaggcgacaccggctacgaccaccgccgggcgcgcgagtctctccagttatggatgcaagtccgcgaacccgtttatatgttaaaatagtgggcaactcacgcgggtaacctattaatttgacctaaatatgtttatgggacgacccacttatatctttcgatacggtaagatacggtaagctagaccataataaggaagccaagatttaatatataagtagattcacatgtcgacccgcttgcttacctatctccagctgctcatctaccctggtggctctaccaccactactacagacgtcggtgaacctctgccaccgcgagactccaacgagcattctttctgctatatcatccctgcgagtttgacctggtgagttttttcaattcaatatcctcaactcttttcggtgctcagaccctccatctcctttcttccttgactccgtgaacatatccctgtctacccttcgaattcctcttgcactcactctaatctgcctctttcacttcacattacaaatctcctaaacttctggttatgttcgtaactagagtacttttatgttctatctgtgggttttgagttctctttcgtaaccgttcttatattttttatcaaaaagtctatacaaaccattacgaaaagtaaaaaacaggtcgaaacctgtatgaccaacccactattaaacaggccaccaatcatccgtgacccattaaagctcaaatatcatctcatctgtttaaattaagagagtaattatatttataacgtcataatatttaaaaaaacagtcgatatgtatttatattgtaagttcgtaaattatatatataattttagtgcatttatgatgtaagtctgaaaaattacatatataattatagtataagcacgatgtaattagcacgcgtgggatcgtaaacaaaatagcattgaaaaacacggctcaaatcaataatgatggagtcggcaacggctgatttgggctcaggtggagttgagatccagaaatctcatcattgctcgcagatcgaatcggcaacgacaactccggtgaaatggtgaatcataaacaaaagtaggtcggaaaacactgctcaattcgaaggaaatgcaaagaaaatagcccagtaatctcaccaaatcatgctccaagttttgccgcctccaatcaaaagaagcctgtcgaagattaggcaaagcgaactcaaatctatgcagaaatcggggaaaatcaaatcgtctctccaagcggaacgcaagctgtcgacaaataaatattcaaccggagaacagcagggaacagtaacgtggacctagttaattagcaagtacaatctaaaccgagagcgctctcgatttagtattaaagagcgacgcatccgtgagagaaggtttacttgcaactggtacacttacgtgagagatggtctagttgtttactattgtacaaagtgtatctctttttttcttcttatagatttttctcttaaaatatttattcgatctacaatatgactacaccattgtgttagttggtacacttacgtgagagacgtacgtgagagatggtctagttgtttactattgcacaaagtgtatctcttttttttcttcttatggatttttctcttaaaatatttattcgatctacaatatgactataccattgtgttcgttgtaattaaatatttataacaatatcttacatgattatattataataaaaaatatttatattgtaaattacttttatcatatatatgtaagttacttttaccatacgtataaattacttttaaatttgattaagttactttttagacattcactgaacaatatactttactttatcgttagttctataatatgttgattagatttaatttctagataaacttaggtttttacctccataatagatttacttttgatatcgtgacaagttactttttttacttttttaagttacttctataatatatgtaaattacttttaccatttattgaatttacttttatatatctaagaagtaatttaatgaaatctaaaagtaatttagatatattataaaagtaaattgtatttttcataaaaaaaatattatcatgtgagattttgttgtaaaaatttaattgttacgaatacaacggtgtaatcggatcatagatcggatgagtgatttaaaagaaaattctataagaagaaaaaaaacatgcactattgagtgtactagtagcaacaagagaagtcgttggttaagacagtctagcttacatctctctccatcccataatataagggattttgagtttttgcttgcactgcttgaccattcatcttattaaaaaaaaaattagaattattgttttattttctttgtgatttactttattattcaaagtactttaagcacaacttttcgttttttatatttacacaaatttttttaataagacaagtagtcaaatattgcaagcaaaaactcataatcccttatcctatagaaaggagggatgctagcatggatctcaaaaaccatctaacggctaaaaaacgaatgatggaaggcttataaatctgtcaaatgatagttagcaattccgcttaataccactaccgttcgtatactgaatttgactttgttgaacggtacattatgtgtgttgtacgaatttgatcaaaatagtgtgccgtgcatacgtttttttttctttttttctaaaacaaagtagcaggaaaactcaaagcactgccaagcgattctacacgtctgattctgcatgtccttcgattatctcaatgcgttcatctcgtgtcgttcgactgatgatctccatgtttatctcttgggcccttggggcaatacgttttatatatgggcttacgtatccttaagcaaaactaaaaacaaaaccttatttttttaaaaaaaaacaaaaacaaaaaccctaggtagcagccagcacacgctctccaaacatggcgccgccgccgccgccgtgcgagagacggccagtaagcctgagcgatgacatggtcgccgagatcctcctcctcgttcccgccaactccgtcggccgcctcgccgccgtgtgcaagcagtggcgccgcgtcgccgccgacccgaccttcctcgcggcccgcgagcgccgcgcgccgccgctccagctcctccgcgtctccaggcggccgtcggactcgaacggcaggcagtacgacgatgccgagctgagcgtggtcgtccccgccccgctgatctccggcggcgccgagggcgaggaggcgcgccgccccctcgcccgctacacggcgtcgttccccggcggctacacccactgcaccctcctcgcgtcctgcgacggcctgctcctcttcgccgaccaccggcggcgcctccgcgtcatctgcgacccgacaacgcggcggtggtcgggcctcccgccgcacctgtcgtccgccgcgctgggcttctacctccaccggccgtccggcgagtaccgcgtgctgtccaagggccccgatccgtcgcgcaagcacagctcgtcgtacttcgtcatctcggccggcggcggcggcgaaccccggcggcgcgaccgccgaccagctcgtggagagacacccgtgctctcacctgggccacgtcgccgccggggggaagctctactggatgggcgacctcgtagaggccggcagacacccgcacctaaacccctacgcccccgcgaagctcgtggcgttcgacacggtgtccgaggcgttccggctggtggcgccgtcgccggagacggcggcgaacaacggcgacgacgacgacgtgctgatgttcgagctggacggggcactcgcggtgctgaaaggcggagcgatgtcgacgctcaagctgtgggtgctcgacgatgacgtcggcggcggcggcggcggcgacgccggcgagcagtgggcacctgtctgggaatgcaaatatagctgcatgttaccagtctctacgccggcgagcgtggccgtgtgggatgacgacggcggcggcggcggcgacgccggcggcgccacgttcacccggcgtcgcatcacgctgtacggcgtggatgagacggcggcgagggggagggcgctccacgtgttcgcgtgcggcgcgcgcaacggcgggttattgcaggtggcgttcagggagaacacggtggcgcacgccttcttcaagatgcatccgtcgccagccgtgcgcacgtttgggtttctctgatctcgagaggcggctgcgatgatcgtcgacggtgcacgagtggaattggtgtgtaatttattgcacatggaaaattgctggactcatttatattttttagactagatgtatgcatgcagttttaattttgtatgttttttaacatgcacaagtactatttgttggaaatagtgcatacttagccattaatttagcatatacagcaagcataacctacttgcgacatgataggacaagaaaaactcataaattctatcatgctagatatcaaacaagacataaataaccaagccaagtaagttattaggctaatcacaatggtaatctagccgcaatattttaatctagatgaacagtaccatgcatatacaaaactcaggtacgaacaaaactagattagaaatgcaccggttcctttcctttgtaaacgaaagaattcactcactgaatggatcgacggagatcagcgagtcgaagcactgcagtcaatcgatgatgtcgagcggccgtgtagaaatacgctgcccagaaacctttacaccgcccccgtgcaggtgcgaatgcggcgaaggctcggagacaccgctcgccggaatgctcgttgcacgatgagcaccacggccggcttggatcgacggcgacgcaacacggcggtagttgaggaatttcagagtagatggctgttgtgttctgtgtccttcaaagacgtctccttcactcctatatagagctaacaccgaacggcagcccacgctcaatccgttgctcctccgcgtcaaagccggatcggctccatgagaaacgcagccgccaaacggccacaagcgcatgttctcgcttcacatgagaaccaagtcttcaggtgattgaatcgatcagcagaggttgttgtatgcaagcatcttttcatccaacacatgcttatcgtgcgactaagcattaggcatttaaattgatgaaatgatcaatgtctccaagcatgttatttccatcactattcattatttttgttgaaaaatgctccacctagccgcctctggcatttcctcctctcttacaccgggatgttgaagtgcgggtttggtgaggcctgcaccacgaggacataacggcatgtacaagggttgttaatcactacttaaaacacacacaaatgatatggtattataggtggcggaacagttaaaactggttcctatacactttttctcatccccgcgggaaaaaaaaatagaaccaacacttttcaaaactatggatgccggttataaagaaatactactgacaccaatactataagtgtcagtttacttagaagaaacaacacctataatatattataggtgtcagttaattagaaaaactatatgaaaaaaaaagagccgagcctatcaaccacccatatatcccgtcttgtccttatccctgtaaccccccctctctcttgaccctgctcccttgccctcattggcggcagatctagtggtccttctccctctccaccaacaagattttcttgtggcagatccaatggaggcgatggcatcgttgctccagcgagcggatccagtggcggcggtggctttcccggaggtcctctaccacctccattccccttccgtcccaagcttcttgcacggcagatccggcggcggtgacaacttgttatggatgatgttgttgttgttgtgttgttgtgacgatgattatgatctagagttcattgtggattgatctaatggttcaaagcgtttgattttgggggcgaagcagggtggatgtgctcggtgccccccctgtttttcatcccgagaaccttaaaggtgccggttcctaaactagcatcttcgaggtgactcaaaggtgccactgctaggtgttagttgggaaccgacaataggtgccagatttcttaatcaaaactaacacgctttgtgtggcactgaatagtgatctcttactcttcctaattacgagtgttcgttgatatggaagagagagaaagaaaagaggcaaacaattgttgctactggtaacaacggcttaacaacgacacttagcctctagaacatagaaacactcttgcatgagggtgaaaagaattgaaagaatagtaataaaaaacaatatatttccgttcccatcactactaccaaaaccatcattcgtggcggccattttgggttttcactggcggaatttgaagccgtcacaaagcaaaaagccagtgaaaatcaagatcttcgctagcggttatcgaccgccagtgataattcattttcgctggtggtcgtcttaaggcagccgccagcgaaaatccattttcgctggcaacaggcataagacgaccgccagcgaaaatgaattatcgctgtcgggttacaccatgccagccgctggtgtaaatgctggccaaatttttttaaaaaatgatggacggagcgacaccgctccgcccgcctccatcaacgctccaccattcaaaaatttcacagaaatttacccaagcattctaaaattcacaaaaatttacattcaaaaatttccattcacccaagctttcaagcatcacaaaaatttgaagtcgtcgtcgcggcacctcccccatcagcattggcagcagatccggcctcccaggtcatcgcggcggtggatccggccacccctgtcgtcacggcggtggatccagcctctcccgtcgtcgcggcggccggatccggccggccccgatctcctggcagtagaggcgacggcagcccgcggcgatggtggcgacgatagctggtggcggtggaggaggaagagggagaaggagagctcgccaccggatccgtcgcctgcgtcgtcgtcgtcaccgagactagacgtcgccgagcctgctggatccgtcgcgccagcaccgtccccgctgcagagcccggtcaccgccacgacccatcccctttgccaccgccggagcctccatctcctgcgccgtcggtggagagggaggaggagagggctacgcgtcgttgggaagggaggaggagggaagagtggatctggaggatagagtggatctgggagtgttgagaggaggggatgggagggcaggggtggcgcggggagccgctggtcactgccgccagagccgccatcgccgtcgccggtggggaggccgggatggaggaggagagaagaggaggggtaagaagaggaggggatgtggagagaaggagaagaggatgaggtaggtgagtggtttttaatgtgagggatattgggtacgagctgggttttttctggcggttctgtttattggccaccaggaaaaattcgaccgtcagcgaattatatattttcgctggcggcgcacctaagtgaccgccacctatcagggttatggataccacatacctaatagtagttgagtaaatctcggcaggacccaccacataccatgtcctatacggaaacaacctgtggatataggaggagttccgaataaggaaagacaaccagagttctacatggaaacgacaaggactactcggattgtatccatattggttttcctagttctacttagacaaggggacacctatgggtataaatacaaggccccctaggaggagaggggacacggacaatcaacacccacaatcaacatacatggaacaacagatgccacaacatacaagccaacatacgccaagacaagacgccggatatcgacttcggagataagcacggctagtcccctacggtgtctccggatactgtcaggagagactaaagcgctatctctgatctcgccgggcatggattcgaggaggaagactaccctgttgtcgactatgagtcagaccttcagaccgccaagtcgacaacagttagataggctacccaaaatattgtactggtgtgattatggtgaataagagtaatatcggctttggccaacaggatgtagggttattacctgacaattcaggggcccgaacctgtataaaaatccctgttcccgtctcttttacctcagtctcgcgtataccctggtaccaatgatctccatactatgcaaataccggaatcgcaacatcaaacgtcgacaccaccaaaaattgacatttttttgctggcggccgctttagacgggccaccagtgaaaattcattttcgctggcggtcggttcccccacccccttgttacgactttgctggcggtttttacatttttccgccaacgaaaataataagccaacgccataaaaaatcattttctaatggtgaattattataaagatatgatctctaaataataatttttgtattgtcttatagactatatacttgtctctaacatcgagcatcctctcatcgacgtgctcgcgctgctagtgcttcctaccaacgacatcttgtcacgacgagaagccaagctggctagattggctacactttcaaagcttttaaattttttgatgtttctacggtcatcgaaacttgatatttgtggcagagaatgccatcttcttaccccgatgaaatcccacgtattgttgctcgctagctaagaatgtctagcgaacttagccaatttatagtgacaaaataatggccaagtagattttgcccccgagaagatatcctctcgttttgtacatagcgtttaaaatttttgaaaaaaaaatcaaaatagatcaatatataatatatctttccacaaacattcaagttaaaatttgaattatacaacgcaaacaaataacaaatttgaccacagattacgcattatattcatagtcaaatttcaaatttgttgtttctcttctacttttacatattgaatttgaacatacacatatttgtgaagtaatatatcatatattgatctttgttactaaatgtctttaaatttttgataactttttaagcgacatgaaaaatcctaaaggtatgaatggagtagtttcccaaataatggcaacaatatttgaagctgaatgtgaatcgaagcaagtaaatataggaaaaacatggtaacctacgttttcttttagccacttggaagaatggcgatagaacgggagacggattctaataacttgagtggacgtccacccgtttattgtatgtcaaataaatggttatgaaaaaaattcaaaaaaaatgactagatagatcgatatttaatatatcacactataaacatacaagttcaaattcaacttctacaagttgtaacaaaaataacaaatttaactgcaactatacatgcatatactaatttaagttttatttgctttatttttacaatttatagaagttgaattttaatttgcatgtttgtggagtgatatattacatattgatctatcttgtcaattttttttcaattttttttcataactatttgaattacatgtattaaatgggtgaacaatcaagagtttcccgatagaacgtgccgttgttgattctattgtcatgtaccatctccctgggattgcgtgtcacgtatcactgctagttagcagcggaaaggattggagagggctacgcgtcggacgtccggatatttgcaaatctcctgatgatgttgcattatatgttaaaatatgttgcaatatttcattgctcgaaaaaaaagtttcaacatgaattgtttttgggattgtctgtatatctgttgatagaaaatctcacttcccatctttcaaattttgaaccatcggatacactttgagattcgtgcagaggtattaaccctaacactcctctcgttcccctcccctcgctcatgtcgccgccgccactccctcccatcacgcattccaccgccaccgcccgatcccccgccgccaccgccccgcctcgccggctggccgaagggcgtcaacggcgccgtcgaggccccccggccagccccttcccctccctctcctcttctttcctcaagcggatggcggcgcactgtccccgccgccgtcttccccgtctccggcggcagggcaccaccaccggccgcctcctcctaatacacccttctgctttgcccccgccgcctacaccggcccatcgccagcttccgaccccgcggcttcggcggcgcccgccgccgcctcgccgcccaccttcgggctgccgcctctcacggccatccctctaaaaccggaactcctccctcttacccctccccctcccacccttcccacccccacctcaacccgggaccctaacccgtagggtcctctaccggagtctagggtgtcgccggcgctggagaagaagaggaggtcgccagagttggaggagaaggccctggagcacgaatcacaaagtttatccggtggaccaaaatctacaagatttggaggtagattttctgtcgacagatcgttagcatttccgaaatacttattggccacatcttaaagaaaaataatcggagttgccagaaaacttcgccaagttttttttcctagaacttttaaatttgtgactattggagagttgtgcatgatggaaaaaaccgatgcggaaaggaaaaatcgggcacccgtctctctctcgtctgttccccgtatctgtgttccagcgccggcggctgttcgcggggtggtcggtggcggcggcggcgtcgtataggagggtgaggaggcggatgatgggccagcttatggcggcggcagctatgcaaaggtcattggtgacggcgttcgagaaggagcggagctgggggtcgtccttcatccagaagcactggacgatgcaacagctccggcgaggtgacccgcaatcgtggtgaccgcagtgcggcttgctatagaagtctgtcgctgttctcgagggttctcaagggttggatgttcgagaacttcctccgcgcgtaagctcaacggcctcttcagccggcgatgcaacagctctcaagggctcgatgttcgagaacttcctccgcgcgtaagcttaacggcctctttagccggcgatgcaacagctccggcgaggtgaccagcagtcgtggagccgcagcgcagcttgcaagagaagtccgtcgaggtgaccagcagtcatggtgccgcagcgcggcttgccagagaagtccgttgccgttctcaagggtaagggttggatgttcaagaacttcctccgcgcgtaagcaatgtttcggctagtgtactcgtgatgtttttctatgtatggatcaaatgttgcagtggattttaaatattgtttaatgggtctgtctattcatttgtcgtgtgatttctaacaaaaaaaaatcacccaaattttttctgcctttatatttacatacaacgaactacaaaagaaaataaaaaatacatatttactcacacattatttttataaaaaattatagtgcacttacatatcatatcaactgaatttacaaatgtaattttagttatgtaggactgtaattttatattttaaaatataattttagttatataagactgtaattttattttttttaaaaaaataacaaatacatatttacttataccaaaattacagtgcacttacatgtcatatcaactgaaattacaaatataattttagttatatatgactgtaattttatattttaaagaaaataacaaatacatatttacttacacattagttttatcaaaattacattgcacttacatgtcatatcaactaaatttacaaatgcaaatttagttatataggattgtaatttatatttcacgacgacgagagggacggtgtcgctcgccgaatagcgttggtcgtactgccggtggccggctcgccggtcagaggccaccttgccaccatgtttctctatcatggtgcacgcgtgggctagctgacacagtccgtgaccgtgagctgcagctcacatcacaagtggtgcatagcgtgcggccaaaaaaaaaagtgtgaaatgccatagaaaaattcacacgggagatggatagcaaaatcgttgtttaataatatcatcttgacggatacggggtttattgttgtacatggggtaagtgtttcaatgactttaaatcgtttgttgcatatgttgatctaatttttttcatctagcgatctgaccgtgcttctctttttttttaacaattgaaacattctttcgcaattgatgaaataatgctttttatagggtgaagcaacgtccgatttaaaaaatcgggcgcccgatttataggggttcgtttaaattttttttgcacacggatcacgcgccaccaaaccccgggactcgacgccgacgcgcccaccacccgaagccaatttgatcccacgtcacggggggcgcctctgcgtcgccgtcggagaaaaagctacagtagctggacaaccgggatccatggtgctacgggccttccgctggcaagaaagatcctgtcgtccgaggcgttccggctgatgtctcgtccgccggcgacgacgaggcggtggggaacacggacgtgctgctgttcgagctggtcgacggacgggacacctcatgcttctggagctgcaccagacgcgccgtcgccggagacgacgacgacgacgacgacgctcgtcatcaggggtgtgggcggccgctcgaggacaaggatgcatgcggtgggcgccgtggccgccgtgtgggaggacgtcgatcgacgaccgccgcgccgcggcgctcaccacccatcgtcgcattgatatcaacgggggtgctggacacgacgacggaggcggcggcggcgaggagggcgcgcggcggcgcatcttcgcgtccgacgcgtcgcgattcgcgttcagggagaacatcgcggcgcacgcatggcttcttctcgacgcatatccgatccgttccatatgatgtacgtactagatcgacggtgcatacgaggccacgtacacacaaacaaactacggggagatggattatattagtttgagatttgtggcatcagttttttttgtgtttttttaattatatgatgaggattttttttagataatggaattatatgatgaggataatttgttgaatggagttaggtattctgtactttttgtttagcacaggaaccatcatctcttacgtcaccccatacgtcaccggtcgccgtcgccgtcgccgtcgaaccatagagaagccaccgctcctccctccctctcgactcccgtcacctgtcatccttgatcctccctcccctccccggcaacgctccttagtacgccctcgacaacgaccactcatcaccatctctactcctcttgacaactcgctactatccctcctttttactacattataaatcgttttcattgttagaccctgtttagatgccggcaaaatttttcaccctgttacatcgaaagtttggacacatgcatggagtattaaatataaacgaaaaaataactaattatacagattgcgtgtaaattacgagacgaatcttttaagcctaattgctctttgatttaataatgtggtgctacagtaaacatttgctaatgacgaattaattaggcttaataaattcgtctcgcagttttacaggcggagtctgtaatttgttttattattagtctacatttaatacttcacatgtatgttcgtatatacgatgtgacacgtcaaaactatacactcctgatctaaacacagccttatacaaaagtttgatcaaacttataaaaacacattaacattcatatagcatcaaattaatgccattatatcttaaaatttgttactatttttatgttacttgattaaatctaaatgggtttgactttgaaattaaaacgacaaacggaaatggtactacccaccaaccgagatgcggacgagactccgctgactttgtgcagtttgcagttgtggcaccgacatgtgggccttatagccctgcacaaagttaggggatctgtttcctcgagatgttgggcgcctgacacgctgaccctactcccccggacgtcgtcgtctccaaccaacaacaacggcttgtttggcaacttgaggtaaaaggattgagagtttacacgagggaattgatgatgagattaaaatgggaatttgatttttatcccaatatcttgtttggtggaggtggtggaaattgataggaagtttagttggagattaggtcattaatgaaaatggatggctgtgatttgtttaggcaaagtaaaggaggaattccctcccaattaccacatctacccaggtattgaaaagggggacttcctttctcaattccctatcccatcacgccaaaattcacatgtctcataaccaaacaaaatactccctccgtattttaatgtatgacgccgttgactttttaacaaacgtttgatctttcgtcttattcaaaaaaatttatgtaattatcatttattttattgtgacttgatttatcatcaaatgttctttaagcatgacataagtatttttgtatttgcataaaaaatttgaataagacaaatgattaaacgttggttaaaaagtcaacggtgtcatacattaaaatacggagggggtatttaatagcctcatctttctaaactctcaatcccttgtaagagcaagtacaatagcaggctataaaccagctataaatatattttaaagagataaaggaagagagagaagagcagcgagctacagatttgtagctagttgcaacacggactacaagacgtaatgtgtatgacatgtggtaccaggtattaatagtatagtaagcaactattgtatgaattggctattacattggttatagatgatttggagctagtagtgagttatactattgaacttgctctaaaaactccctccgaccaaatgggccgcaaagacagtgataaataatccatgtgaggcagtcacaggtaaaaaaaaaaaaaaagcttctctaatcctagctcgtgacctgacacctgtccagatgtgaacgaatcgagcggaggctagcgaagtagtagcgagtgtagcatcttctcgcgcgctggtctccccaccgtctctttcgccatttgcacaattctctcactcctctttccccctcccttcttcttgcttcttatcccccaagcaataacgaggcgtcatctctctcgtcatcttctactctccctcctctagtcctcttcttcttctactttgtacgcgccactcactctccgagcttgacggcggcggcggcggcggaggtcgtcgagtggtggtcggggagatgggtcaagatgaggtggaggtaggtgcggagaaaaaggatcaagaactaccggaggtggaggtggtcaaggaggaggaggaggagggatccaagaaggcggcggcgggctgcgactactgcggcgacgcggcggcggtggtgtattgcagggccgacgcggcgaggctctgcctgccatgcgaccgccacgtgcacggcgccaacggggtgtgctcccgccacgcgcgcgcgccgctatgcgccgcgtgcgccgccgcgggggccgtcttccgccggggcgcgggcggcttcctctgctccaactgcgacttctccaggcaccgccacggcggggagcgcgacccggcggcgccgctccacgaccgctccacggtgcacccgtacaccgggtgcccctccgcgctcgacctcgccgcgctcctcgggatctcctactccgacaaggcggcggcggcgaccgcggcggcggggggcgacgacggtgggtggtgggccatctgggaggagccccaggtgctcagcctcgaggatctcatcgtcccgaccacctcctgccatggattcgagcctctcctcacgccatcttcccccaaggttcgcttttacagccttctactgttcactgtccgaaaaaaaaaaatcccccccttttctgaatcaacttctatttaatttactcccatttatccggcttaattcttgtctgctgcaaaagattcagaactcgccggatgggaaggtgaatgaggaggtcatacgacagctaaccgagctcgccaattcagacggcggcggcgcgcagatttgggctcatcgcgaggcggcgcaggccggcgatcatcagttaccttcatggggaacaacaacacaacacaacactggacatggcaatttcggtactgcaaacagcaatgaggttgcaaccatgccgacgcctggttatgaggtttgatctacaatcttcagcatatctgactaatttgcagtgctgtttaccctatggatgtacttttgtcactgcaattgttagtcaagcgataaatggtactagattggtagtgtccgcagaatcttcgtctgaacggtagaaactatacagattctgtatcatatgcggtgaagatattcctaggcatgctttgctgtacctatgttgatggggaatttattctgtagtgtcaactcaagcgctagcaactcaagatacatctgagtcagaataaagtcattctagtgaagaacccctaaattctctttctctttttcagagagaagaagccccaaatttgatatgattctgttcttttcctatctattgtcatattcgtgattttgtgtaagattcttatttggtttacacctactgacacatacattaattttttaaacctggacaaggataccattctacccattgattatttattgacagtcctgttcagatagggggaattgtatccacactgaaattggccatgaaaaacgcagagtaggcctagttgataaagagctaagattttgattgtcagttcttttgcgcaaaatagatgcttacttggctatctattaatataactttatctatatggcagaatggtggatgggataacagcgattaccctgcgctaaatgatccgtgcaaggtcgagttcacatatgagcaacctccagccagctcagctgaagcatgtatttcatcatttgttcagatgtctgaactttgccccagcatgagcaatggtagcagcatggaggaaacccaccagacaaaccctggaaatggcacgccaatgcaagttctacccaaaatgccagaatttgttccttgccccgacaggaacttggtcatttctcgctataaagagaagaggaagacaagaaggtgacataagcttatggcaagcatgatgtttttatttcctcttgaagcttctcttggactcttacccaggatttttcgatttgaaacataactgtgtgacaatgaaattctaattattgcagattcgacaggcaggtccggtatgagtcccgcaaagctcgtgctgatagcaggctgaggattaagggccgttttgctaaagtcaatcagatttgagccttcatttctgtaatatattttgcatcttggacatgagtaatactaattaggaccaagcagatatagtacaagaaaaaatatcagcattttgtatgtaactatgtacccacccagtggctacgccacgctgaggagaatttagtttcatcgaatctctgtatatagtgttgcatcgaactcagtgatactatttacatgcaaaggatattgtcattatggctgtttccccatggttttactgcaaactgtctgctgtgttactactgcaaaagctctcctttgatgaggatcagtaaaatagtgtcaaattcggatcgcagatatgttgacattggagaggacaattctgtgttaagagatgagtaactcgtttcatggcaaaatggttacaaaatatttaattccctgtaatcggcttgtcagtttgtcatgaatcatgaattcgtgatgctagaggataaaacagagtctgctgcataccagaagctaatgaaatagttgatgcacgacaaatcacagtaatctgtcaaaagattagctttgatttatttatatcataccagatctgacacagcaaaactatcctcctttggaattaggcaatgcattgtatggtacaattgaatggctaatggcgtctgaaacattaagaacaactcacatctctacaaacactctggatgaagtagtaatttacaacttacaagcaccaagaaactggcaatggcagccaagaaggcgagcgaggcctagaagatggtctgctcgccgagctcctgccctgccatgccttccctgatcaccctctcgaagaactgctcgagcgtgtcgctgccgtagctgggcgtcatctcgtcgctgtactcgccggtgtccgggtcgagcaccagcatgctctccgacgcgtagtacctcccgatcttgccgaactccgccgcgtcctccaccccggggaacaccttggccagcgcgtcgagcacccagatggcggcgtccatgacctggatcggcaccttgatgaacctgggctcgcgccccagcagccggaacagcatctccccttgctccagcggcgtcagcgccttccccggcccgccgatggggaggatcttgttggccttgccctcgtcggagatgcagtcggcgatgaacgcggcgaggtcctcctcgctgatgggcttgcaggcgcagagcttcccgtcgccgaacatgacgtagggctggccgttcttgacggtctcgacctggccgcccaggctcttgaagaaggcggtggggcggacgatgctgtaggtgaaggacgggtcgcgcgacgcctcggcggcgagctcgccctcgaacctgagcttggcgcgctggaactcgaggagcggcttctggacgcagacggcggagaggaggacgaagtgcgcggcgccgaggccgcgcgccgcctggagggtgtgcagcgtggcgcggtagtccacgcgccacgagtcccgcacgccgccgccgcggctggcgaggcagcacaccgcggcgtggatggggccgtgcggcgacaggtcggcgcggagcgcgcccgcgtcggtgacgtcggagaagacgacgcgggcgggggcgaggtccgcgacgacctcgtcggggccgttgcggccgcgcagcccgctccgggggcgcgccacggcgaccacggggtggccgcggcggaggagctcgcggacgacataacgcccgatgtagcccgtggcgcccgtgaccagcacggtggtctccgacggcgccagtgaccggaacggctgcgccgccgacgcagcaggcggtggctctaccgacgaagcaaggaaaggccaaccccgacgggcacccttaggggcggcgttggcggcgcggaaggagacgaagcttggcgccggtcgagcagtgggggacgtggtggaggatgaggaggcggcggtgaggtgggaggagaggaggagggcagccatggcggctgccggctagggaggcggaggtgctcgacggaatgcggggagggaggcggagggcgacgtggaggccggcagtatcagagcccggccggcgagcgtttgtggtggtggtggcgtcgcgaccaaatccgagagcgcgattgcgctgacgtcactttgatattttcattttcattttttggattttggaggagcagcctctcatcaaagcaaccccaaaaaaataaaaaaaggaactcgccactgggctgaaatcagcaaagctcaatgggcctcgctgtgaaggccacaataacagaggcccactcagagcccgtctttccaaggctttattaaagcgagaggactcgatggccccgagacgaaaccctagccttcgccgccgccgcatcagttggcgatcgatgcttctccaagttccgtcgtgttcaaccgttttcgttcgatctcctctttctgattttggcctctttgtcactggtttatcgatggcgttgtttgtctatccccatttgtttctctcggtggttttttgttcatctttgaggttactgtgatttattttttccttcctgcaatacatcgtcttgatttggaagtttatggattggtcatgctcttgttctgtgtgtttttttttttgttgttttacatcctgattttcgatctagcgattgttgaatcttggagagttggtggtgttggccggtgatgacagcgtatggtatgagcctcagtaactaatctgcgcatcgggtagtgataaacccgggttattgacggccaagattcatgtgccaaaatgctaatctgaggccagccaaaccatctctcccttgagcaacttaccttacttcgtttccatatcttaaataacaagcgtaaagaaatggcgagctagtgttcaaacccaattaggaatgacatctgaacaagcagaagattgagaaatgtaacgcagacaccgggttgatgccagtatgccactcgcacataaattacgcaacatactccttatttgcaggcacagtagtacttttgagtttttatcataacttttaatcattcgactttgtttgcgatttactttgttatcaacagtattttaagtataacttattcttttttatatttgtactaatttttatatttgtactatactggacggatgtagtagaacgcagcgctgtaaaaaaaaattgttactttgttcaaaatggttctaatatggtccaaaataatcgctccaatcgttacgaggtaatcccgctgccgcgatcaactgtgtttgatcattacataccgccgccgtaatgatcttaattatcgtcgtgcctaagagcaagtttaatagcagagctcactacttactagtcaatgctataatagcagagctctttacttacttactagttaatgctaaaactaacatgtacagtagattagctataaggttatctttattttcttcatcctctctctttctttcactatgaatttaatatataatatttggagcttgtgtgtagttagcttttgcatgatagccaatactccttacttttgtttatctctcttctatataaatatataacttgcttatagcctactattattcttgctctgagttgttcacgcattgctgattgcatgttgattgctggtggcgtggattgatctctcgcttcgtgtggtgaatccgtccatgctggttgctggaactggaaggctgaacggctccttttgctgttgcctagaacatttccgctgtcacattcctttgttccctcgatcgcacccaaccatttcgttgtccgtgacaatctgttccaggtttcaaccaagagagggcccatggccttcgtaatcctcatcttaaaagctactccctccgttttaaaatatttaacaacgttaactttttagcacatgtttgaccgttcgtcttatttaaaaaaagtttgtgaaatatgtaaaactatgtgtacacgaaagtatatttaacaatgaatcaaatgatataaaaagaataaataattacttaaattttttaaataagacgaatggtcaaacacgtactaaaaagtcaacgatatcaaacattttgaaattggagggagtatatcaccattatccaaatggagaatcctataacaccattatccgccgaagcatgaattcgacttctttttttctttcttgaagattatcagttcctcttttgcatatatatttttttctgtctcgtttaaagttcatttttcacgggacagcaattggtagcgtattgtttcacgcaaactggatttcctttacatacacttctgaccaaattatagtactccgtaaaagtctagtagaacactacacggccattctccccagcgactgcacaataccaatttttcgccttcttctcgggacagtcggttgctcgctcgctcgccgctactcccttcgtcactagaaagaggacgtggttgcacaaatcttaatactatgaaacttaatactttctccgtttattttataactttgacaagtttaaaatttaactagctaacgttatacagacaaatttggaggtaagggcggtggctattgttcaagcccaattaggaatgacatctgaacaaacaaaagattgagaaaaggcatacaccggattggtgtcaattgcacataaatgcgcaatatattagcaggcacagtctgaatacgagcatacgagtaaaacttatcgctgtacaaaaattgttgctttgttcaaaatgattttaataaacagtgtttgatcattgataccggcgccgtaatgaccttaataatcgtcgtggctgagttgttcacgcattgctgattgctggtggcgtggattgatctctcgcttcgtgtggtgcttgaaacggcggctccttcgctgtcgcctagaacatcttctcacgtgacagtcctttgttcactcgcaccaccaacatctttgatacttcctccgtttcataatataagttattctagcatttctcacaattatattaatgctaatgaatctatttatattgatgttaatgaatctatatatttagattcattaacatcaatacaaatatagaaaatgctaaaataatttacattgtgaaacgggggaggtagaattcatccggcccatggcctccgtaatcctgatcttgaagctaccggtttatccaaaaggagaatcctatatatcgttattatccgccaaagcgtgaattcgacttctttttttcttctttcttatagattatcgattcctttttgcatattattttttttttctccttttgtatcatcttaaagattttttttcattggcctgtatccggtcgggtattgttctacacgtatttctgccgaaatttatttagatagaacactacatggtataggtcattgtcccacacggctgcacgataccaatttttcgccttcttctgccgtcctccggtcctcgggacagtcagtccgtcggtagctagcacctgctagcagacgtatgaccaaaacaacgctcataacccacgtgaagcggaaacaccgagaaaaaccgcggaaaacggccgaaaccaacgagtggattgtaaatcctcaaaaatacatttccttgttatttacatataacctactaaatagttattttttaaaaaaattaaaacaagataaattattatatgataaatcactccataaacatacaagttaaaattcatcttttataagttgtaacaaagaaaacaaaataaactataactagtaaacgtatattcacaattaaatttactttattcgttgtaatgtgtaaaagttaaatttgattatgcaggtttgttgagtaatatatcatatattaatctatcttgtttattttttaaaaattttatcatatactcgtactatttaaatgaatcgtacttccttcgttcgataatataggagattttgatatagatagtgtaagtgaaatatgaaaatatcttatattaggagatggttggagtaaacagcaatgctcaatccattgttcgagtagtttttccccgaaccaacgcaatccacacgcgacgacgccgcgaaccggcgcccaatcgacgcacggcgcgcggggccgtcggtttttggcgccgcacagccacgcgtcggcgcccgccgagtcagcaccacgtcctcctcctcttccgcccagatccactcccacagtatggccgccgaccgccgcgtgggcccaacatctcagtcagcgccaacgcggtactactagctgcctgccgggtgggccctccagcccaccgtccaaatccacctacgtggccgcacccgcgtccctacgtgccgccttatccacaaagaccacagacctcaccccggttggtgtggagtggggcccacgctgtcattcggtggacgaggccggtgcgggccccgcgcgtcattggatggaggaggaagcgagcggcggaggaaaaacaaaaaaaaaaaaagaacgcgaggccacctggcgcgctctgtattattgcggctgctgctcgccgtgccacgtggcactcgactggcgcttttttcggtgtttttctttttgtttcttttcgcttcgctgtgaataaatacgaggcgaaaaattaaaaattcagtaccaccaaaccaaacccaaacgagagagagaagaacacacgcacaccccgagcgaacgcaaaggagcgagaagccgagaagaaaggagcaaagtcgcgatcgagtgacgtaagcggcgacaatggaggctgtgctgatgcagcaggcagcggcggcggcggcggtggttgcaaggccggcgaggcggcggtgcaccggggaggaggtggtgggtggaaggcgaccggggttggtccggctcggatttgcgcggcggcggtggtcgaggctgaggctgagccccgcgcgggcccacctcgccgtcgaccggagcagggaggccggcgaggaggcggcggcggtggtggaggaggagggggaggcggcggtgaggctgttcgtggggctcccctccgacgtggtcaccgccgacggccgcgccgtgaaccgcggcaaggccgtgtcggcggggctgcgggcgctgaagctcctcggcgtcgacggcgtcgagctgccggtctcgtgggccgtcacgcagccggggcccaccggcgacgagctcgggtgggcagggtacctcgccgtcgccgccatggtccgcgacgccgggctctgcctccgcgtctcgctcgacacccacggctccgcgctccccgcctgggtcgcggcggcggcggccgccgaccccgacatcctcttcgccgaccgctccgggaaccgccgcgacgggtgcctctccttcgccgtcgacgagctcccggttcttggcggcaagtcgccgctccaggcctacgaggccttcttccgcagcttcgccgccgccttccatgacttcttgggctcgactgtcacggtaagcgaaatcaagaacaccttcgtctcgttctcgaagttgcagtgtttcttaatactagtttttgttggattctgtaggatgtgacggtgagcttgggtcccaatggcgagctcaagtacccttcgtatccgcctgggagcgacggcgccggcggctatggcggcgcgggcgaattccagtgctacgacaggcacatgctggcgcggctgaagcggcacgccgtggcggcggggcagccgctgtggggcttgtcggggccgcacgacgcgccgcggtacggcgagtcgccggagagctccaccttcttcaggtccccggggggctcgtgggagaccgcgtacgggggcttcttcctgtcgtggtacgccggggagctcctcgcgcacggcgaccgcgtcctggccgcggcgcgcagggtgttcgacggcgagcccgtcgagctgtccgcgaaggtgccgctcccgcggtcgcgccccgcggaggccaccgcggggctccacggcgggtacggccccgtcgccgagatgttcgcgcggcgcgggtgcacggtgatcgcctcgggcatggacgggtccgcggcggcggcggcggtcctcgcccaggtcaaggccgcctgcgcggagcacggcgcgcggctcgccggcgagagcgcgtcgctcgccgtggcgcgcgacggcgacggcgcccccggcgcgtggggcggcctgctcgccgccgagcgcacgcggccgtgccacttcacgtaccagcggatgggcgcggagttcttctcgccggaccactggccgctgttcgtgcagctggtgcgcgccatggagtgccccgaggaggcgcacgaggacgacctccccgccgccgccggcgacggcggccggctcgccgtgccgtccggcggccgcgccgcagaagacgccaccgcgaagcaggcgcagacagtgtagacgcagctggcacgctgcgactcgtagctgtacatatgtgcagtagtaataccagtatactgctgtaattacagcagtacaatttactattactactccatttttattaggaaaatcagcggtaaattctcagtgtgtagctgagaattatgagatggatgatgccccctgtattagtggggtcaaatgagtatttgtcaaaaatggtattttgtaatgatcttatgatcgagatgagagattgtattctagtgatgctattgcatcattgttacctcaagaatcagaacatgagacgtgtaccccaataattcttttgtccatgacattgcaatgcttatacgatgatgattgatgcatgattaacatacgtaatctgcatgattagctcgcgttggaagaacacgagcttcttatcctcaactgagattaggtccaacaaaatactgcttcggattaacaaatacacacagttttggctctcagatacatcctgataccatggtaaccactagtttcttactcagtagaatttataaggcccattaggcattataaaaacgctcgactcaaatcaacaaatgattaccgtatgtattcgtcaacatatagtagtatatacaagtcagaatgtgaagttcaccgctgaaacgtttgtagcttctctcgcttttgccctttcccaaaaataatttaataaaaaataattaccattttacccttccaccttccatacctgattgcccttttaataccttttttcaggtaccttctctctatcatatctgatcaagggtcctaattaatttcaagcattgaagaagatctctactaacaaatcacacaatccacaacactgcttttgacactgttctcagcactgcagcctattactccatgtattacactaatttaaagaacacatcaagttgcaacttgcaacacacaacttggcatttttggctacacaagcctgccgtttacaatgtaaattgggggagattaaaaagaagaagaaactctctaggtttcaacagccggcaccgcccaagaatgtgtaacaattagaaaaaaaaaacaaactagaacagaattacaagccaggaggccagaaagatcacaggtggctattatgtacactgcagcagcagcatccggggcagcaacttcaggagatggacttggtgtttttttttctgcccaaatccaaacaaatccttgtgcttcaatgtcaagcgtgactcgtgcacgctacgcctgccgatccagcttatcatgcttccacggttcgtccttcatccagcacctgcaggtacattgcattcgcggccaaaaatcttgattaggatgcggttcatctgattgtgatttagctgcatgaatgcagctatgcctggacagtgatggaaaacaactgcgcaactgcagcttaagaggtatttttgcgagttccattggcaactcgtcagcctataaaccaaggctaaatttgaatttttgaaacttaatttcagattggtctacgtggttttcttattgttttctatttaaaccgctaagagtagaaacataaaatccctactctaaaattatttttctttgcttcgtgtcacgtttcatggcacataaaccgtacccaagcaagtatgcaactgtagtttacagaacaggctgaatcagtagtgattacggagctaagggtaaaacacagagggcagctatcatctggtgcaaattgcatacatgtgttgccatctattctcttctgatgtgacatcccaacagaaaagctcgatttgcatatgggcagaccgatgaattcagatatgcctaacagccagctcagattttggatcaactactgctctactagtactcctaatctgactatctagtgtctgaagtttggaaggttctgaaaatgtgagtcagctttcataatactgttgaagaaacaattaggtaaactgaagaccatctagataaaagcaagtattaagtgtcattatatcaagcagggtaagtaaccatgtgtaaatgtcgatagtagtaaagctgaatagagagaaatgatcaccttatctcattcacaggctattttggtatcaaaactgctcagacagattgcaaatgattgaaatgctgatatcggataacggtagtccatggtgaacaagtccttcccaatctttccaaactggagaatcaccttgtcctgctcctggttagttggcccattttcatcagacgccaccagctgaaagtttttcactgaggcaacagtaacccgtccacggaagttgaggcaccaacattgcagttgctcatgccacctaggagatttattcttcagaaccagcttttcttccttctgagtggataattgtgaagttgcactatctattcgagctgattttgatctgaagaatgaaattgatgggaaagagtcgaggccactgagaggaaattcagtctgtgtcggagctttcccaccctcttgaacagctgatgtggggatggaatccataatgcagttcatccttcttggacctctgcaataggaatgcatcacaaaaatcactgcaattttctacgaagtattgtagaagcagtcaaatctagcatgcaaagtcaatcaacaatgaaaaggttgcgtatatggaattatgacagctggtcagccgccttctctatataattattcctagccatgtgtgctcaaataacagccagaaggctcacggagttgtgatgttatcaccacttttatcattagagccttttcttaaaaaatagattcagcatgtctaattgatcaatcatgcaattgcagtaatcaccactgtgattctaactatcgatgaattcacatattaaggtctcaggtgttgatgacaatatttaccaatactatccatagatttactcggcataacacaagtgctgattcaataccttgcacccaaaacattcaattcgtaggaaatatgtgaaactgggtaattcccggcaggaactctcggggagacttggttcagaccaaccacacgtgcagaccgactttttgagacaacagctccatcatatggtggatgggcatcatagacggtaaactttgttccgagaaagtttgacctgttaaaacaaaggtggttagctggttcttttaattgttattgtaggctatatttttagatctgtaagaaacaaacaaaaaaaagatataactgaagattaagtttgagtaatgcacttgacatccaaatacatacagttttgttctaagttgaatgaatagtttagatgtgaaatgcatagcacttcaatttcttgtactttccaaattctaacacttacagcaaaaggagagggggaaaaatgccatgtgatgcttttatatgaaacagcctatagtacatctaaagggccttccttacacatactactaaagaaactaggaacaaatttagctttagcttttcagtgatgaaatctcaaaagatcaccttagcttgccaatataggtgttgctcccctttgacatatcactcatgtcaagggaaatcaggtagtctgtgcatgtgggcttcctgcatttgcgtgcagcaagtaggaacttcccatcatcggcaagtgctgtaaaaagaaacttcccgaaaatagtaagcatatatccattatacgccagcatagctgtacttaatttggcgtaccaggggtggataaacagcataccttctgtgagcccaatatacagataatatgtctgagtagtccggtttcttcttatgaaacatttaagagtgccgtctcttgggccaggctgcacatcacgtagacttgagtaaattaggactaagatgacactaaaatgaacttgtcaaccaaaggttacagtcaatgaagtggcgtcaatttctacgaaaatgacagcagagaaatggcatttgatactggaatatcatgctaaacatgtgaagcaccgcaatcaaaagggaaacggcttcatcagatagcatttatgcatccatcacattttcttgatatgcagtttgttttctagcccaaaactagataaatcacataagggagacaccttccaaaaattaaaacatactagaatgccatggttcacaacatccattaaaaagatgatttggctgcttgcaatccatcagagcaaagccgacatacgcaacagcgcaacagaatgcagggctttcatccttcaccgcttgacgaacgcaattcagcagctaaccaatcaatcataaagtgttgacacaatgaacaaataattcctaaagattaaacaatgaagcttcaacacaatgaacaatcaaattactaacagttcgacatcgcaaccgggaatttcagaatgaaacgagagcgcgaacctgcttgagcgagatggggaaggtgagcttgccggacgcctccgggacgcggacgatctccttggtgatccccctccagctccggcagacgccggcgcacgccaccacgtccctccgcgacggccaccacacctccgactcctcgatcctcaccagcacctcccggagcagctcgggcggcagctgcgcccagcagctctgctgcatcgccgccgcctccgccggccccaccgccgccacccgcggcgcgccgccgccgccgcggtgggaccgcgaccgcaggctgtgccgcgagatgctcccgaactcgtccctcatctcctggatcaggctcctgaacgacatcttcctcctcgctcgattccccctcctaatccacacctctcctccaatctctcaaatctgcaggctgcaaccgcgccaagaaaaacccggtcacgaaatttaccaccaccatttccatcaaatcttccaccaaacggaacgccaagaatcgcaagaacagggggaggaatttcaccgtactgaccgagagacgggccgagctaatttcaccgtaatgtctccatggcgtcgccgcccatgccggaatccatcgatgaacaccaacaaggcaccgaactgagctggaagcaagcagggcggggaccaaatccctcgacgcagcaagcaagaaatggcagaaatcctcacgcggaggtaggtgtctccgccgctgaatcccagaatcaatccaagggccaagaaaaccaccaccagctcgaagaagcaagaaaacggctcgaattcaagctctcaacccaccaaacagaacacccaacatttatccgaaattgagcacgaaaattctgcaatggattcttggctggaaggaggaggcggagggagcaagaacaagaagaaggcagaggcaaagattccaagaaacgaaaggcggaggtgaggagggaggaggaggaggagcaggtgccttgggaatttttaggtggtgaatgggtgattgataggtggtggtggtgtaggaaggaatggttggggaatgccagtatactagtactacctatgattgctactacacaaaaaagggaatggaatggagatggagcttgagagcaggtaggattagggttcctccctccctcttccttccttgctgagtggctgaaaaagatgggcatctcacaactctccctccctccctccatgcacacatccatctatccatccacacattcattgtagcacaattaattaactaataaatgtgtgtataagtacagctgactagtactaatccactcgtttcaaactataataagggttggctttaatatggagtaaatattaagaaaataagtagatatacaaatgaactagctaagactatatatagaacacatagatggtacaaccagaatggacaatttactgaataaaatcatattatataaataatagggttttatatttataataatttcgttttaaaagttattacttactctatattttactcctacagtactggttaactttgcatgagaggcgaattataatactaatagaccacacttgtggaaaagaagaaaccaaattatcaattattttggcatgacactctgtcccaatgtcattgtcagggcagggatgatgccactatagccaagggaagcatcattgctcaagcttaacccaagtagtactagtactcctcatgattgattgcttccatctttgtgctaattaggcatggagtgcaggacacttgactgtacctgcccctcactttccaagtgtgagtgagattaaagcacaagaaatgaggatttctttttttttttcaaggtacaactctgccagtttggccaagcaaaatgttggtactatcatctttgcatcatcatcatcatccacctgaggaaaaacagtagaaggtcccttttaatgttcaggtgaaaaacatgagatgttttattgggcttttctgctatttttctttcacctcacatgtgttagtggcctgcatcaaataacggggttttttttttgcatgcatcccttacatgtgaaggcagtggtcgcgcgcggagaatcgagaaagtaaatgaccggcgtcactgcctctcattctaaccacaaatagttaatggtcaataaaataaaatgagttactagtaatctctttctttttctctcaaaaaaagttactactatttctatttacagaaaaaagtttattcccctgtatttatactcaattgcatacgcaccccgtttataaatattacttcattgtcatgatctttgagataaaatatagagcttttattctgtaacttgatgattccccgtatgttgttgtaggatattagcttaacattggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36358 - DNA, 494 bp, Oryza sativa
tgtgttttcagcttcatgaaatggcaatcgtctcatccattcaagaagcacaaaaggacaacttaaggagttttaacaattatatgatgcaagttctcgaggttgtttaccctttcctgctgctaacttcattacatatatatatatatatatatactagcaaaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgctgaaatatttggtatttttaagtaggtatgtgtataattaaataaatttacaagtaaagcaagtgtgagaaataaaatgacatggttaaatttaatttttttttttaaattctccatgattagttacgctctttgaaattatatttgaatttttcagagcttaattgttaattttattaatacaaacgt

SEQ ID NO: 36359 - DNA, 1120 bp, Oryza sativa
aaatatattgtgattgtgaaaaacatattattttgtaattgttggtttgcattaacaaatattgtcatagcgttagcacgggcaaattactagtatttctagctatcattcataatattagatctgttttgtctttccttgtagtgtcaaaagccaagatgtaaaaggctaattagtagtattatgttttattcatggattcatctaagtttagaagtccatgttgcaagtcgacaatgaactgttcaaaagtagggttgtagtgttaaaaggagggttgatgaccaaagtaatcaatagaggtgtagcaaaaaaaaaaagagaaagataagataatatgccacttggagttgtccatttcaatccatatattcaactcaccagtcagcttcaatgccgagtcaaacctttccaatataagagtgtcatgacccgagagggaaatacccgacaatccttgatgatgaagaattatggtgttgaagttcctccacatgctccacttgaacgcttagcacttgcagcacaagtatggtcttgtagtttgcggtatcgatgactcctaaaatctccccatcatcaatttccatctcaggaacattggtttcacatagaaggttagcagcaagagaatattcttgctcaacatcactagaacttgcatatccaccatcatccgtagcgatgtatgcatgctgacttgtacaatccttcatgacatgtcacatacccttgcattggtgtcgtatgatccgattgtttgccccgtagaagctactgacgaggtacttttcgtgggtacctacactttagtagacttgtaaaatcaaagatgtttttgattattattctgtgatgaacaattgggcattggatattattggttttattatttggaatttattcacgaagtggttttggagatgattggatttcataggtgaatatacaggtagtgctggatttgggtccggtcagaccgggcacgggttgccggtcggaccggcgtgtattgcgcggtcagaccggcgcagcccactgtctgaccggccgacgctgtgtcggtttcagtttcgggttgtttatttggatatccatgattatttcataattatgactt

SEQ ID NO: 36360 - DNA, 1459 bp, Oryza sativa
gcgtttgttcttatcttacccagaggccgcggcggtggcggcggatgcggttgggcgacgggggatgaaggagattagggcggggtcattgagggcggcgacctggaagttgagggcggcgtcgggtggtggtggcggtggtgcgcaggggcagatcctcgcgacgactctgacgccgccgccgccgccgccgggttcctgcttctgctgctgctccattcccagaattttgttttttcttttgtttttggggttgtggagatcgatctgggggatgggaggagatttgagaggagcgggggggtggggggaggagaggaggagcgtttctttcctctttttgaattgggggaggctgcggaagcggcggaacggtcgaatcgagtagagtcgtgtaggggaaggaggggggaggaggagcatagtgtgcgccggtgcgtctagcgttagtgggccaggcccatgttaaagcccatgccatctctcccccagtcctcgcaatggaaaagtacaccgaaggtccctcaacttgtcatcgagatacaaaatcgtcccccaaccgtaaaactagatatgacgcatcatccaacttacaaaaccagtgcaaactaggtccctcggtgattttgaccccggttttgtccgaacgtggcgggtgaatcagcgtgggccccatgtgtcatgatgccaggtcagcaggccggcctctcccttcctctcctttcctcgtctctttctcacaaacacacacaccctcctctgtggactgggcaggccagccagcggtggggagaaggtcgtcagagcgaggaggtccgacaggcggccgacgatgcggtggcggagacacgagagaagaggagggtggcggcagggcgaggcggtgtcggcgggcgagcgcggtggcggagaggcgacggcgcctaggcacctccacgaccaccccttcaccgcctgcgtgttgtaccgcctcgcccgcgcgcgcctcttcccactcgtgcccccgctcctcgccgcattgcactcccacggcggcccactccggcccaccgtgtttgcccctgtcatcaaccacctcggcgccgcttctcgccccgacgctgcagtcgtcgtcttccgcgccgtcccagccttctactcccactctgccgccacattccatttgttcctcaacgccctcgtttccaatggtcgcgcggatgccaccaaggacatgctcccgctcgccccgaagcgaggcgtccacctcaacgccgtgtcgtacaacatcatcctcaacctccttcccactgccggccagcctgcccagtccagagagaagagtgagagagtgaggaggaaggagaggaacgaaggggctgcccaactccactccgccggccgccgctcctctcccctggccaccattcctctgccttgtgggcgcggccgacgggggagcccgcgcgctgcccgtccc

SEQ ID NO: 36361 - DNA, 595 bp, Oryza sativa
gtatttggcgcacctttccggccagagccaactcggcctgctgtttgtgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcct

SEQ ID NO: 36362 - DNA, 1017 bp, Oryza sativa
tcacgcccactacagatgatgtgttagtattgttttgccatgtttggcaggtcaaaagatctaggttttaaaaataagttttagaagagtttatttttaaaattaaaaattgaaagtttcaaaaaaaaaaaaccagttcatagacattatctattcatcaactatcatatcagcggaatcaagcagctctgctcaacagtaaccatcgtttgggctgtgtttttttctcccttttctcaacttctatttttttatattttgcgcgtatgtttcttaaactatattttacacaacttttttaataaaaaagttcatataaaaatcatattaatctatttttaaagtttatttagctaatgatacgctaaactatcgctctgttttcggtacctcaccttacagcacgtcaacaagagcagcaagcgtgttaggatagggatcggagtcggaatcggaatgcgatggtgactcgccgagccgcctatattatctctgcgacctgtgtacgtagctgcttcccaccgtcatccaaactaaaaatctttctgccacgcctaggattaaggcgccccgccgccgggcgcgcctcccgcgccgcctcccggcgctcaggttctccgtcgccgacgtgctctcgccgcgctacttccactccaccgaccgcctccgccgagccagggcgcgcggcgccgccgacgccgaggacgtcgagggcaggctgctgccgtacatcaaacgcctggaccggcgcgccacgcgcgcgttcctcgacggcctcgccggggtcctggacgcgcccggcgctcgccgccggcgcgccaggtcgctctacctcgagttcttccgcacctacgacggcgccggcaccatcgaccggatgatcgacaccgccgtcggggagtggggcgtcgagcacctcgacgtcgtcgtcctcaggtccgcgccgcgcgaccccccgctgccggtgtacgccttcccggcccacctcctcgacgacgagcgccaccgctcgcgcct

SEQ ID NO: 36363 - DNA, 672 bp, Oryza sativa
tcgcttctcagctcgagctagctcgtttagctcgcgagccaatacatcgaacagatgcaaatacatattatacaaccaaaatgtccacgaaggcaattgtatctccatatcaaaccaagaaatcacatgctagctcaagtgttcaacaaatgaatcagtattcatggtagctctacctttaacaataatcttgttttctggtggcgatatacgagatcgagcacaagtgctcaacctcctggatccattgccccatgcctgcaacctcctcctgcccgaccattacaccacttgaccaagacaagaacgggagagccgtgcaggtggtcgaggcgctcaagggtcggcggagctgccgccgatggagggagcgtgatgcaaggacgtgaggcgcaccaacaaggcggggccgtgtgtggcacaaaaaaggtcgatctggattgggaatttcggatgaggggaaagaggaagatgaaaagctacactgatcaaataggttctggtctttcctttttgactgttttctttggacctaccgtgggatggattatttttctacatatgggccttggcctactaacttctctgcctatgcttctagctcgtttaagctcgtgagcagcttttatgtgtaacgagctaaaacagctgctcggcttgttgaaaaacata

SEQ ID NO: 36364 - DNA, 529 bp, Oryza sativa
caaatatgattgtgcaatataatgatcaaccttgtaatcgaccaagaacagctccgcttgctagcccaccaacaacggagttcatgggatcatcaggtgttgaagcccgagcatctcttgcaagttcacgtgctcctgaatggaaacaagcacatgcattacataaacatgttgatatataatatattcatccagaggctccatgtcccttattaacatgagcttacagaaaatataagtgctgcaataaatgagaagacgctattccaccttttacaaacatgtttaatatgttccctaaaatgaaaatcatagtccaaaacgaacagtgcaaaagtatgtattctaaatcccactaaaaaagttatgtattctaaatagtagattaaaagccacaagatagaacttgtacagttgtagtaccaagcagaattaaaaccaatgccagattctgatgtgaaaaggacaacaaatgttcatacttcatactgtgtacaaatgtaagcaataatagctcaaaacaagttca

SEQ ID NO: 36365 - DNA, 732 bp, Oryza sativa
catagacaatcttgaaagctcttctacggcgtggattcaaagtgagccaaaatgcgtcacaaaaataagaacaagggttaaaacattaaaaaaataatcctgctatatgcaatgatttagagaggcaatgcacaatgatttagttctccttcaggctttagtcactttatacaaaaacacaaaaaagaccaaaaaggaaaaaagaaaaccaaaactattttatatataaaaggcccactacaagtaattacccactaggcccataaaggaccactacaagtcattacccattaggcccatcaaggcccatctaaaatttctagggtttcctcatcctcgatggggtttatccttcgagcacatatataatccgcacgccgccgcctccctctctgcttcgcactccattttccctctccccgctcgccgccgccgccgccgccagccaagctcgccgctcgccatgggtaagcctccccctcctctccctctctccggttcatctcgattagttttagctctcaatcccttccggatctgaccgtttcttggacaaatgtcagcccggatcaaggtgcacgagctccgggggaagaacaaggcggagctgcaggcccagctcaaggacctcaaggcggagctctccctcctccgcgtcgccaaggtcaccggcggcgcccccaacaagctctccaagatgtgcgcctccttcctccttctctctcgctcgtt

SEQ ID NO: 36366 - DNA, 563 bp, Oryza sativa
tagaagacgtgtgcacctgtcagcatggttggagctgctgtcaaccatgaccacgagattaggagaggatgcagcggtggccggtggcagtaggcggaggggaggcagcggccgtgcgcccgtgcgacgctggaacagcgcaccagattggcagtgcactggaatggtatactggacacgtggcgtgattttaccatacgcaaacttgcgttcaggttttgccacgtggcccaatcagcgccagggtccgatccctgaaatcggtataagagattgatagcaactggcttaacttcaatcgttgaggtattggaggtaattttcataatgtgcgtaatgatccatatgctaaatttaaggttacgattccctcttttcattgtgcctatgatgctgaagcttattttgattgggaaataactgtagataaaaaatttagtgcacatttattcctggtgagcatagggttaagcaagctactagtgaatttaataattttgcaacagtatgatggactcaaataagtacagatggactagcacctacaacatgagaagtgttaa

SEQ ID NO: 36367 - DNA, 674 bp, Oryza sativa
ccccatatgagtgtgctatatatatatatatatatatatatatatatatatatatatatatatttgtaaggtatagcaccgactgcaaaactgatacgattatgaccactgaaccttgatagaacttttatcaaacaacaaaccaaaaagatcaaatccatgaaacttggtactcaccagaccattgtaaggcaccaaggatgatagctcaagtttataagacggatcacccagcctagtgatcactgagacttctccttgtcgctcctgaaagtcaacaaaaagtcccattagaaagaaagaagtatttaggttccagtaccacagctacatgtgaaaagctgatcaattttaccgagaaactgtctaaatgaaaaattgagaacccctttctcgcgattagtaaattaacaaaatgcacacatactatatcataagcaacggaacagctgaacaacacttgatgggtaaatgcgggtgactaaggattcaagccagaaaaagaagaagtgtgccatttaccttgacatcgtgtgagccgcggagctggatggcgccgccggggagggagccctgcccgctgagcagcgcgttgcgggcctcgacgtcgtacagcacggagaaattcttggcgatgagcccgaccacgggcgcgacgaatagctgccgccgcg

SEQ ID NO: 36368 - DNA, 9343 bp, Oryza sativa
ggggtgcgggaggctctggaatccctggctcggggttttttccgtttacaaccctggactactgggttattctgttatgtatttctgtgtctgtatgacagtgttctactactgcagtggtattattactcgactgaacagtaaatgtgactgtcagtctgttaagttcagtggggacccactcattactacatgcaggaaaggctgatggcttttttagccaatattttgaacttgaaagtagaatttgggtggttccaacttctaacagtgtgaagtttaaacagtgatcccttgtttggtcgtatgatttgtcaactctttggttgtgcaaagaccaaccacgtggactcttgtgtctaggcaaaatcacttgaggatgtgttcggctgtcctatttcaactacgatacagccatgttgtacagtaatttgtgtcattgcaagcagctgtgtgggtgcattgcagcagtcgaacacaccctgagattgtactcccatagtcccgtataaaacaaacttaggatacatcataatataatgaatctgaatagaatggatcacatcccgttctagatttgtatttttactagttagcaacattgaccttttctcgaaactttttaaatttttcttatggatagaaatcaaacttctactttttggatattttctttaaaaaaagcattttaatttgccataaagcatggaagttcaaacaactaaaaacacgtgttactttttttaaagctcatctttcaataattctagctttgcttgaaacttttttcaaccagaactacaatatcggttatttttcacccttgatttttaaaaccaaggagaagcattgacggtgattttggttaaggtgtagtatgcatgactccacctattagagtttaaatcataggaaacataaatgttactccctccgtccgattcgtagcgctagaaaatattccatccgattctaagttcttatattttagaacagatgaagtgtgcatatagggttgcgcttttgatactcctttgtttcaggttataagatgttttgactttggtcaaagtcaaactacttcaaatttaactaaatttatagacaaatataataatatttatattatcaaattagttttattaaattaataattaaatatatttttataataaatttatttttggtcaaaaatattactatttttctataaatttggtcaaatttaaaacagtttgacatcttataacgtgaaacggagagagtaggttttcagtgaggctatttttttagaaaataggacaaacgtggcctctacgtccgatcggatgtacacagccaattttaggctatggatgtgttgttgatctttgtctgtgttaaggtggtgcattcaaggatatctaagtaaggtagtggtgtgcgcgcgcgtatatgcgtcttctaagtagttgtaaaaacaaaaactaaacaaaaaggatacctttggacatatattttttactccgttttgttcgtaagtaatcttggacaaaagaacaccttgaattggccgatgtacgagcctgctcttggccaaagcgtgtaaattatgagaggtttatggtattgaccacacatgtatcaatttacattggaagctccgttcacataatccttttcagggtgaaaatgtattgtcgatgaaacaaaaaatgaacacaatgtgccgctgtgctccttgctttgtctcgatcagtctccggggttgtgaacttgtgataccacagcgttattattggccgagggaaagatttaccatgtactaaaacatatccagggcatcgaacgtactcttgctctacaaaaatcttgtgtggaagatcgccatttctactgatgacctggaactgatcgtcataccaggtactactagtactcatttttcctgcaatcagacacgcataaacacggaattgctgacgatcagcaacatcaacagccgctgttccttgcaaacctgtcgtaattaagcacacggagacggcgatttgcagcgtcgtcttcagagacacacactgcaagtctgcaatgcaaattcagaactactcctaaccagcaagacgtagctagttaacgacagagccacgcaaagagaacgcgaccgcctttgcttcttcttaaggcggagagggaaaaagaaaaacacgaatctgataacgagatcgaggtcaacgggagcagagatcgaagaagcatacatgacaaaaaggaactcctattgcagccgcacctcaaatgaaccagagaatcgacgaaaccatgcatgcgtctcacgaacttgtttgctgatggtcatctaaccacgcgtgcccaagagccaataagccgactgctgcatcgtcaattattctccaatctccaggcatgcacgggtagctagatgaccagcaacaaaacaggttcatgggtagcaataatctcacctgcacaccacgaccacccctagtattctactagtagcaattagcaagcccagagcataatctggatatattgtcaatgagaagaaactggagctggacgcctggaagactggaagatggggcgaatgagatgaagctgctagtgctgtattgaagcgaaggatatattttggatcgggtaggtgcgtgcacggaagggatgatggtacgttgatgccagcgaattagaggcatattcgcgaggaataaaccgtcccccgcagaagcacgacgacatggaagcatcaagtaattaagcaggagacagtcagcaacatgtatgtacgtgcacactctgtagtgacgctgacgctgtgccactggctgactgtactgcctcttctgctaggtggagatgatgagcgtagatttggatcaacggtcttggtaaattagccgtgacagggaggagttgtaccagcggacgaacgcgtggattttgcggttgtccagtcatgaaaaaaaaaggaatactctctcttactcgtagagaaagtcattttggacagtgacacggtctctaaaatacaacttttacttattgtttctataaaaaaatatttattgaaagtattatatgtatacttttatgaaaatatttttcaagacaaatctatttatataatttttatattttcaaactcaacaatttgagagttatttatgatttatattttcaaggtctgacttaaacattgtcctaaacaattttctttacgagtacgaaggggtattatatatatccagatatactcctttcaaaaaaaaaatccagatatgagcgatgatggggcagcagaggaaggggactgttcggaacggatgaaacgctcgcaaagatgtggataatttgtaggcaaaattgttcccctctcggactgttctaccatgtgtacaaccatcctcggggcagcatcgtggacttgtggtgagagaggcctgcggcgctatctacgagggccacgtacgactccacgtgaccggcccacggggggagtcctaggtctaccgacgcaatgggctgctacccccttgagatacaggcgagaggccgagagccagcccaacctgcatggcccgcgcgagtccctgacgtcccccgcggcgcgcggcgctggtgtgagtgtgtgacgccgtgacggtgtacgccgccgcaacggattccacccggcgcagcgcgctgcgcaaccagaccacgcgcgggcgccgcacgccagaggcccagagtgcagacgcccgcctgtgccgatgggtggagtggaacagaagaaccaaagctccgggaagtattttctacacgtgtcagtacctagatggtcctgtttggcacggctccagctctagctccatctctcctggagctgaagctcaaccaaacagtttcagttctatctaatatgggagcggagctgggtagagctctctcacaaaatgaactagagaggtggagctgggtttaggcagctccataactctactccagactcaactgctggagctaaatttaggaattggagctctaccaaacaggctctacatgcagtttataaataaacagttatataaaaaattataaattttaataagatagcttatgataatataagacactgtacaaacataaaagtctaaattcgatcaacaaaataacagaattttttttgtcgtacaagtattattcattaccgatgttaccaattattttttatatttttataactattcaagtcacgagcaaataacgggtgtcatgatagctgctgcagagaaccctgtcaaccgagctctgctcgtcagcccgtccgtcgtgctgctgcttttgctgctccctccatcctaaaaatacttaatctagaagaggatgtgatttgtccagatcgttattcagagtccatatcgtggttgagtttttttaagatgtagggagtacttggcaaggctagcaaagtgattcgctatatgtagttatgagctgatcattaattgattgcatgctgcttgcattaaaaagggcgatatgtgagcatttcttttccttcaatctacgtcaaggtcactgctcgtgctcggcatacgcctcggagagtggatcgtggttaaagcaggaatttagtatactaccatcacaaagtctaagcacatgattttcgccaagacgatatttgctatggggataagaatacgagaacaatacgcaaaatgacaatatataacgcagtaggagttcgttaacgtcaataggcgatgctgaatattttttaatgtccagtgaccagaatacagcggcgccccctgttttgccctggtttgccatggctgctagctgtcactgctcaaaagcagagcggcggcgacggcgaccaacaatttgtgaagcaatgccaagctaagtttctctatcatttaaccacgtactgtttcattagtctatggcactggccacctgcctcacaagtcacaaatttcaattttcaaacgactatgatacaggcaagttggctttgctagctaggcagtattaagatgccaaaccgccacatagctagcttacatacacgcaattagggtcaaacattttgctctctactgcttccatagttccaaagacatctcaggaaccaacactgtttgctcaaggtgactgttcagtttcctatgtttgccgttccagttcttgtacatacaatgctttagatgtctcctagttcatgcatactcttctttctgcaatatgtaccagagatttatcagtttctttttttttctcgcaaaactgaactggagtagggaaaaaaccgaatctttaacatttgatcacatttttttttttgcagggctagctagctgctggtgatcacacagcatggcgaccaagtacatcatcggatcagtggctgcatccttcgcattcgcctatgtctgcgagatctacatcgcggaaggaaagcttcttggaggtgagctagcttaattatcttctctgaccaccgagatctccttagctaagctgcctagctagcttaagtacgtagcttgcagtttatgtgctctttctcttgtgttagtgtttattagtttgtgtttacttcagtttatttgtgttttatgacttgttgaggtgtgctcgtgattgagtgaattggtgtaataattgactgtaactcgttaagtaaaggccgatattctattccattatctaaacaaagtagcttgcaggtcatcagcatctgaccactgcttgcttgcacatgtgtttcttggcaaaactaggcacgacgactcggaccatggcgactgacgagtgggggaaggagacggacaagaagttccaggcgtggccgcggacggacgggccgcccggtggtgatgaaccccgtcaggcgccagaacttcatcgtcaagtcgtctgaataaatcttcttcatcagccctccctagcattctctcggggaagaaagaaagccaatattgttgcgcgcgtgtgctgattaagcccgtgcacaattcacctcctgtttcagactttcagttaaagcaaactagcatgtatttttgctgtaatttttgtgttaattcccggtgagaaatcagctcgaaccgcacggttaaatgctatagcatcgcgacgatcctcgcagtttgtttctgataatatttagtgttcttcagggacgaaaatgatactccgtagaatagtaacctcgaacaatttgtagtatttatgttcgaaacagatttagaatttgttttgtttgaagttgcaaacataatattcagagagccgcatcaaaattccataaattaaattcagtatacccggcacactttgtcgttccttggtgcaatttgaaaacaaggggtttggagcatcggttgctataggcctatagccttgccggcgaaaataagatgactaattactcaatgatttgtactcaaatgatcgaccaggaattgaaggtagcaatgtagcattcatattgcaaaatctgtagtacattatattgaattgtttcttacaaagaatacatatagccagaagggctgcctatttccagttagtaaagtaggggagtgttaacctatattgaatctggaaataggaagaaaacctcatgtgcttaaaaaaaatataggcctcatttagaatgtaacttgcctacgtttctcttaacaccatgaatgtgtttttattggaaaagttatagtcgaggcaacttagaattaagcatcggagcatgtatttttatggtataagctttcagaaggtgttcttgcatacatgaaaagaagaaaagcaaagaaaaaccattgaactaattgtaagtgtagaagttgtgttgcattacctatttacctttactatgttgaaagtgtaacaaaatatgtgcatctaatatatgaatgtgtgaaccttgacactatcaatgaattctcaagtgttgaaatccaggagatttgtatggtagacctatcggatccaccaatcagatatactccatctaacacccataaatacaatttaaaatacacgtcaacattaatgcatgaaaaatcataaatgcaatgagtgtctaagatcctaccgtgcctctctctatataaactcctctaacatatacaatagagtccatatcgaagtaatattcttctaatatgtccaattgtccaccatgaatagaaggatgggttactcataggctgttgttttcatgtcttccaccttgccatctgctctctaagacgttaactttcactaaactgcaattttaactttttgtttattaacctttgtttgatatgtgttcaataatctatttcagttttggatcatttttcgaatttgacaaaattacatgctacaaagttgagttctactaagggaatatgtataagcttacatgcacatcctgtggtttccctcgctctccgtactactgcaggactaaaccaaatggttcatcacaatgttgttgtgaacgatacttcttcggtgatatcagaatgacattagaagcgatcaattggtggccttcttgcttggtcaatattgaaaaaaaaaatgatgttcaggattgaatgtaatagtctaatactattagattccatgaatgtgtacaacaatataataatcaataaattctcaaatcttgaaatctacaataaatgcaaatagggatatgtccaataaatctaaccatctaggaatcctgcaaaccatatacttgcgctatctaacacaattaatgccactgcaaatatatatcaacatcaatgcagggaaaaacataaatacattgaatgcctaaggtctattgtgcctctatacaaactcctgcaaagctctaacatataaagtggataagattgtgttataaatcatctaatatggccatgagaaggatggggaacccattgactgctgttttcttggctgttatggtcatgtcctccaccctaccatcttgctatgcaggtactagggatatatgctctctaagactttttaactttcacatcactacactttaacttttcatgtattaatctttgtttcgatgtgtgttcaataatcaaatgttggctttgaatcatttcatcgtgaaacgtgaagccgatgaagggacgtgctacgatgtcatgttctgccggggtgatgtgtgcaagcttagatgcagataccttggttaccctgacaatgctccgtgctactgcaagagtaaaccggatggttcggcacaatgctgctgcgaacgatcatcactctgatatcggaatggaaccagtgattaatggtggctttcttgtttggtcaatgctatatatgattcatgattaatgtagaagccattgatccctacttgctcttgcatatgtaaattggcgatcgaacaagtattttcaggtctcatgcatactcaataaacttggatttgctatttgttactacttcactgaaatttctaaacatttgttttcatttggagaatttgtgattgattactactagttcctcgcttcatgctccttcaattgcaccaagaggatccgtagaacatatgaatagaataatctgtagaagcagaacaagagcttatctgtaattgtccatatgtgatacgtatatttcgattttattgttgattcgtcgacattgaatttggtttttcagacttgtgtaaatcgatgaatattctcttaaaaaaacacaagctggatgtatttggtgatgatgatttatcatttgagttgtacattatgttcaagcgtaaattgcgaggtttgtaactctgccatgtttaagaagattaagattaagattctgagaaaccagtttataagaatatagaaaatatttggaatagcttatgactgctgaagattctaaatagttagaactaagagtatctccaagagattatctatttagctctctaagttaaaatttagccaacatagaaaaaaaaggagctccaacaaactttccaaatagacaaattgctcctatgactagccaaatgtagccagccaaatgtagccagcctcttccggctggccaaagatgggtcccaccaccactcccagccccatcctttctctctctcctgtccacccaccactggtccataggagcgccatcggcgagcgaacgaggaaagcacgaggcggcggcggcggcggggacgaaccgagggcgccgtcgacgagcgacgtctggtccacagtccgctgcagcaggcatcatcgtcgccgccagcggggagccgtcgccatatgcatcgctgctgccgcgcgaggagttgtcaccgccgccgcctcgcgcgcgtgaggagcaccct

SEQ ID NO: 36369 - DNA, 6321 bp, Oryza sativa
cgtcgtcgtcgcgagcctccgccgcccccgctgccagcctatgcacagtcaacctccatgcccgcatcgggataggattggtatgggagaagaaaggagaggaaggaggaggaacgagagactgacatgtgggacccgatgttaaattggagaatgtgaatagagagactgttggagtaaaatgcaaacttggctctccaattctttagatggctggccaaatgctcatttggagagcttaaaaatagccaatctgttggagatgttctaactgacaactgacagcaagtcaacaactcctccaaccaaagattctgggatattctctatggcccctattcttttctccaacaaaagttggaaaaaattttggatactcgtggcacgcttttcaaattgttaacgatgcgtttcatgcgaaaactttatatatgaaagttactttaaaatatcatattattttattttttaagtttgtaataattaaaacttaatttatcatatgttaatatcacctcattttgcgtaaaaaatttaatgaggattgaggagaaaagaaccatatgtaccaaaaccaagatgaatttgggcacatcgatgtgatgggcctgtttacctttggattgggaatgagatgagcaaatccggcctggcccatattcccttgtgggctcgtgcaatgttgggcccttacggcctgcctatgcgggcaaaaaaacctatccttcctctaccacatctagtaatttccactgacatgtggggtccacacgacggcctgttcccacgagcccacctgtcaggggcggtagtttccacaccaagagacattaccgcgttcagtgcgcaaagcactgccactttgcacactgacaggatgggcccactagcagccacacccaccaatttcctcctcccttcttcctccttcctccttccgctcttcttctctctcttctctgcatctctctctcgtcgggaggagaaaggaaggaagagggtggcaggaggaggaggaggccccccccatccttcctccctcccctgcgctgagctgcgatggcggacggcaacccggacggcatcaagagatacacccctcccgtgcacaggtccgcctcgttttgttccttcttcaatccttagcgtttacgtgagctggggggactcgtaggcgatgagaggtgtggcgtttcttggttggaatctggggggtggccgtagtgaagaatcgcattgggagagcgagttaggaggaggggcgggttgctttgcttgaatcttttgtgggtgagctgatttggttggggggcgtttctttctgatttgggaggcttttgtcgaggagcttgttcgattggatatttcgatttgggtcttttctgagcgtatttttttactgggtatcatgcttcgaggcttgggggcatttctgtgctgatgtggtcgggatcattggaagcttggtgtgttgccgttttgcttagatttgggcggtatattagattttttgagctgctttgatgggcttgatctgtggtgccacgtacaaatctgtgtccagtgtaaatcgaatatcgttttcttttatttggtgttctattggacgttggctttttgtgtttgctcataaagaacgtgtgggttttagtacatatatctttttgtcgcttgcaagctgccgtttttaagttttgtggtggtttattggctcgctggtctctctttttagcttttttgagaatgaacaaccttagcaactaacttttatccttaaaagaatttttttagaaaaatctttgttcaagctacatggctaatctaatggcttatttcagggcatgtttaatgctgacctaactacctgttttagcaagtgaaggatgacccatgattggaatttgggttagcgaattaagctaacatggcttagcaaaactctgccaaacagtcggtcagcttgtataagttaacgcatgactttaacacaacgcatataatgactagcataaagactatcatactttagttacatgtactgccagatattgaaaattgtcctttgataggtgatcgcgtaatcacaatttcacaattataagtggagttcacaatgaagaagtagatttgctaaagacatattgttcaatcagtctatcaccttgttgatttgattagttgataacttgatatggcttctttgttccatctttgtatttatgagctaaatatttattttgtttgaaaccatcagttatttcttgaaatattctgttgtctgcagtctaatgttagttattatttagttttaataatcttgctacatatcatgcatagatatgctttctgatggctatctttactgaatatgcttcaggaaccgtgctaacaatcgacgcaagtctggaggtaaatcacatttaccaattgaatcagttggatttcatgatgttttggggatttattatattttcctttattatttgtttggcttgactgctatataaggtctccaaattagttgataaggtcttatctagttgttggttgttatggtatcaaacttaattcattattcctctagtagatttctatgcagtgaaactgccatgtttcttttccacaaatgggctgaaaaatatgtgccttacaccgaccatgttgataaccactctatatctataaggaaatccttgcaagcaaatatccttgtatgagcccccctactccattgtattaatgatgccaatactctgtacaacatgcaacttcatgcatctaatgcaagctacctgcaatcataatccctacaatcagtcatttacaagtcaaatgtgttttttactcagagtttacttattatgtccaatagctgtccagaatcttctaaccttgacatgtctttatttgattatgcatatttccaataatttttttatgggctatcttttccttatccatgtgttttttttaatgatttatctgtatgtttaagcataacaatttaatttatgaggtgatttttttttggctgacattgtaacacttttgttataccaaacagatagggctgagaaggctagttatttgtacaataatgatggagagaagagccatgctccttcattaaagaaccttccaccaattatccctcatgagacttttttcagcaatcctcagaatgattacagtcaaacaagattaatacccttggagggatgttgtgccagtgaggctgcccagcttctcaatgaccgtatgtttctcagagagaccaagcttcccttttaactgcttgtagaatttctatgatataagttctatctttttgactttctgggaattgttgcatgttattgtggtagtgatacattatgtctacagtaataacatactactccctttgtcccaaaatataagcattttttagcatagtgctaagtcaaccatttttaactttaactattaatagcaaaaaaataaaaaaaaatcaataatgtgaaattgatgttactagatttatcattaatcaaactattattatatgcaactctttttatttaaaacattttatttctatagatattgttggtcaaagtagcatctcgaagactatgtcgtgatccaaaaatgcttatattttgggacggagggagtaagtagtaaaagcacatgcagtatattacagaaccgcccattgctttaataagtttacactggctgataatccaatattcagatactgtaagttgtaaagaaaaatacgtggagcacctgttgtgatttattttggggttctctgcatgttagtagcatggaagaatattcaaactgtgtacctactgcttatcctatcttttttgttcattaatcataccatcaactgttctctttatgtgcaattgtgcatatgccaccagtaatttaccggaagttaggcaacttttaatcaaggatggtctaagcatatataacaaatatgtattcctacagttgctgtactaattttgaaccaactttatttacaaccattcttcttatgtgataataaacctttgctgcttttcccctgtaggttgggctgcagcaatgaacttgtacaatgatcagtcatatgattcccctggtgagtccttaatcaaattcaggccgcatgatgggagatttactatgtcatgaatcatggtagaggaatctttagatattttaggatcaatttctacaagacctggcatactatcctagacctatgtttaatttagataaccgtttcataagttatgatagaaattggaggtgaatataaagtgttggcaacagtagtgacgccgcacaattatggtgatagcaattatagtactgtatagcaattcgtgatgttaatatgttattatgaacaccatcaagtacccaattgtgcactcaagtgaattttcatgtcagttgtaccaacgggaagcactaaaccaaagcccattaaatgctgttgatgttttgccagataagccggtgatgtactctggatctagtggatcatcatggggtcatggtcacatgaaacttcctcatcaggtatattgaacctgcgattttgtcatactgttctcctacgtcttagtttctgtactctgattccttttctgtggtcattggtagtacagatgaacttctctgaggagttgcgccgtgccctagatgagcaaccagtcacaggaccgtctgtcaacacctggaactaatcaagctcaagctgcattggagtgctaagatttacaaaaaagcaatctattgccagttcgctgtgtgttgtatcttgtactgaaactgtatgcatgatgcgactataaatgctttactctaacttgcaactcctttggtttataacagaaacggcaatcctgcccatttgtaaccttatggatggaaagccagcctgctgtatcatgtggagtactttagcatgcagaagtgcagactatataaaccaatgctatatatatatccctcttcttaagggtgaacttttgcagttttgtcagatttgttgcttcgaaagcatttttttgagtaaccttatttatttaagtgaagaatgcaatttgatgtaacatgacaaaaggctcgaatattggcttaagtgaacagatgtatgataaatacacaagacacatctattcatcactgaattttgtggagcagcatctccaaacagtcattgcagagaacagtaaataagtagcacagcaaaatggatcagctattagtgaggatgaaaaatgtcggttttaggcaaattaacatccacctgttgtccgcttgaatgatgtttaaagtaaacagagaggccatgcatctgaatctacaagaaacgagattttcgtcgataatacaggtttgtgactttgtataactacacaaaagagaatggtggacttaagagcctgcataaatttgacaacgtttgacaacgggtgccggtgggcccggtcgggcgcgagacggagacgagtagcacgattagcttcgccgcggctgaggggaattagttcacttggtctggtctgaaattcatctataaaccgaaatatcagatacaaagaaaaaatggttctatagcattgaaaattcatgatttgagttttatattaaaagttttgggttcactttaatagcattgaaatttacattcgttttaatttttagcactctgtcaggaattcagtcaagtttcatacttattttattttttttgtcaaagaaaacatgcaaaataccgataatgtccttctattctttagcctttccgttctcccatcttgcgctcatcctagacttcggccgccgtcctagagcccatccgccccagcagccctcaatcttgcccatgccaacaccctcgaggccgacactcgcctgcggccgccgccctcgagaatgcccaggccggcgctttcgagcagcggagctcgatcgccataggctgccatggcgatgctcgtgtctgggctcgccatgctcatgataacacgtcaccatggccaccggtaattaagttcttgttcctgcacacacagtgatgttgaggcggcgcagattgatcgaccacgatgggctgatggcagtgacaccaataggggcaccaagaagaacctggtgagcagttgagacgatgcaggttgcattcgcatcgtccctggcgttcgtggtcagccgcttgcctctactagtgagcactgaacagcatcggcctggccgatttcagcgtgggcggacgcctacattgttagaaacacagatatgttagttaaagataagagtcaa

SEQ ID NO: 36370 - DNA, 19364 bp, Oryza sativa
aatagattagaaaacaacataatacaacaattagattttccacataccttggaacttggaagagtgagaaacagagaatcatccttctgtacagtgtgcatattgaactgaagaatagcaaggagttcggaggaggaagaaacaaatggagagggtgactgtgacgaagtgctaaaaaatgtaactgaggtaactttcggtgctataaacctaaaatcgtaaactttcagtgctaaaactgaacataatactgcctaggatcctgattgatccgcttttagctaacgtggcagagtgggacccacatgttagtgaataacacttctcttcctcctctcctctctcttcccctctcccttccatatggtcgacgtcgaccaccgcctgccagtgccgcatggcctcctgcactcaccctcccatgccaccggcctccatcgcctcaccacccatggctctgctatcaccaccctgcgcgtgtcacccgccacagcgtctccctcctcctaccccacagtcgctcccttaccgtccactgtcctcgctcacctcgccaccgctagggtctctgtcctcccaggcctctctgaccccgagctcttccgcgtggcctctagcttcctcctgacctccgtgacctcttcacgatcgacatgccatctggatgggttcccgaactaccgctcctctgctgggctccgccttttccgcttcaccaaggaggaggtccccaccaccatcgccacagcgctgctggtgctccccggtagcctggtggggcgttgctccccgccttcccctcctctcatcccgctctatggttgacggtgctctgcctcactgggaacccggtgttccatgtctccgaatcccttcttactatatagttgtaatccactacaagcattaacttctctaaagcagcctccacgtgaagccacgtcatcaacatcttgcaaccatcggatcaagtgccatcttcgttggttcagcacccatgcagaaaactcttgttgattgacccaacccaacgttttcctccgccgagggtatcaggaccgtcgtgggactgctcgcctcctcaacgtgctgcactggcacaacatcaggaaactgccggcggcgtctcccttttcaccgcaatagcatttattttcattccaatgatgcaaacactgaaacacatcaacttatttgatcaagctcgaaaagggcaattgatcgccattcgcaacagtgcacatgtattgtctatttgactattagcttatttataacatttgttgaagaaacatctgtcttccgaatgttctcaaaattggcctgacaaaattgaccttaccaatccattcatatgtctcaaagttgaccttctatcttcatatcacttataatttgttataaagatttaaatatattctttttgttcaacataacatttagaaagcaacttttacaggtcgatattatgtatatggcaaacaacttcagctggagaaaaaacatgccaatgacaaggtttgcaattattcctctatcattttggccattaaattactattgtccatattaattgttctatcactaacccatctggcctaacatactgacagttgttttttcatatattttttttgacttgaagttgttttttcatatattgtattatgacacctttgtattatcattaaacttgaaacgtcaaccttttagtaaccctattttatcagaattggtcacttttcattcatacaaactatcgtaagcaatctttagttcatcacttagaatccccgccgcaacgcgcggggtatcacctagtatataaggtgatgaggccggatatctcttgaagtttttttttggttgtggtggtagttggggggggggggggtaatacgtaagggaaattcgacaaactattgttcaatatcttccttgtggttttcgaattatggaccaaggttgtgctcgatcgacgagcgaaatctcagatgattcaacattttccgtgtggtttccgaattagctagcttgcactatacgtgctatttttatcacgtttgtaataaaatgcaccggtccagctcacaacaaagtcatttattttcaatagacagggagacccaactctacagctcaattataatttcaaaataaatgatttaaagtccaaatagcatgtcaaaagcattaatcaaatagaactttcgaaaataaagaaatccaacgaaaagcatatggtttaaatgaaaggatggaaaatgaagcaacaaaatgtgcagctcacgaaaagttaaatttttaaaaagaaaatcagagagattgatgggtaaccttttgagctaccctaaaggaactaagattttatccatctagattgggctacacaaattcgacaaccaggttacctactgtttttaggttgggactatgcagtgttttatgaatttttagaccatgatgcaaagactcaaaaaatttagccaaaattcgtggagtctgctgggtatgtctacaagctactgttaaaagatagcatgattatcttttacggtttggactacataaaaagaagaacgccgctgtctaaagatttcagaacacggttatgcacactaattgagtttttaccctatgatacaaaggtccaaaaatcacaccaaaattcatgatgcctattctacatgttccttgtaaaaattctcaggtctatcgtctacggtttagcctaggcaaaattaacagactgactcgaaattccaaaacacgatcaaccgacacagaaagaaacttcattcatgttttaagttacctaaattcctcatcttttgtttacattaggttagggtggtacagaggctatgtgaattttgggtggtccatctaagcaacaatctacaggtttaagcacaacaattttatccttcacaaactacccattctagaccatgtcagtaaaatttgaaatgtcggaagagaggagttcaaaatctaccaaattcattttttttggtgcagagataacataaggagatggaaaccatatcatgtctttcaagatttaaattttatccatccattttcaaatcctataactagaggctatttttaacccgatattttgcaaatccgtactagtacataggtgattgcaaatggatttcaaaacttttcaaaacactttggaactgattttttatgattaataagtgttttcaaactcattttcactttagtacaagctttcaaaaggtctcggtcctatagagcaagataagagttttcaaaatcaaaatagagacctagaggaaagtaatctctagagagggatgatatataaggttgaatatgattttcgcaaaataatttgtagctgagagcaaaaccctcaaaataattttaagaaaccattctaaacgaccaacttaaggggttcctatagttggtattagctctggtaccatgcctgtggaggacacctgaactttacattatatctgccaattgaagtgaacaattcaaatcaagtagcaggcataatgtaaaatccgaagcctcaagtaaaggatataggagacattgctgggactttagcttgccagttaacttcagcctgagatgtgtccgtcaaaccacacgaaggcagtgactagatgtgttacacattcaggaaacttgacgaaaatagctaaagctctacgacatcccaaatatcctaaacccttactcatgtggaactagttcctaggatatccactagcttcacactttcatcttaagcaatgatacacagaagaaaatacaagacaaacaaaattcaattacaactactttagttatacataggccaactagccaaataatcagagattcgcgcaagcttgcctacccaaacaacaagcaaaccgactagggggttgaccccaattagaatctaattcctagaagaaacggttgaaacccgcatcactcaataaacactaagcatacaacctacaaaaatggatactctagtataacaagagtcagtacatcattagaaataatgtactgccaagcctaaagcaattctaacatattacatgcagggcatatattcaaggaaggctatatgtagttaaattttagcgtaaagcaagttttggttcacaattcctttcaaaggagttgatgattcaattaacaaaacaaattctgtaattatatcataaagaacatcatagtaccatcataagcatagctgccttccttggcaaggcataatatcatcatcacacgcgcacacacactcaacacaacacatttcaagagagaaaactagaaatgtttgatacacgcaaaccatgattttcataaaggcttggatgtgcaacaaaatgcatggatgagaaatgaagcgtaacgaagaaaccaataaatcgttagggacaagcaaactatgatttgcataaaatcagtaagctgcaatcaaatgtagacgtctagctcgcaaccaagatattcttcgataaacagggtaacataactataaaaattaaattagttataagtctactattaaaacgtcggagcacaaaaaagccgcaaggattaaatacaagcaaatattttcttttcacaaactagtaagcataagtttatacaaaatttcacaaactaaaataaagctttaaagtccaaagagaagttccaaaaagagaaaaattgtaactgaagaaatcaaacttaaagtaccaagttgaaatttaatgttgaaaaaaaaaccgttacgcgagaaacaaaagtaagattcaacgaaaggacggaaaatgaaacatcaaggaagaaacctagaatcatttgatacaaaaaagccgcaaggtttaaatgcaagcatatattttcctttcacaaacaagtaagcatatgttcgaacaaaattttcgaaagcgtcaacggagaaaccaataaattgttcggacaagcatactacgattttcataaaaccaaatagcatgtcaaaaacattaatacaatagaactttcgaaaataaagaaatccaacaaaaataatatggtttaaacgaaaggatggaaaatgaagcatcaagggagaaaactagaaatgtttgataaaatgaaaccatgattttcataaaggcatagatatgcaacaaaatgcaagggtgcagctcacgaaaagttatggattaaaaatgaagcgtcaacggagaaaccaataaatcgttccgaacaagcaaattacggttctcataaaatcaataggatgcaaccaaatgtagatgtctagcatgtaaccaatatattattttccgataaataggaacacgaaactcttgaacttagtctaaagtctacgattaaaacgccagagcacaaaaaagccgcaaggtttaaatgcatgcaactatttccttttcgaatatgggtcagcctacttaggaattcatattatttatgtggctcttacgatgattttgtctttggtgggggtggtatgagaacctatccttgtttggttggtggaatacgatctaaggtgtcatggctatgttgttttctaataacattacgatattattgattttaaatgtttataaaacttttcaagaatactagatttagaatctctaaccattaggatgtaacaaggttcaagtcttcatggtctacagtcatgatctaaccttgttgatctcacattcgataaatttaagttttaggacagcaagtaaggcggttgggaaaataaggataaattgaacaaaactttgggttacatcttaggggttggcaatatttgttctccgggtgctaattagtcatatgcaatctaatccaaggtgttctaggaatatttgtcgagtcatattggatgcatcaggacggtctcattatgtgcatccataaacttgggtcgtggtagaaaacgggatgctatatggcatgtatagcaataacttttctttttctcaaaaaggcaaggatgtatgtatgatgtcatgatgaatgaaatgatgcgatgcatgtatgatatgatacaatgcttatggagatattttgtattgcatacatgccatagaacaatcctttcgggaaaattgttcttgagactattgatcctactcatggtttttcatgggcattggaatggttgtaactctttatacgctataggctaggataaggtgacaaaattaaacatttttttacctagactcgtaacaaagttctccttatctaggaaagagatggtaattttaaaacaaatggattatcttagagaagttttcaaaacctaaaagtgaagttcctaaaccatgttgtgagttgctacgatgtacaaatcttgcatccgaccgtaaagggtcacaaaatttgcacactgagccatctcatcttaaattacatagtttgcttacgacttgttcctagtatgatatttccatttaggcttgtgggggcttgcaaaggttacatgttgtctctgggtttgtaagttcatggcactctatcccccttaaaataaaataaaattttgcaatggggtttatcaagaaatttaaatggaagagctaaataggtctatgtgccatatgctgtactatccagtcccgaggcgcaaactgaagcaaaagactatgctagatgggtgataaattagaaaaaaattatatccatgatcctaacaaagttttctcctatctgggaaggaatgttgattttttggacaaatagattattttagagaaattgggcaagacaagtgatgcagtgctggaatttatcggtctactatctttacctaatttttaggtaagttctaaaggttcataagaaatttttaaaaagaaaatcagagagattgatgggtaaccttttgagctaccctgaaagaaccaagattttatcccttctagattgggctacacaaattcgataaacaaagtatttttttttcgataaacaaggtaacgtaacaacaaaaattaaattagttataagtctactattaaaatgccggaacacaaaaaagccgcaaggtttaaatgcaagcaaatattttcttttcacaaactagtaagcataagtttatactacaaaatttaggaaattgagatttcaaaacgaaaataaagctttatagtccaaagagaagttccaaaaagagaaaatttgtaattgaagaaatcaaacttaaagtaccgagttgaaacctaatgttgaaagaaaaacccgttacgcaagtaagattcaacgaaaggacggaaaatgagttataagtcgaaaatgaaaatggtagagaacaaaaaagcccaagatttaaatgcaaggaaatattttcttttcactaactagtaagcataagttcaatcaaaatttaggaaatctgatatttcaaaactgaattaaagctttaacgtccaaagagaatatcaaaagcattagtaggagagaaagttcgaaaacaaagaaatccaactaaaagcgttcagtttgaatgaaaggacggaacattgaagcgtgaagggacaaacctaaaaacgatccatacaaggaaatcaagatttttatagaagcttcaaggtgcaacagaatgtatgggtccagtttacaacgatgttatttgttttcaataaacaagaagacgaatccaaataactcaattaataagttcaaaattaacgtcagagcaaaataaaacggtcaggcttcaatgcaaaagaatattttgcttttataaaacagaaaaaaaaagttcaaacaaacttaaggaagattaaccgtgacaacgaaaaaaattgcaaactccaaaaaggatatttgaagaatcaatgcaagaagaacattacaaaatcaaggaatccaactaaaagtacaaaattttaaacttatggataaaaaataaagcgtcaacgaagaacccataaatcgtttggaacaagtaaactacggttttcataaaatcaaaatgatgctaccaaatgtagaagtctagcccgcaaccaagatattttttcgataaacagggaaacgtaactctagaacttagttataagtctacgattaaaacaccagagcacaaaaaagccgcaaggattaaatgcaagcaatattttcacgaaccggtaagcataagtagatacaaaatttaggaaattgagatttcagaactaaaataaagttttaaagtccaaagagaagttccgaaaagagagtacctagttgaaattcaagtgtgaaaaacaaccgtcacttgagaaaccaaaataaagttttaaagtgcagttagcgtgtcaaaagcattaatacaagagaactttcgaaaataaataaatccaacgaaaagcataatgtttaaaggataggttggaaaatgaagcatcaagggagaaaactagaaatgtttgatacaaagaaactgtgacttttataaaggattagatgtgcaacaaaatgcatcggtccagctcacaaaaggttatttgttttcaataaacagggagacccgactctacaactcaattataagttcaaaattaacgtcggagcaaaataaaacggttaggcctcaatgtaaaatgaatattttgttttgttaaaccagaaaacaaagttcaatcaaactttacgaagacgaaccgtgacaaccaaaaaaaaaaggaaactccaaaaaagatatttgaagaatggatgcaagaagaacgttacaaaatctagaagcgtcaacgaagaaaacaataaattgttagggacaagcaaactacgattttcataaaatcagtaagatgcaaccaaatataacgtaaacccgcaacaaagatattttttctcgataaacagggtaacgtaactatagaaattaaattagttataagtctactattagatcatcagagcaaaaaaaaagccgcaaggtttaaatgcaagcaaatattttcttttcaaaaaactagtaagcataagtttatacaaaatttaggaaattgggatttcagaactaaaataaagctttagagtgcaaatagaagttcaaaaaaagagaaaatttgtaattgaagaaatcaaatttaaagtaccaagttgaaacttaatgatgaaaaaaatcgttacacgagaaagaacaggaaatatttaaagtccaaatagcagaacgttaaaaaaaaagcaatccaactaaaagcataaagtttaaatgagaagacggaaatgaagcgtcaagggagaaacccataaacgtttggtacaaggaaaccatgatttttcatgaacttaaggaagatgaactgggacaacgaaaaaaaaaatggaaacaccaaaaaggacatttgaagaatagatgcaagaaaaacgttacaaaatcaaggaatccaactaaaagtaaaaaacttaaacttatggatgaaaaataaagcgtcaacgaagaaccgataaatcgttcgaaacaagcaaactaccgtcatcataaaatcattaggatgcaaccaaatgtagacaaaaaataccaagttgaaacccatggagtaatataaaaaaaaggtcacacgagaaaccaaaataaagtattaaattccaaatagcagatcaaaagtattaatagaggagattgttcgaagataaagaaatccaactaaaaacataaagtttaaacgagaggacggaaaatgaagcgtcaagggcgaaacctagaagcgtttgatacaaggaaaacgtgattttcaaaaaccttcaaggtgcaaaaaaaaaaaaatgcatgggtccagctctcaataaagttatttgttttcgataaacatggagacccaactatacagctcaagtattcaagttatttgttttcaataaacggggagacaaaactctacaaatcaactaaaagatcaaaattaacgacaaatcaaaataaatcggtcagagcttaatgcaaaagaatattttgtttttataaaccagaaaacaaagttcaaacaaacttaaggaagacgaaccgtgacaacaaaaataattggaaactccaaaaggatatttggagaattgatgcaagaagaatgtttcaaaatcaaggaatccaactaaaagtacaaaatataaatttctcgatgataaatgaagcatcaacggagaaaccaagaaatcgtttggtacaaccaaactacgattttcataaaatcaattagatgtgaccgaataaagacatccagctcgcaactaaatatttttttgataaaaaaaggagacgtaactctagagtttaaatataaggcgaaaattaaaacgtcagagcacaaaaaagccgcaaggtttaaatgcgagcaactattttttttcacaaactagtaagcaaaagttcatacagaatttaggaaataaagctttaaagtctgaagagaagttccaaaaagagaatctttataattgaagaaatcgaactaaaagtaccaagttagaacttaatgatgaaaaaaatagatcgtcacgcgagaaaccaaagtaaagttttcataaaccaggtatcaaagttcaaaccaacttaaggaagacgaacggtgataaccgaaaaatttggaaactccaaaaaggatatctgaagaatgaatgcaagaagaacgtttgaaaataaaggaatccacttaaaagtacaaaatttaaaacttacggatgaaaaatgaagtgccaatggagaaaccaataaatcgatcggacaagcatactacgattttcataaaaccaaatagcatgtcaaaagcattaatacaatagaactttcgaaaacaaagaaatacaacgaaaataatatggtttaaacgaaaggatggaaaatgaagcatcaagggagaaaactagaaatgtttgataaaatgaaaccatgattttcataaaggcatagatgtgcaacaaaatgcaagggtgcagctcacgaaaagttatggattaaaaatgaagcgtcaacggagaaaccaataaatcgttccgaacaagcaaactacggttctcataaaatcaataggatgcaaccaaatgtagatgtctagcctgtaaccaagatattgtttttcgataaatagggacacgaaactcttgaacttagttctaagtctacgattaaaacgccagagcacagaaaagccgcaaggtttaaatgcatgcaagtatttccttttcgaatctgggtcagcctacttaggaattcatattatttatgtggctcttacgatgattttgtctttggtgagggtgttatgagaacctatccttgtttggttggtggaatacgatctaaggtgtcatggctatgctgttttctgataacattacgatattattgattttaaatgtttataaaacttttcaagaatactagatttagaatctctaaccatcaggatgtaacaaggttcaagtcttcatggtctaaggtcatgatctaaccttgttgatctcacattcgataaatttaagttttaggacaacaaggcgattgagaaaataaggataaattgaacaaaactttgggttacatcttaggggttggcaatatttgttctcctggtgctaattagtcatatgtaattctaggaatatttgtcgagtcatactggatgcaacaggacggtctcattatgtgcatccataaacttgggtcgtggtagaaaacgggatgctagatggcatgtatagcaataacttttctttttctcaaaaaggcaacgatgtatgctatgatatcaagatgaatgaaatgatgcgatgcatgtatgaaatgacacaatgcttatgaagatattttgtattgcacacatttttttttgatggaaggcaaaagctcatgccatacatgccatagaacaatcctttcggaaaaattgttcttgagactatttgtcctactcatggtttatcatgggcatgggaatggttgctactctttataggctttaggctaggataaggtgacaaaattactttttttttactcagactcgtaacaaagttctccttatcaaggaaagagatggtaattttaaaacaaatggatcatcttagagaagtttgcaaaacctaaaagtcaagttcccaaaccatgtttgtgagttgctacgatgtacaaatcttgcatccaaccgtaaaggggcacaaaatttgcacactgagccatctcaacttaaattacatagtttgcttatgacttgttcctagtatgatatttccatttaggcttgtgggggcttgcaaaggttacatgttttgtctctggtttgtaaggtcatggcactctattccccttaaaataaaataaaataaaattttgcaatggggtttatcaagaattttaatggaagagctaaataggtctatgtgcccatatgctatactatccagtcccgaggcgcaaactgaagcaaaagactatgctagatgggtgataaattagaaaaaaaactatattcatgatcctaacaaagttttctccaatctgggtaggaaaggtaattttttggacaaatagattattttagagaaattggtcaagacaagtgatgcagtgctagaatttaccggtccactatctttacgtaatttttaggtcaagttctaaaggttcaaaagaaatttttaaaaagaaaattagagagattgatgggtaacctttttgagctaccctaaacgaaccaagattttatcccttctagattgggctacacagattcgataaacaaggtatgtttttcgataagcagggtaacgtaactatagaaattaaattagttattaccctactattaaaacgtcggagcacaaaaaaagccacaaggtttaaatgcaagcaaatattttcttttcacaaacaagtaagcatgcgttcaaacaaaattacagaaattaccattttagaagtaaaataaagctttcaattctaaagagaagtttcaaaaagagaaactttgtaattgaagaagtcaaacttaaagtatcaagttgaaacttatttttaaaaaaaacccgttacgcgagaaacaaaagtaaagattcaacgaaaggacgaaaaacgaaacataagggagaaacccaaaaacgtttgatacaaaaaagccacaaggttaacatgcaagcaaatattttcttttcacaaataagtaagcatagattcaaacaaaattttggtaatttacattttagaattaaaataaagatttaaagtgcaaagagaagttccaaaaagagaaactttgtaatcgaagaaatcaaactaaaagtaccaagttgaatctgaacaatgaaaaaagaaccgtcccgcaggaaaccatagtaaagttttaaagtccaaatacacatcaaaagcatgaatacaaaaggctaataaatcgttcagaacaagcaaaaactgcggttttcataaaatcgaaaggatgcaaccaaatatatacgtctagcccgcagcaaagatattttttcgataagcagggaaacgtaactctagaacttagttataagtctacgattaaaacgtcatagcacacaaaagagccgcaaggtttaaatgctagaaatattttcacaaaccagtaagcacagtacatacaaaatttaggaaattgagatttcagaactaaaataaagttttaaagttcaaagagaagttccaaaaagagagtaccaagttaaaattcaagtgtgaaaaaacaaccgtccctcgagaaaccaaaataaagttttaaagtgcagttggcgtgtcaaaagtattaatacaagagaactttcgaaaataaataaatccaacgaaaagcataatgtttaaacgatagaacagaaaatgaatcgtcaagggagaaacctagaaatatttgatacaaggaaaacatgattttcataaaagctttaaggtgcaacaaaatgcatgggcccagctcataacaaagttatttgttttcaatacacagggagacccaactatacacacaactataagctcaaaattaacgtcagaataaaataaaatggttggtcatagcacaaaaaagccacaaggtttaaatgcaagcaaatattttcttttcacaattaagtaagcataagttcaaacaaaattacaaaaattgccatttcagaagtaaaataaagctttcaactctaaagagaagttccaaaaagagaaactttgtaattgaagaaatgattcaacgaaaggacgggaaatgaaacgtcaagggagaaacctagtaacgtttgataaaaaaagccgcaaggtttagatgcaagcaaatattttcttttcacaaacaagcatagattcaaacaaaattttggtaatttacatttcagaactaaaatagcatgtcaaaagttttaaagtccaaatagcatgtcaaaagcatgaatacaagagaacattcgaaaataaagaaatccagcagaaagcatacagtaaaatgaaaggatgtaaaataaagcgtcaagagagaagcctagaaatgttttatacaaggaaactgtaattttcagaaaagattgaacgtgcaacaaactataagggtccagctcacaaaaaagttagttgttttcaataaactgggagactcaactctagaactaacggcagagcaaaacaaatcggtacggcttaaagcaaaagaatattttgtttttataaaccagaaaacaaagtccaaacaaacttcagaagatgaaccgtgacaacaaaaataattggaaactcaaaaaaagatatttgaagaatgtttcaaaatcaaggaatccaattaaaagtacaaaatataaatttctcgatgaaaaatgatgcctcaacggagaaaccaagaaattgtttggtacaaccaaactacgattttcataaaatcaataagatgcaaccgaatgtagacatccagctcgcaaccaaaatattttttttttgataaaaaggaggcgtaactctagaatttaattataaggccaaaattaaagcgacatagcacaaaaaaaccccacaaggtttaaatgcacacaaatatgttcttgtgaaaaattattaatcataagttcaaacaaaatttcagaaactgagatttcagaactaaaataaagatttaatgtccaaagagaagataaagaaagagaaactttgtaattgaagaaatcaaactagcagaactaaaccgaaactcaaggatgaaaaaacaaccatcactcgagaaaccaaaataaagttttaaagaccaaatagcatgtcaaaagcattaatacaagagaacgctcgaaaataaagaaatccaactaaatgcagtaggtttaaacgaaaggacaaaaaatgaatcgtcaagggagaatcctagaaatgttcgacacaaggaaaccttgattttcataaaagcttcaaggtgcaacaaaatgcatgggcccagctcacaacaaagttatttgttttcgataaacagggagactcaactctacaactcaattataagagcaaaataaatcaattaggcttcaatgcaaaagaatattttgtttttataaaccagaaaacaatgttcaaacaaccttaagatgaaccatgacaacagaaaaaaattggaaactccaaaaaggttatttgaagaatcgatgcaagaagaacattacagaatcaaggaatccaactaaatgtaaaaaaattaaacttatggatgaaaaatgaagcgtcaacgaagaaacctataaatcgttcggaacaagcaaactacggttatcataaaatcaacaggatgcaaccaaatgtagacgtctagaccgcaaccaagatattttttcgataaacagggaaacataactctagaacttagttataagtctacgattaaaacatcagagcacaaaaaagccgcaaggactaaatgcaagcaatattttcacgaaccagtaagcataagtacataaaaaatttaggaaattgagattacagaactaaaatatagttttaaagtccaaagagaagttccaaaaagggagtacctagttgaaattcaagtgtgaaaaacaacgtcactcaagaaaccaaaataaagttttaaagtgcagttagcgtgtcaaaagcattaatacaagagaactttctaaaataaataatcgaacgaaaagcataatgtttaaacgataggttggaaaaggaatcgtcaaagggagaaaactagaaatgtttgatacaaggaaaacgtgacttttataaaggattagatgtgcagcaaaatgcatcattccagctcacaaaaggttatttgttttcaataaatagggagacccgactctacaactcaattataagttcaaaattaacgtcagagcaaaataaatttgttaggcctcaatgcaaaatgaatattttgttttattaaaccagaaaacaaagttcaaacaaactttatgaagaagaaccgtgacaaccaaaaaaaaaattggaaaccccaaaaaagatatttgaagaatggatgccagatgaacgttaaaaaatctagaagcgtcaacgaagaaaacaaaaaatcttgagggataagcaaactgtgattttcataaaatcagtaagatgcaaccaaatatagcataaacccgcaaaaaagatatttttttcgataaacaggataacgtaactatagaaattaaattagttataagtctactattagatcatcagagaaaaaaaagccgcaaggtttaaatgcaagcaaatattttcttttcaaaaaccagtaagcataagtttatacaaaatttaggaaattgggatttcagaactaaaataaagctttaagtgcaaagagaagttcaaaaaggagaaaatttgcaattgtagaaatcaaacttaaagtaccgagttgaaacttaatgatgaaaaaaaatcgttacgtgagaaagaataggaatgatttaaagtccaaatagcaaaacgttcacaaaaagaagtaatccaactaaaagtataaagtttaaatgagaagacggaaatgaagcgtcaagggagaaacccataaacgtttggtacaaggagcgatttttcatgaacttaaggaagacgaaccgtgacaacgaaaaaaaattggaaactccaaaaatgacatttgaagaatagatgcaagaagaacgttacaaatcaaggaatccaactaaaagtacaaaatttaaacttatggatgaaaaataaagcatcaacaaagaaccgataggataaatcattcggaacaagcaaactacagtcatcataaaatcaataggatgcaaccaaatgtagacagaaaataccaagttgaaacccatggataaaaaaaaaggtcacacgagaaaccaaagtaaagtattaaagtccaaatagcaaaccaaaagtattaatagaggagatcgttcgaagataaagaaatccaactaaaaacataaagtttaaacgagaggggcaaaacctagaagagtttgatacatggaaaccatgatttttcaaaaaccttcaaggtgcaacaaaatgcattggtccagctctcaataaagttatttgttttcgataaacatggagacccaactatacagctcaagtattcaagttatttgttttcaataaacggggagacaaaactctacaaatcaactaaaagatcaatattaacgacaaatcaaaataaatcggtcagagcttaatgcaaaagaatattttgtctttataaaccagaaaacaaagttcaaacaaacataaggaagatgaactgcgacaacaaaaataattggaaactccaaaaaggatatttggagaattgatgcaagaagaatgtttcaaaatcaaggaatccaattaaaagtacaaaatataaatttctcgatgataaatgaagcatcaacggataaaccaagaaatcgtttagtacaaccaaacatcataaaatcaattagatgtgaccgaataaagacaaccagctcgcatccaaaatattttttcgataaaaaagaaggcgtaactctagaatttaaatataaggccaaaattaaaacgtcatagcacaaaagccgcaaggtttaaatgcgagcaactatttatttttcacaaactagtaagcaaaagtccatacaaaatttaggaaatggagacttcagaactaaaataaagctttaaagtccaaagagaagttccaaaaagagaaacaatataattgaagaaatcgaactaaaagtaccaagttgaaacttaatgatgaaaaaaaagaccgtcacgcgagaatccaaagtaaagttttcataaaccagttatcaaagttcagaccaacttaaggaagacgaacagtgataaccgaaaaatttggaaactccaaaaaggatatttgaagaatcaatgcaagaagaacgtttgaaaataaaggaatccaactaaaagtacaaaatttaaacttatggatgaaaaatgaagcgccaataaagaaaccaataaatcgttcggacaagcatactacgattttcataaaaccaaatagcatgtaaaaagcattaatacaatagaactaaaaataatatggtttaaaaaaggatggaaaatgaagcatcaagggagaaaactagaaatgtttgataaaatgaaaccatgattttcatcaaggcatagatgtgcaacaaaatggaagggtgcagctcacgaaaagttatggattaaaaatgaagcgtcaatggagaaaccaataaatcgttcggagcaagcaaactacggttctcataaaatcaataggatgcaaccaaatgtatatgtctagcccgtaaccaagatatttttttcgataaacagtgacacgaaactattgaacttagttctaagtctacgattaaaatgccagagcacagaaaagccgcaaggtttaaatgcatgcaactatgtccttttcgaagatgggtcagcctacttaggaattcatattatctatgtggctcttacgatgattttgtctttggtgggggtggtatgagaacctatccttgtttggttggtgcaatacgatctaaggtgtaatggctatgttgttttccaataacaatacgatattattgattttaaatgtctataaaacttttcaagaatacttgatttagaatctctcaccattaggatgtaacaaggttcaagtcttcatggtctacagtcatgatctaaccgtgttgatctcacattcgataaatttaagttttagtacagcaagtaaggcggttgggtaattaagaataaattgagcaaaactctgggttacatcttaggggttgacaatatttgttctccagttgctaattagtcatatgctatctaatccaaggtgttctaggaatatttgtcgagtcatactggatgcatcaggacggtctcatta

SEQ ID NO: 36371 - DNA, 8069 bp, Oryza sativa
tataagagcaaaataaatcaattagtcctcaatgcaaaagaatattttgttttacaagctagaaaacaatgttcaatcttttctcgaactagtaaacataaatacatccaaaacttaagaaattgagatttcagaactaaaataaagttctaaagtccaaagagaagttccaaaaagatagtaccaagttgaaattcaagggtgaaaaaacgaacatcactcgagaaaccaaaataaagttttaaagtccaaatagcatgtcaaaagcattaatacaagagaactttcgaaaataaagaaatccaacgaaaagcataaggtttaaatgaaaggatggaaaatgaagcgtcaagggagaaaattagaaacatttcatacaaggaaaccatgattttttataaaaccttcaaggtgcaacaaaatgcatgggtccagctctcaataaagttatttgttttcgataaacatggagacccaactatacaactcaattttaagctcaaacttaacgtaagaacaaaataaaacggttgtcttcaatgcacaagaacattttgttatcataaaccagaaatcaaagttcaaacaaaattaaggaagacgaaacgtgacaagcgaaaaaattggaaactccaaaaaggatatttgaagtatcgatgcaaaatgaacgtgacaaaggaacaccaaactctaaaaatccaaccaaaagtaccaagctaaagcataagagttcaaatagagcttcagtccaaaatctagagaatgtatttatggataaaaggaagcaccagcttgtaaaaagccaaaaaaaaaagtaataaggtaaacatttataatccaaatacaagtgtccaggaagaaaccaattcagtgttttttgggggaaaacgaattacaaattaaaagggtcacgcgtgaactagaatatcatatttctgagtaccagatttaaaaaaaccaaatctaaattttctgaatcccaataaaagtatcaaggatgataccaagtaatgacaaaacaaatcgtaatttttggataataaattagaaataccaaattaaagctttagaatgctgatagaagtgtgaagcaacaaatgattaaaaaagaaacatcaactttaataaaagtaggcatatagaactgaatctgtttagtccaaatagaagtatccagtaagaaacaagtagtatttgttgggcaaaggtaaaaaacactcaataccaaattaattgccatgcaagaaacatatttcaatgaaaaggaacttcataagtaccaaagtagagtctcaaaatccaatcagaaatgcagaattaaagctttaaaatacaagcaaaagcatcgaacacacaaaacttaacatcaaattctgaacaaaaaacaattgtaggttacaaactgaacatgtataatccatataaatgcatcgattaacaaatcaagaaatgttattcaaaataatcaagggatgttactcaaagtttagaataccaaaaaagtatcaagcagagaggaggagaatgtttgttgccctttgtattttaaagcttctaaattggtaattgtagcaggttttccatttgtcttcctttctagaaaaaaaaaacttatcttggtaccctttaataaattggttctgctaggtataagctgataacggaattttacagtaagaaatttgcaaatatctgaatatatatcatcaatgtactattgtacttgaaagaaataccacatacatgaagaatgcaaattaatttgtcattcccagtgtattgaaatttccaaattcgcatgcccctaaccacagacacagattcacatcccccctccccaacacacacacggacagaaaaacacaatcccaaaaaatcattcattacaaagataaattaaaattaatttagtagtttcctattatttttttaaaggtaaatctgagccatagttgccattagcaatattgagtatcccaacctattattgccatgttatagaagcaaggcaacaggacatcattgtattaacaaatacaagaataaataacccaaaaattttaacttgtaaacaaatgtacaattcattctactctatgccatcattttaacatgaaattagcaatcacttactggttgtgcagaccataacttgctcatgataagattgtaacagctaatagcattttttaggggatatcctagtttttttaataaaacacaggacagaatcatacgaatcaaatatattaataacagtaaagggagaatatgtacaagaattacacacaaggcatttacgaagaaaataatgaaaaccagattttcaccagtataaaataaaacttacgcttggaataatgggcacagcatctgttaatggtataatgccctctcattacttcttgtgtgggatttaataaacaacgtgggtcaataaagtgtttgtcaagtgccaaaacctgccatatgttccacataatatcattcaaatatttgctttcacctgagcaaatagccaaccagattaagaaatctctacttcaattaaatgcagagcggagcaaatagattccattactcttaaatatttgactttgtcttggaaatgctattagctcatattatcatagatagttttttttttaactaaactatatatcagagattagaaatgcgcattttactaaagtttgttgttggctacaactacgatttgcaaagctcaacgaactgtcattttagtgtattttgctcttggaaggtacagcctgctagtttcaccaagaactgtcatatttgttttgaaagaattgcttttctacctaataaaatacccatgctaaggctatggtgccgtttgataatgcaaaccaaacaaataaaatgattatatattgttctgattcctaaaaataatatctatagaaagtgtaccgttccttaaaatagaatataaagaaatggatttctataggatatacatgcatagcaatcaaacttaaattaaataagccagtaatttgcataatttacatatattgaattagtgaagtgagcatttggatctacctgcactgtctcaagatatcaacaaagtaggcatctctagtacacagtctcatctcgccactgcaaagaaataaagttaaataaaggaacagacaaaggtgaaaggaaaaaaatcgttaaatgaagtccaatctcaaaatactctacctcttccttgctgtctcctcaacccttaaacttcacaaaagaacaagaaatcctaaaaccatcacagtttctgcaaactggaaaagcaggccgttgtatgatcttctcatattgtgttttatttcctatgaccagcgtagtgtcacacgccaaaacttgtttctcacctcccatgacctgatgtcaccaatgcagtgcacctcgatgacaaagaagatatacgacaatacagtccggctgctggttgcactcaagctctcacatggaaggctctatatgatcagatcaatacttctgcttctgccccttgtccaatctgggaatttgtgtagaagaattcagcccccctctgagttcaacaacttgtgcctggcttatcttcaaaaatcgactaccaacaatgacaaatttgcttgtgaagaacatggtgcaaacggtaaaatacgaaatatgcttgcatcaagacgaagacagcgatcacttattcttcaagtgctcctttgctgaagttttcagcgaatcaacgttttcctattaggcacagaaaagaaaagagaaactttatgatacatatagtagaaatgtgaaataaaaaaaataactctttgtgggtaatccaaaaaaacactttggtgaaatgaaaaaacgataatttataacacattctgatctttttacacgtcaagtgttattcgggccatttcatgagataaaccagtagctcctaaaaacatatgaacaattatatttagatgaataatagcattccgtggatactttctgaacgctagcaatatacatctagcaggctagaataaatatatgcatacaccgagtaaaagagattagtgtaaattgagataagcatctttcataaatgaaagagagcagagcataatccatgtgaaaaactgaaaaccattcaaaaaatggaattgaatgataactattaagcctttttctttgcacggattcagcacgaaatgcagcacaaaaattgcacataatggcacaggagggagaggataccgggagtgcattcggcaaacctgcacagggtcgctttcaaggacgacgtcgaggaagccgatggatgatcgcaagctgaaccggtttgacattcacaacggtggcgcaccgtgcgctggatctgcacatgacggagttgaggaggaagatccaatgacgaagtgcaccaggtgacggacctgcaccttcagggccgggtggaacagatcagcgaggcagccacaggttgaaaattatagtcagtacaggttgtggtcagatatttactgagaatcctaaatattatacatgttgttacaagcatttctccaggtggaacagatcggtgaggccaccacaggttgagaattatagtcagtacaggttgtggtcaggtatttactgagaatcctaaatactatagatgttgttacaagcatttctcttagcaatcagtgtaccaactgtagttcacatccttgttcatttcattatatcaaacaaattctgtaggtgcgataacgagatgaactgtccactactgtaaataatctatattataatgtaatcatccatcaatttgccaatgatgccggtaacaagtaaaagatttattgaaacagccaaaatttaactgtgtaaatttggctagcatcatttacttgacattgtatttcagactatgttttacaaatctcacaggattacaaaacatagaccaatgagcaatacgagcaaaattactagagctgtggacaaaattagcctgacatgcaaccaaaagtgcaaacctgagttttttttaaaaaaaagaaagaaaacgatcagagcagtttatatgacttttagagacttgctttacatgagttaatctgaaccttggtcaccggaattgcgctgcatatgtacttctttcgcaatcaggagtcaagttaaaggtgattgaatttaaaacccagttacaaacaagatccaccagggttaaaagaacagaaagtacaaaggcactcacaattagagttcagttcttcggtaatttatctccaagattcagtctcaccgcacttaatggtgtggcagccagaacaatttccaatgctgagaaaaggaaaatattttagtaaatatttccattattagaagctttaatcagttgctataggatatgtagcggtcattgatatattaacagcttgaaaatttgtctgaatttatattgattgcaaagcaacaaatttgtgaacgaaaaaggaagttaaagcaaatttataaatttagacaaatgaccgaaatgacctgttcttgcattatgtgggtgtgttcagattaaaatgtcttagaagacagcattagaacaggttagtcattaaatgaaaaagaaaatttcagaataggtttgtcatcaaatcaaataaaatgcttcagaaggcagcgacatattttatcaaatcaaataaaatgcttcagaaggcagcgacatattttgatctaaggcataaaatccaaaactacttgaactgtaacattactgattttagctaacgtctcataccatcctacatactaagattcataacttgcagagctttcctccctcccactaaagtaccatgacatgcaatactgaaatctaccattaccaaaagaaaacgagaagtgaagaaaagatcaagtagtccaattgaagacatcactgcgcttagcaacaattgctgaaaatattatatccttcaaccagatttttcctgatttttgctgaaaatattatattgacgatgtagaggaggggctgcaagaagttaccaatgaaattgaccttgctaatctggcaatccccaagcagacctgctttgtggctgaccatgtcgttaattcacattcactgccttgcaaagcgtggccaccactatggctgcaacagtcatggtcgtcccttgggagcaggaacagctgggccctgccgacggcgccagcaccccttgcagcggccaagcctgcagtaccagccgatgcccttgccagcacaggaggaccatgcaagcagcccatatttgtggagttggacggtacaacagctccctgcagtcctgcacctagggacgaacatggagttgagcaagctgactaattatgtttcaattaagcccgagcaaaactataaaacaaaaccacactgcaatatgaaaaaaactacggagtaaagcgtagaagtatccagcagtgtgcctatgttatgtttccagggatcctttgggaccctgggtaaattattaaattctagctaaattacgccatgttaactagtataccggtaaatagttacataattcgtatgtattggactcttggtatttttttgttctgggttcatcactggaaatatctattagcacaatgcaagcacatgggaaacagtcggtagtacatgacgaccaacatccatagtactaagtgaaagcatcataatacagaggagaagatcagaagaggcacctttggtctcctcgacaatattatgaagtttctttctcttggccatctcttcatagtacttcagtttaagatcttcacactgcacaactgcagcaaaaaaaaatgcttacaaactttttcatcaaatactctaaaacctttacaataatgcaactgatggatataacctaatgcttgaacagctcctaccatcttactcggttcaggaacagcgtttgcatggccatcttgcttcaagagatagcaatgtttgctcttgtttcatgacctgaaaattaaaaagtgatataattagtaaaacatagcacctcatgtatttatcaattcagtaaatctgcttttaccttgattttattttccaagttagatatggcagctgcccataatttattggcatattcgtacttttgggaaacacttctcagttgatcagcttgtctatcaaggacttgttctgtcaggaatgtaaaacagtggtgagcatacagaaacatcttatctgaaaattagaccttgaaggagtaagttgaatctaatatattgtgtcttacctgctattgctaccgtttttcgaatacaaatggcacaaaccatgggacttccccttactcctttgaagtttatgacaaaggcaccgtcactctcaactgttaccctaatatcacgcatatgaaggggtctgttacctccaaccactgcatacacatcaaattcagacaaaatctgtgcatcaatcaaaagtcaaattgtttagctaaacctgacaataaattgtgatacaaaattaagagcctcatgaatactgtgtttgcattttcttctagcacaaggacatcaaatgctctaattccttctggcccgtaagtgttcattatctcagcaaatgcagatcaaagaaatagtctccaggagcaagaccatcgattttgtagctggaatttccatatcgaactgagtggtaaagcgaaggatagtcacctcttcaaactatatcctcagatgtcaatattgcatcccctccttcaaagaaagaatcgtcagaaagctttgaagagggttcacaaccctcaattgcactgccaccgacattaatgaacagaacaaagtctcatcacaggcacaagaaggataataagaaacattgtggaactatgatgacatgaccaattaacatttcgataaggtacttccaattttcaatttagaattcaagattatgaaatatccattttggaagcacatcactgatgatggctatcgaagccccttctactcgatattactacagcaccacaattgatgcaaccttgtactctgacatagaaacaatcctattttcttcaaccaat

SEQ ID NO: 36372 - DNA, 15129 bp, Oryza sativa
  unsure (1)..(15129): unsure at all n locations
cataaaagctagagcagtatgcaaatgattccacatatagatgattcctgttacatggagataccttattaagctcctagcataccacaacacctgaaggcctcaaaattggattacaactttggcaccgatgtaggtaaagcaccagaaaataccaaatctgggtacatccaacctcctaaatttcctctgccacatgcacacacgcacacacacaagaaaaaataagagcaaatttggaagcaaactttctagggttttctaccagagtcaaatcgagtactctaattcgaccatcctaaacgctcatttcccaaaaaccctttcacgaacatggtgggagggttaggatttaggaatagatcctcacctagcggctagaaccgccattgctgaccaaatgcagattgcaggaaccccacagcgggaagagggagaggaggggaggactccgccgccgccgccgccgccgcgccggcgcagggccaggtggtggccgcatccgcgttcgcggcgtgaggaggagaggagagagagagaggaaaaggtttttactttcttttttttaggacgaaaatacgaccattgctttaagaggaccagaaatatgcccgtagctttaagaggaagaaaaaatgtccgttgcaacggattaattagaaactacggagtactaaatatttagccgcttaacaaatttaggcgttgtttagtttgcgaaaagaaaatttttgggtgtcacatcggacgtttgacccgatttcagaaggggttttcgggcacgaataaaaaaactaatttcataactcgcctggaaaccgcgagacgaatcttttgagcctaattaatccgtcattagtacatgtgggttactgtagtacttatagctaatcatgaactaattagtctaaaaagattcgtctcgtgatttccatgcaaactgtgcaattagtttttttcttttattaatatttaatgcttcatgcatgtgtcccaagattcaatgtaacgtttttggaaaaaaaaaaaaagaactaaaccgggccttaggatgtttgtcccaattgtccctcccatagtcctttttcggtcatatctgtgcgataagtgtagagggacggggtagcccagtctggaccattctgaaattcccaacttaagcatgaaggtgaaaaaactttaatttgtcagtaaattggaccctaatccattcaaataaaatcattagatagaaccacgggatttcaccacaaagacatcgataaattgaagctcaaattgtgcaggaggagtgcgagtgacaagagtgtacgataacttatgtcgagacaacttcgaccatgtagaacttgaccgccatcgctacgggtgggcattcggtctaaccgaaaatttcggtctcggtctttgatctttcgatcttttcggtctttgaaaaataaagaccgaatttcagtgaaaaaatatcaagaccaacaaattcggtctcggtcctgaccgaaattcaacaacattttcatatatgcaaagaaataatggaaattttcaacacaaaaatcacaaaaaaaattcgtaagcactttatgagtaaagactcttattaggttgcatgcctagaagaagtagggatgtgaaaattagagtttaatcctattaaacatagtggattgtaggttgtttttagataatttttgataattcggtctattcggttacccgaggagactaaccgaattgaccgaacaaaattcagtctttcactacctaggaccgaattgatgaccgaatttctcggtctcggtctcggtcttttcggttcggtctttttctgcccacccctagccatcgcaactgcagattgcagtatttcgcttggttatccttctcacacgccgccgctatcgcatgccccatggcagtcgtgctagcagcaccatcaccagtgaggtgtgccgcacggatctcctaggccacttaacgtgggcgttgtaagtggacatgcgggggaactgattgagcagggctgtggtttgcgagggactcgagtggtgtttgatactaatgaaaatgaatattaagtaaggcatgaaaaacaaaaagctattagcatatgattaattaagttttaattattgcaaatttggaaattgaatttatttgatattttatagcaacttttatatagaaaatattcacacgaaacatgccatttagctgtttaaaaagtgtgctaatggaaaccgaggtaaaatatgtatcttaatgaaaaagaaccgggcgtcgctgtgtcaatgtgttatcctgatatatattgtcatggattgatcgagtattcaatcaagtttcctatgtattttgttaccgtcactacaatagaaaccatttttcatagcaccacccttttatttgtactggcggatttaataaatgcacgcttgtaaagatacttaagagggattgcggacaccaaccgccagcaaaaatcgattttcgttggcggccacttaagatattttacaagcggatctcttaagcgactgccagcgctggcggtcactaaagagcaccgcctttanaatccaccgcctcataaaaanaatcagtcacagtgcattaaaaaaccacgcacagcaaaaatcctcagatccactccacattctcctctcctcagatcgacacctctcctcttctccttcctcaccggcgcaccaccgctttactcctctcctcctccgatccctcccaaccggcggcgggtccagcagcagcggcttcggtggcagcaaagagaaggggtggtgtcggtgaccgccggcagcaactcccgcgcgtgagtaacagatctggtggtggcggacgggctcggcagagtggggtggcgtaggggagcctagctcctcccctctccatttccggagtggggtgacaaaggggagtatcgtctctccgggctcagcagtgacgattggcggcggcaaaggggatggggtggccgtggcgactcgggcaggatacggaccagcggtggggactcctgcgggtgactgatccggtggcaacagccgagctcgggagagtgaggtggcgcagggaagtctagctcatctcctctctagatctatagtgggtggcacaggggaacctcccctcttcagggtcgacggcggcgaccaacagtggcaagagagccgccgtggtggggttcgtcaatgggcagtgcatgcggccgtggcgactagcggcgctgatttttaattttttttaaccctaaaaaatgttttcactggcggtcatctttaacttgccgctggcgaagatggtatttttgctagtggttgtcttaacatgtcgccagttaaactcgattttccctggcggctggctgaccggtagtgaaaatgtattattttcactggcttttagttcgctggcggcactgtcggctgccagcaaaaatctattttagtcacccgttttcatttttaacaagaaaaaaaatccgtaatctcaattaacccgtggtaatcggaaaaccggatcgataaataccagctcattggatgatcgataaatcagttatcagtggagagctcgatattcggaggggttggcagcgatgcgatgagggcaggatacatcgttgatttggcgtccacagcgagtcggaagcgacggcgtgatccacatcggcctgctgtcttctgccctgccggcgtcgcaggaccacgaaacggcatcgtctggctccgctcgacagaacgagtataggtctaggtatttagcgatgcgctgatctactccctttccgctcgacagaatgagtatagatctaggtgtttagcgatgcgctgatctactccctttctccagttgatgccggccgcaaggattaaaacgtctcgatcttagcagctttgttatttagtttcaccgtcagtctccagttgatgccgcaaggattaaaacgtctcgatcttagcagctttgttatttaatttcaccatcagctgtgatttgatttcatatatgtcaagccaaggcagccgtggcggcctaccgctaccaccagatctcctggatggtggtgtgtactgtttttagtttatacatgaaattctgaatcacatatccacactcagatgagtatacactatttcttattcatctttcttttaatctctctacgtacgtattatttgtctctaatatatatgtattatttgtctctaatatcaccgtattcttccacctaaattttcaaggcggcagtattgtctctaacattacttgtgggctcttgagattttaattgaattaaattgggcctagcccatttattctaataatccccaccaaatttcatggctcacaagaaatgttcttaaaactgaacctatttgttataccattgtttcggtggagactgttaagttaaacttccacctaggaaaagagctacaccagatcacaactgaacaatggactatacattgaattgtcagttttgtgcgatcaggtttcactcgaactcttaactggtactaggctgccgtttacatcccctttgtttggagcatataaatcatattccaagccttttcatgagtatataaagatcaactagatctcatagactgtgactagcagttagacttatataggtatgttccttctaagatgttctgtaggtatctctgctttacgaaaagccactcaaatcacattgaggtatataccatccttccatacagaataggagagaagtacatcatagagatgagcccatttcagggtctctcctctcagtcacccaatagtttctttctccatcctaattcacgggatctccaatcacaaaggacaggttaccactattgggcaactcaagtgggtctcaaacccatctccctcgatgcactgtctatcgcattacgtgatagtcccttagtgaactgatctgctagatttttagctgtcttgacatagtccaatgctatcactctggagtttttctgctttctgacaaacttcagttttctttgtacatgcctggatgacttcatgttgtccttcgaattgtttactttaataattactgtttgattatcacagttcatcaggattgctggtactagtttttcaaccaccgacaagtccatcaggatctaacgaagccactcggcctcaactgttgcagtatctaaagctgtgagttctactttcattgttgacctcgttaagatcgtctgctttcaagacttccagaaaacagcgccatatccaagtgtgaatacatatccacttgtggcctttatcttattagtatcagatatccagtttgaatcactatagtcctccagtacttttgggtacccagtgtagtgatccgacgtcaccgtcgacggtgcgaacatcatgatgttcctcctccacgccttcatagcggagccgctccactgcgcactcctccaacactagctctccgcgtcgatggcctcaccggtgccgtctcccacgtcgtcgtccaccacccacacccacaggagcctggactgtgcaacctagcaaccgggaaggcccgacgctggatcaagttctggacagacaaggagaagagaagggagaggggagagaaagaaagtgatagctaatgacatatggggtccacatgggtctcgtagtgactcagcttgccaagacacctaaaatcggtcacaatactgcctaggacatcgggtgatctgattttgtaaattgagggacttcttatatctggtaattcggtttagaaatgaattttggaagaagctagggaaaattttggtgaaaattccctacatacccctgaaaagtttcataatctcttctatacccctaaattttgtctcaaaactctatatgcccttgagtttttattttgatctcttctatccctattccgttagttgactgttagatttttctaaaatgatcatgtcgcccatttcccatacttacatgctatctactccataattcacaatgtgaaaaaattgtaattcatgataaaatcaaatggggcataattattttttttgtaaaatatgtaaaagaaaatttaaattgttgaacatttttttacaaatccatatgagttttagctagaaattatgaaccaaaattatttatttattagattcaaattttgatgaaaacagtgtaccagtttcataaaagttaatttaaatttatttaaaattttagatttgtttttaaaatttattgtcaaataattatattccctttgtttttttacaaatagatctttttcatataagaattgtgtttttatcactaaactagcacataagtataagagagagataatatagtcaatttcaaaaacatttaacgaaatggatatagagaagatcaaagtaagaacttaggggtatataaggaacgggacaagatttatgggcacacaaggggaacgggataaaatttatgggcacgtaaggggattaaacgaattttcgagggtacaggagattttctcaaaattttgtggggtcaaggtcgtctccgctgcaatggcggtcaagccatgaaggcggcgagaaagaccgccatgccgtgcgcgacggtgccagcccgagaaaaatcaactgacgaagcgacgacgattccttcgaaaatgtagcacgagaggttcggagatcatatccacagtcagattccaaccgagaccaactgcagccgtgcaggccggtgctgatatcctcataacctttttaatatagctgctactggtagctttttaaaagctttatcctgtactaagtatttcttgctttaccactgtgcaggtagctcgccatgctcgtagctttgtttgcggcgttagtactcctctgctactcagccggcaacatccactgcgtcgtggcggtccatggaaacgactccgacatgctcgcgctgctcgagttcaaggatgccatcggcgacgatccggcgggcgtcctgagctcctggaacaaaaccacccctttctgccggtggaatggcgtgaaatgcggccgccgggagcatcgcgtcacggcgctcgagctcgccggccagaacttgaccggtcgactcgccgccgcttctctcgggaatctgagttaccttcacctgcttgacctttctggtaatcgcttctctgggcagatacctcgcctgaacagtctccgaaaattgcaagtcctcaacctgagtaacaatattttggacgggatcattccggacacgcttacaaactgttccagtttgacgcagctagatttgagcataaacttatttcaaggccagattcccctcggcataggactcctctctgagctgtcggatctcgtgctttctcgtaattatctctcggggcacattccttctgagctcgggaagttgtcgaaattgtcgtcgttggacctgagtgtaaatatcatatcaggtgaaattccacgcgccctttataatctctcttctcttcgaatgctattcttggagatgaattttctggggaaatcgttgccgtcaaacattggctatgcccttcctaatctccaatggctcttattgggtgttaacatgtttcaaggtaacataccaggatcccttggcaacatttcacagctacatttgatatatctgtcagagaacaatttctctgggcaaattcctagctctctcggtaagctttcgaacctgtctgtcaaccttcagtacctgcttttggacggaaacaatctatcaggacacataccgtccaacatgggaaatcttcaacaactcacacagctggaccttagttacaataatctaaaaggcaagatgccacccagcttgggaaatcttcagcggctagtgagctttaatctcagtaacaacaatcttcaaggtgatataccatccaagtttggagatcttcaacagctcgtatggctgaacctcggcaacaactacctccatggtgaagtaccatctagcgtggcaaatcttcaacagctcgtcctgttggacctcagtcacaataatctcagtggcaaagtacctcgcagcttgggaaaccttcctaagctcaggcagctggaccttagccacaataattttggtggcaaaataccatccagtctggcaaaccttcgtcaactcagtcgcttggaccttagttataacagtctcaaaggtttctatgcttaacatgccattagtgcgtgaccagtacgttcatataccttttatgcccacttatcagttatcgctgtactatctctctttaggcccaagggtacgtgtcaacgtgtgtcttggtgtctcaagggcactctagtcttttacattctctctctttttttaatgtcttttcccattctcttgttctcaatttattgccctataggcttaaatcaactgattgatacccaacgttttgttgtagaataggtgggtaaatacatgttatacattatgaaaataatagatatatatatatatatatatatatatgtttgaataatgtgaaaaagatgtggagataatgatttgatatggcttgcatattgagttctaaaattacaacaaaatgcaaatgatatgttatgtttgcatgatatttaactactctaaataataattgcccgggcaccatggtatgaaatacacaaattcgtccaaatttttcaaaattttcaaattgtgagtatatacctagttataagttttctattcatacatatacctagcaacaaaacaactcaaatttaactttattttacaatccaatattacatacctaactaattatatgtttagatgctatatacctagaatcaaaatctaacaaaaacatgtttaaatttagttcaaacttgttttgaactagttagtaaagtagttaatgttaacacctaaacatttaaaaaaatttcatactcatttgaattgagtatatacgcaatttgaatcatggagcccgcgcaccatggagctccaaacaaatttaatgaaggggatccattaaccaaccagtccacgtaatggtttattgaattaaacaattaacaaataaataactaaatactagattatggcttgactatcggcagcacacaaacgaacgtacggagcagaaatcgaacgtaccaaccttctgctccgttttaatctaggttttttttttcttacacatgcatgtgcatttaaaaaccgagcagaaggtcttgacgagtttctgtcgagaagagtttttgctttttgttatattctgcatatttttgttagcgttgcagattgttatattaagccgattgatgttctgatctatttcgaaaacgatgttctgcttccttcctaactgatgttgttctccttgtgtgctgcacatgccgttcataaccatgcgtgcaacgactggccgcaaaactagcaatgagtaaaactacaacgagcagaaaattttctgccttcttaacgtcttctgcttagtgatgattttgttggaggagcagaagatgttctgcttctgttcaaattatttttctgctccctttctaatcgatgttctgctcctttcccgggtcacatactcacatactgcctgcctcctttcctgtttctgctcattttcaagttttataagcttcatatagacgatgagattcagtttaacaggcagaaggtattctgcactttgtattccttgctctatattctacgttcttacaaattgtaaatgacctgaatggacttatggacacaacagattagaagtcacgaattatgggttggggaggaaaagatgttctgccattgtttcttcctagtcgtatgtctaatagtgaatggaatcagtttgtgaaagagcagaagatattctgttatcctactatccattgattcaggagcgggattatagctttctgctgcacaaattctgttctgccgtaaattctgtgcagaagagtttcatcccttacctcggctgtgtgttgtacatttatacaagcagaaactatcccgagcagaaattcagatatgcaaaatatgaaatacgttttatttaagtacgtacacataataaactacaattagtaatcaataggcataatatgtactgccgttacatagagaaaattttagtatttgttgtgccaacatttattttcccgatgatgttctgccattttttttcctgatgttctgccatttttttcaattggcgggctatatatcttttgcctatcagaagcagagcatattctgccaaggcgagcacgcgtgaggaagaaactccatccgaatgttgatttgcatgcagccgatgatttagcacttatctgaactaataaatcatttagttaattacttaattaaacagctcggtctgttattccactaacccgatccgctaagggataggagtaactactggggacacctaataggcgggtgatcgctctccctctcccggccctccccttactccaatgctccctcctctccccccttcctcctcccctttttctcttcctactacaccataaatatgtaaatttaatatttgacttataaactttgggtctataaactaatatttgaattcaaattcaaatttgaatcgggtatgtaaacttttgacttataaactttgggtctataaactttaggtgtataaactttagatatatagaaatactatatatagaaaatatttgaattcaaattcaaatttgaatcgggtatataaactttaggtctataaactttatgtctataaactttaggtgtataaactttagatgtatagaaatactatatatgaaaaatatttgaattcaaattcaaatttgaatcggatatataaactttaggtctataaaatttaggtgtataaactttaggtgtataaactttagatgtatagaaatactatatataaaaaaaatatttgaattcaaatttaaatttaaataggatatttgaattcaaattcaaatttgaatcggatatatttcaaattcaaatttgaatcgggtatataaacttttgagttataaactttgggtctataaactttagatgtatagaaatactatatatataaaaatatttgaattcaaatttaaatttaaatcggatatataaacttttaatttataaactttgaatctctaaactttagatgtgtaaacttaaggtgtataaactttaggtgcataaatttattaaaataggaaagtaatgcggtgccaaaaaagaaaaccaggtggaggggagaaaatctaatctgatcgctgctagctacccctagcgatcaatcgctagctagcatttccggtaactactcccggtagtaggaaaattatatactactaccgggagtagctactccctccctatgcgccctcaattcgatcgctactaatgccaatgactgttaccgggtctaatgaatcgaatactccctccagcttttatttttctcggtggtcaacagaaggtcgtttatcttctacagtagatccaacaattgaacgaagcctcccgagtttgttgtagatatgaaatttgaaacttgtgtttgtttatccaaagtgagaaagcaggatattttttccgtcgttaaggaagagcagaacattatcgatctaaaattgttctctgcgtttggagggttcataacccaactgaagtcagatttgtagcctcgccggcggctgtgttgcagataacggtgaaagccctggcatggaggattccagttccaaggtttgttatcatattcatctgttatttttttcatcttttggattcttttcctgatctcgattcctttcttgatcgtttctgctcataattcgctttctttatgttttgcatttgcagcaactttgcagtcctgcagcaggtgcaaatgtatcaggtggtggtggctctagttctgttttcaccagaaactatcatgctggtgtaaatgtaatgaggcgataagaaattaagaagtcatgttctgctcccagttctgctgctgtacgccatgttctgctacatctctaccaaatctgcaacatgttctgctcctcagaaatcagatagcagatcatgctctgctccaaatcagtgcatgtccatctctaaacccaaaaaaagaagtgatgttctgctcccagttctgccgtgtgccatgatctgctacatctctaaacccaaatacaagcacaagcagaaactacgatccatgttctgctacaagcgcagaagaagcaggaatgttctgctctcgtttctgcacgggccttgctctagtagtagattaaatcgtttgaaggaccagaagctattctattacatatccatagtttaaggaacgggagattagcttctgctgcatgcgcatgcatacttctctgatgcagattagtttctgccattttttttagttgatgctctgccaattttttagttgatgcgcatacataatcttctgctggctagtagcagaaaatcaatttgaaaagagcagaacatcaacaatttcatgtgccgccaaacagctgatgttctgcgtcctttcaaacagaatttctgctcgatcttctgctctctttccagttctattctgctcctaattggatgagcaggatatcttctgtccgcttaaattttttttcatatgagcagaatatcttctgtccgcgttttttttttccatgttctgctcctttcccgattcacattatgttctgccagcgatattttcaaaacagttatgttctgccatttttttagctgacgttctaccggtttttaaaattggtttgcatgcaaccgatgatttagaaattatttgaactaactacaagctaatattttgtgcaaagattatcggattatgggttattccactaacccgatccaataagcggagggagtaactactcccgatagtagcaaataggtgtcatatatatatatatatatatatatatatatatatatatatatatatatatatatatatatatatatatatatatatatagactttagaaatagttgaaattcagaattacaaaataaggaatattggaagaggagactaaagtccatatcgaaatacaattaagaaataatagaaattcaaaattaaaaataaggaatattagaagtagagtatagagtccatattggaatttaaaactaactaaaatttggaataaacataataaaattaaaagtagagtttagagttcgtataaaaatacaatttacaaataactaaaatttgaaatttaaaaaaacatgggaagaagaatctaaagtcaatacaggaatacaatttagaagtaactgaaattcgaaattaaaaattaaagaatattaaaagatgagtttagaatctatatagaaatacaattagaaataataaaaattcagaattaaaaaaaataatatttgaagagagcctagagcctatatagaaataaagataacgaaaatttggaattaaaaaaaaagaaatattgaaagacgagtctagagttcatataggaatataatttacaaataactaaaatttgatattaaaaataatgagtaactaacacgtatataaaatacaatatgaatattacacattagtagtttcgtaaagttagtacaaaatttaaaattatattgtcatttcaatatatttaaataatacgttgagaaaacatatatatgctattatatgagagaaaatataataatgctagccgcgcaatctgtgcgggccgctatattaaatctttaaaataagatatcggatgataatattttgataaaaatatatatatgacaaatgggccgggtcccactaacttttagcttttcccatccaagctatatccctccaaccaaacaagaaatttgatcatcctatccatacaaaccaaacaaaaaaaattggatcgccatatcgaataaaatatgtttggtcatatcccatccatacgtaaccgtgagccaaacacaccctacaatggttcattattctggcaccgatgcaaggtggtctccgctacaatggcagcgggcaagctctcttttcaccgagacgattggcggccaagctaagctaagctagaggcaacagccaaagcgaattaaagcaggcagcaaaaggccgtcgtgccgtgcggtgcgagaagggcttttcctttttccttccgtcctctccccactttaccatcatcaagcgaagtggcttagtgattccctcgaaaagatagtggaagacatgaagaggttgggataatgggatcgatcgagttgagatccacgatgcatcaccagtgatccagtagggtggagcattgagccgctggaacacaagcgtccacaccaccgccagcccgaatcacccagggcgtgtgcgtaaacattttatctcagcagttggtgtgagtagtagtcctggtcttgcagatgtgctttaattttgctgagttacaacatgtttgaaggcagcttccctaggcaatgtttcagtactaggaaggttagatttggataacaacaattttttgggagaaattcctatacgtctttcggtatgctggtaagagcatactcctattcaacagcttatccaaatctgattctccaaatatttatttagccacagcttacataccgaatagagaaacaattttatttttactctaatagcttctctatttacactcttcaatctaacaatcggtcccacatgtcagtgtgtatatactttcctccctccaaaattctcttccgctttcggttgtccactagtaggacattgctgttctttccccaccttcggcttcttttgccaagccgctacagcaaccaactgtcttgttgtcgcccaagccgtcaccgccgcaactgatcgaccgtgtaagagggtgagaagagaggtgagatggtggaagctggatgacgacgaggaggaaggggtggggtgatggtggcttagggtcacatatgttgatgactatggtggcgccggtggggccgggtgacaactatgttgttgcatcggatagggaggtggtggaaacggtcagcggctgcttgaggcaa

SEQ ID NO: 36373 - DNA, 3571 bp, Oryza sativa
ctgtcactagctgattttttttttcaaaaataatagctttttaataaaaagatataaaaataaattcctgttggatgaaataacaaatttagcacatgtcgaacaaccataattcaaactgtggtggttcgacaggtgatgttggcatgattaaaaaaacataaaagcaatcaatcctactctgaacagtagctaggatatatcgaactatcgtagttcgattggccatcatacatgcacactcttctttttttccttaattcggtgaggaggacatatcgaacttcgcaagttcgattggtcgcgtcatgcacatttatttattttatccggccaaacaagcttaggacatgtattctttatttttttaatcaaattatcaacctatcgaacaaccacataccgagaggtcacatatcaaaccgtagttcttcgatatgtgccatatcaaactttggttggtcgatatgatactaaatttatgatttctgacggtccatctccacttttacaaattcttttattaaaatactattattatctttttaaagaaaattctcactagcactgcttcgatactatggtttggccagctaaaccggctggctagatttgaccagcccacctgggtatttggccagtgagatggcttagtcatttaaatggccagtgagaccttatttttttattatgttttatattgtttggtttgaagagtgggataatcaatctgttggagttgctcaaaggttccaaacctaggtcatattgactggatagatgcggagttgaaaacaaacttgaagctactggcagacaaagctagctttctgcaaatattgtcgctagctagcactccatccatattttaatgtatgacgccgttgactttttaaccaatgtttgactactcgtcttattcaaattttttatgcaaatataaaaatacttatgtcatgtttaaagaacatttgatgataaatcaagtcacaataaaataaattataattacataaattttttgaataagacgaaatgtcgaacgtttgttaaaaagttaatggcgttatacattagggagtaataatctgctacgcggttttatcccgaattcaatcggcgacctctccacaatcattcggtatctctacatcagggaactttcgttccttaaatctgtacatgctgtcgactggataatattaacagctttctatcggaggataatgacagtgggttgtaccacttggatgatttattggaaacctgacaaatctagacaattcagtggcttaactagtacttaagaaatggcgtgacattagtctcttaggctgtgttcgggggcgggtgttgaaaacccatatcccatgcacggaaaacgaaaaacctatagatcaatatgattttttaaagcaactttcgtatttcagagggggagttgggaaagcaaagtaccgaacacagccttagtatttaagagggaatgccgtgtagtttttctataccactatatcagttttggattataaaatgttttgagatttaaataaatttatgtatggatttatatatgtgtttcatatgtatatcacatatatattagtgaatctatacgaagaatggaaatactaaaatatagaacagggagtactaaaaagcagagttatcatccttcatcactttaacaacgtacgagtatgttattagtatgagataaaggcaagcctatgaggagaaaaagaatattgtatgttactcgctccgtttcatattatatggctttatagtattgctcatatttatatagatgttaatgaatctagacacatttattaacatttatataaatgtaggtaatgctagaaagttttataatatgaaacggaagaagtaattaacaaattatacagtgcttgtgcgttgtaatggaatcttagagaaagaatgaaccagatgttcatccagaaagggtgttttttacatgaagtgtggaccgaaactttgcgcgtcgatggacaaacaaaacctattcttgtagtattattacagtagtggagatagatatttgaaccatatgaataggcaaacctattatgcatgtttataaattatctaaaactagttgacgttttcatgaaactgctcttagctatattaaaagttgctttaggccccgttgttttatgccgttagttttagcaactttctcgttatccgttagcatgtttatcaaactactaaatgatgatgtatttgatggaaaaaaagatcatttttcctccgctttggccagtatgaaagtttgcaagccctcatagtgaataatatataaagtttctaataacataatggataaatataatatataaagtttagagcaaatttcacaaaactacagaggttaaccaattatccaaaactacacatttaagatgatatattataaaactatatatttatggctaaatatcacaaaactacatatttaaaaataaaactataacaaaactacatattttagcgtttaaattcttagcactaacattgggtctgttcagctagctggtacagccactatacgcagccgttgctgctgcagctgcagacacaacgtactgtttgtgttggctacacaacagtaaagttaagtgcagccgaacatgcccattatgtttgagttataggcctccaagttttgtgattaaattaacgcaaaatatgtaattttgtgatagagcgattttaccatccaacatttggtacctcgaggtaccatattttgcacacaaaattttggtactaactaccttgagggactaaattttatttgagagataccaaattttacactaaaaagtatcttgaggtactaaaaaaatttatgataacttaaggtactaaatgttggatggtaaaattactctttatgataactctattactaaatctttaattttacaatactccaccttaaattggtagttttacgataaatttgatgttaaatctacagttttctaatatatcatcttagatctatagttctgtgatagtttgttcactatatcttttagttttttgaaatttactctgaagtttacgtgtaaataataattatgaaaatatcgtttatgttcttggtggtttaattatccagtgcattcaatttttcttaagtaccaaatgatttcaattcaccttaaatagcatcggaagttcctccgttaccttttgttttcaagcagtctgttgcaagttgtgtcagctcttctttgaacacctgtgaatctgtgatggttccaccagaagtgcggtgcggccgtggtttattgcctaaaaagcaaaaggaaataaaagtttgaagaactgaaattcattgcttgcaatgtaataaagcaagtttaacagtatagcctactagtagctccaaagcatctatagtcaatttaatagctaattcgttacctaaaatatatactctctctgtcctaaaatataacaaattttagcccttagaatttatcccaaaatataacaacttctccaccaacattctctttccaaccaa

SEQ ID NO: 36374 - DNA, 5471 bp, Oryza sativa
  unsure (1)..(5471): unsure at all n locations
actctcccaccattcatttttctcacctacctccactactcattcaatcacaacccttcaccgtttacttctacctacttttttaataaccgtatccaactctaaaatttcttaatttttgggacgaagagagtattacacaagtagtacctggtttcacctgtcatacacatattacatttgtagtatgtgctacagctgactataaatttatagctcgctattcttatctcttcttatttatcttcttgatatgtgcttacggttgacttatatagtctgctatcgtacctgctaagagtgtgttcgctagaagccgttcccatttggaattttttttttcaaaaaatggattaatttgattttttatgtaactttcgtataaaaactttttgcaaaaaacacaccgtttagcagtttgaaaaacgtgtacgcggaaaacgagggagaggggttgggaaagggggcatccaaacacagcctaaggcatgatatcaagcgaagctgaggtacgcccgcccgttcaagctgtttttataccggatagggtgtgccaggtgcatgcgtacctttcgccgcgttagctacgagcctacgagcaagcgagtttccaacctctgcactgaacaaggcggaagcaaacacgccgggcgaggtgcattctgatctctcgatatttatttatgcaatttatcgcgcatgttaaccattcatcgcaaagtcgtctcatcgatcgtctgctcctgctggaaatacatctctagtgttaaattactgctatcgtattgtacttttgtgctgaaatgttcacgctttacgtttggcagataaggaaggcgctgaggccaaccatcctctggatcttttgaaaccaaaatcatcctctgaatatggctgcatttctggcgtttttgctgctgttgctgctgtcttacggagctggcagcatccgttgtgaagcaactctgaacaacacagctgatctgctctccctgatggatttcaagaagcatataacggaagatccaacgcaagcgatgagctcgtggaacgcaagcgtccccttctgccagtggaccggcgttagctgcagccggaggcaccctgggcgcgtcacggcgctgaatctcttcaaactctccctgtccggcacaatcagctcctcccttgggaacctcacgtttctcaaggcactcaacttctcttcaaaccatttctccggcaaattgcctccgctgaaccatctccacagactgaaagtcctggatcttaggcataactcactgcgtgatactattccagaggggcttgcaaactgttcgagactaagggtgttggatctctcctcgaattctcttgttggtgaaattcccaccaaatgggccttctaacgaacctctcgagcttatgtctttccaataattcattcacaggaaccatccctcccacccttggcaacattaccggcctaaactatctctctcttcaaataaaccatctcgagggaagcattccccgtgagcttgggaaattgtcagatttgttgtcattgaacatttttatgaacaacatatcaggccgacttccacatgaactgttcaatctgtcttctctacagactttatggttgagtgataacatgctagggaaagaagcactgccacccaacattggcgatgtgctccctaatctccaattcctttccttagcgaggaatatgtttgaaggtcatataccaacttcccttatcaacgcttcggggctatggttgatagacttgacaaacaacaatttctatggccaggttcctagttatctcagtgagcttgcaaatctgtccgatttgtatctagcgggtaaccatctcgaagcaagtgacaatgaaaaatggttacacgcatttgcaaattgtacccttcttcaagcactcaacctagctcgtaatcaaataaaaggagatataccaagctcgattggtaacctatccaccaatctgcaatatctgaatttgggtgtaaaccattttgtaggagtggttccaccgagtatagggaaccttcatggcctaactagtttgtggctaagtaaaaacaatcttattggcacaatcgaagaatgggtaggaaaactgaggaatctagaacttctatatctccaggagaacaatttcaccgggtcaataccatcatccatcggtgatcttactaacttgatacaattttctttgggaaagaatagcttagatggtcaaataccagccaacttaggaaatcttcggcagctagatcgtctcaactttagttacaacaatcttcatggtagtataccgtacaatgtgggaaagcttcgaaacctcgttcaactagaccttagtcacaacaatcttgatggtaacataccatccagttttataaagcttcaaaagctcaagcatttagaccttagtgacaataatttccaaggtatcataccttaagagaccggtatgtctcgtggcagctatggaaggaacgtaattccagggtgtttgactctgtgctctcttcggtctcagtggtcctagagtccatcctgtcggagggccggttgtggtcgttagcgggcgttgcttcctgatgtgaccatggctactacggatacatccgttgctcacatcatggatgaacaataagatatcaagttcgagtcctccaagtgccaaaatccaattcggccacctgctacactgctgacttcaaacgaccgccgaagctccatacgacctccgttttcagcccgtgagtacttgatggaaagctctcggagtcctctttccaatgcatcaagcctcattgccaaattccatctcagtcggcagcaactgaagaaacaaggtgctgtgacacctgtaatgggcctatgggcttgtaacctcatttgggaccccggcccaggtggggcccatgtggggtgcgccccaagctggtggagcacgaccctaggcacccctaggtcatcctcccacccctatatatagctagttaccccttcagggtttcttgggttttgtttagatgaaagtttagccattgctacttcgcttgcagcgcgcgtgtcggctagaccgtccgtctgcttgtattcgaaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgagccaacaatagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcatgtcgtgttgctggtcttagcgtctagttcgtttagagtttcgagttctggtcacgttttgtaccacagtcgtcgctgccaccgtgtctctgttgttgtcgggacctacgaaaacggaatcggctcgttgccaaggttctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctccttgccgagtcccactcgcccctttggccgagtccgaccccctccctcaattccacggttccgagttgtgtcaaacaccttggcgaatttttgtttggtgtcggtttcgagatctgtttggaaaaacggaaccggcataaattaagcattccattttttgtattttaattttgggtttagacttttatatttgagtccctgtaattttatatttatgtttgagtccctgtaatcttacattaaggtccttgagtcagtttttgtttaaaaaaatcaagaaaaaagtgagaaaaaaaaaggcagaaaggtgcaaaaaaaaacagaaaattaaagccacacagaaacaatcagaaaagaaaaggaaaaaaaaagaaagaagaaagaagaaagaaagaaaagagaaaatactgttatgtttgagctaaacttcatatatcagagttgtgcatgagttgttcctagtgctatcttgtggtatcgtttgtctctagtacgttctagcctaggaccagcacggtacttgactttgaacaattattcaactttgcattatctgatttgagcatttgctattcctttgctacatatttaaccctacccagagctccacatatttgattacagcctaccgcaagtgtttgccaaggcatcgatacatccaaccttcattggggtgcttggttgagtcggtatatgtcaccattccacttgcattggtaagatcttgtaagagtttggttaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttgatagtgaatttcaaaagcatgtcttatcggagaaacaaaaggttatgtgtgcctctagtgttttaattaaacatgcttctaatgattggaaacatctttgtaggcataacaaaataccacaatcttggaaagacctgaaacgatatttcagagatgtttatgttcccatgtattatgctgacattttgttcaacaaactacaatgtttaaaacaagataccagaactgttacttcatactatcatgatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36375 - DNA, 251 bp, Oryza sativa
cgtcgcggcgtcgatcggctccgccgtgaaccgctcccgtcgccagggccgccgcgactcgtccacgaccgcccgggtgagggtgcgccgcatccaggcgtcgtgggccccgggatcgcggatccggccccagtgccggtgcagcgcgacgaacgaggcctgggcgtggtcgtcggcccggtgccagtcgccgcacagcaggtaggccgtgcgacggacggcgtcccggcgcgcgcgcaagtactccgcga

SEQ ID NO: 36376 - DNA, 560 bp, Oryza sativa
cgattaatataaccccaattctcatacattgtgtacaatccatcgtaatactactaaactcagaaaaaaaatacttccaactcaaagaaatgttcattcttcggtactacattggcctctactgatgcgggaacttgacgggtgcaggggacgcgaagcccttgtggtacagaagctcggccatgacgctgtacgcgcgctgcgtcaggtggacgccatcccagctgatccgctcctcgggcctcgcgcacaccgccgtcccgcccgcgccgcacatccgctccatctcgaagttgtacttgccgccgcccgcgccgcagcacgcgttggtcagcgccgtgccgtcgaaccccatctcgcgcgcgcgctccagcatccgcacgtacgcgccgaagtagtcggcgtacgcgaccgtggcctccgggtacgaccgcctcagctcccggatcccctgctgcagcagcacgttgtgcatctgcgcgaacaggttgagacccacgaggcacccgttcccgtcgtacgccgcgcgctccgtctcgttcaccgccgccaggtagctc

SEQ ID NO: 36377 - DNA, 3584 bp, Oryza sativa
tataggacactcatatggggcaccatggtatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatatatatatatatatatataattttttatatcgggatgataatgcactttagccattggttctgaatgggcttacagatcacttttatccctcaggcagaactctatgctataaaaaatgctgactagtcgccccgcttttcaaaagtcatttcatgtttcatattgtaggtattgatgtttaggctcttctatgtatatttctcctgcatccaatggatcatatatcctgaaggttcaattttgagggtttgtagaagaatatgatctttggcaactagaattcatgctaatttagttttttttttttactagcataaggcatataaaccctgttacatgtagaataaaatcctgattgttgtacgcagccgagagcaaccctccactttcctattggtcaagtgtcagttgaagagaggagaaacgaagcggatgagaaaatgttatccctttatggaattgcaaaatctaatttcttggatggcattcttactgcccagtacagtgaaaacgatattaatctgagatattgttataaggtgatttttacaatctttcactttggtttgttttccagactatttgtttaatttgacttcaatcatacgctctctatggcaggacaatgaactaactttaattcccagcgtgtccctgccttccaatgctgtatccttaggcttcaaaaggcggtttggtccttctgataagttgaggtcagcatttggaattgttgccatgcctattgatctattagtcatttgtctctaattgtctctggtttgatatttttagccaccacatattcatgctttgtaggctgcaaatttccacaaatttttcttgacaattatacactcattagtgagaacatcaagaaagtttcagaactgaaaataacagacattggaggtgttttgacctcaatgactacatctgtacggatattttatctcattaaagttgaaaatacttgcactatttagaaatctgacttgttacaattgtgtaccgcatgttgtagcatgatttcgttatgtgatgtcctgcttgagcatggctttcggataaattttatggataaccttgtcatgtcaagattttgcaaccaccaagcatgtttatgagcatatctacaagttcctgtgtgttagcaagatattctgcatgaatgataatggtgttcatgagttttacatacttcaactgcaaagttatctgtctggcatttttttttcttcacaaagcgttgaaggatatggtgattgcttagcatcattggtaaatcaataattgtaaattttcattggctgatcaattgctcaatttcctttatattcgtgttaacattacagtttaatatggttgttgggatgtatcgactgcataaggccaatttaaaatttggaccaggatattttcagttatgcccaaggaggcaaaagggttttgcatcttcatgcataatctttgacatctggtagttagcttctttcccaatgtgtctttttaatgttgggttccccttttcagctatcgttatgactttaccactgatgactggaatgctgtttataagcgcacagttggtaaagatttcaaagtgaaagctggttatgattctgaggtgcgagttggatgggcttcagtttgggtatgtatttacagcctccttgttttgctatatctgcatatcttacattactattggagcaagagaattagagaatacaaaatagggttcttttagtgatctcatcaaaatctcgaagttttttcttgtccagacgaaaggtttaaacacacaaaactttccatttattaaatctgaaaccccgaaaatgcacatataccaaagttctttttttatggccatttgtaccattgttagccatctatgcttgctgtgcgcgcgctagtgttgcagatatatgtttttttaatgatcaataattaatataagcaatgttgtgtaaactgtagactgtatctttatgcctttcatggggggatcctttgacagctgttttgacaatttcttaaactacgacagttttgttgaagtgctggtttttatggctaaaacatgcaaaacctgactttgcatcattagacgatttgtccattgaagctaatattgccttctgatggctcaagtgtactgtacttttatgagcaattcgtgagtttcgttttcttggatgctaggtgggtcaagaagacggcaaggcaaagaccgcaccaatgaagacgaaacttcagctcatgcttcaagttcctcaggacaatttccgcaatcccaccttcctgttccgtgtgaagaaaagatgggatctgtagcatatgctacattatatactccatttgtatggggataccagtattgggtactcgggatttggccaacattttgttgtaagctgcgtaggatggcttgaaaaaaaaaatccatgaagcctttccaattctcatcatgtaattctgcctgctgtacataacggccatcgttcgttccgcacataagcaatttgatttccatgtaagattgttcacccctttactcgaagttctgggctaacttttccggagtgctatcggatcttcactccgattccgaatccgttttcgaatactctgttgatgtcctgctccgatgctccgagtcgacatcgaaatcggacagcctacggcataaatagagccatagagggacgcgcgcgatgccacggactatccacaaacaccaacagctgcgtcgcatcgctagccaacacgtacgtacagcgcgcacttgcacctagagcgccatggcgagtagggttcatccactcctcgtcgcgttcttggtggtgctcctcgtcggcacatgccaggcaaggccggctccgggaaaggcagcgtcgtcgtcgtcatcgggagtggtggacggcatcacggccatctacaacttcggggactccatctcggacaccggcaactacctccgagaaggagcggccgccggcgccatgatggagcacaccgtggcgcctccttacggcgcggccatcggcggcgccacggggcggtgctccgacgggtacctcatgatcgactacctcgccaaggacctcgggctgccgctgctcaacccgtacctcgacaagggcgccgacttcacccacggtgt

SEQ ID NO: 36378 - DNA, 6478 bp, Oryza sativa
aacaagaggaaatgcatacattgtagagtaaaacttcagttgaggtccaagtatggggcagatcgaacaatctcgcggacagagcaagcagaacttatgtttctgcatcagggccaacacaaattattctgatgggctagggggtttttccttgggatgctttgatccatagtgatcaatcaattgtttctcattggccagttgaacctacacaaagaaaagcgatgtttcattaagttgataccacatccacatgtgcgtgcgcatgcaaaaatgagtcaacatggtgtaggtcagatcaagcagtgaccagtaatagattctaattcagttacggaaaaatgtatttataccacacgttttcgcttggtaccaaataatactacaatttttttcaccttaaagaaataatatgactgctaaaatcttccatctataccgtttatcaaattgggaacagcattgtccaatgataaaaaaagatgtaggatgatgccttcactgttactccaaccagtggtggaggacagaagggggctgcttcatcagttggaatcagaactcactggagagaaggctttataatggtatttatactattcacaacaacaacattaacaattagcagaacttaacataaatagttcagatggaagatatgagcagtgtgatattttcccaaaggggaaaaaatgtggtactaataggcaccaaccaaaaacttgcagtacagacactgagatgcaattttctcctttaaagatgctcatctttggacctacctctcgactacacactcatcagtataatataaccaaaactgagaataaatgattgatccaactacaaattttgcctagaactatattccccaacccttcctgattgttcaaccataacacagtattcatcagaggcaggggcggatccaacgtgggtgcaggggaatatagttgataagataggaggtgctaaaggtctcataatagcattttagcatagtttaatactgagattatgtgtttatatcggtgtactcagtatttgagtccccccaactttttgtttctggatccgcccttgatcggtgattatcatagaaatggtaatggacaaacaatataacagcagcaatatctcccaaaagaacatcactagggtaatgtaatcatactagttccacccttggcaggcaggctagatgcagtgcttagagagacgaagttagaacaattacaataatagaaaattatcccctatgaaatttccacatcaactccctgtctctccttaccccgtaattggggtgcatccggggactatagacgaagacggacaaaatcgatcactcggctcgagattttcagatcgcatgggataggagcatagggctgggtggatcgtggatgagacgataacaagaagctaaagatccagccatcccctcgaatcctccatgaatccatccaatctagcggtctagccttagggctggggagggaataccgaatacggcaggctacaagctactggttggattagcaagcaggaagggaagaggagacggattcattcgtcaccttgcagatggggcagatgaccttgaggccgacggcgcgggcctcgagctgggaccccttcgacttctggttcttctccgcgttccgccgctgcgcatcgatcttctgcttcccccgcgtcatcggtgctcctcctcctcctccccctccggagttcttccccttcctctccgatcaatcgatcgatcccgacccgagagctccaaacttccaacaaccaccgcaacagaatccggattcttcttcccttctccctattccccgcttcccatctcatcgccgtgggccactgggccgacagccttgttggacctgcaggcccagtagtacacaaggctatcggcccattagagcatgattaattaggtggagtattagtttaaaaaaacctgtaaaataaattaatatgatttttaaaacatttttctatggtatattacgaacattttacacggtgcaaagcgctggattcaatttttattccagaacatggtaagtggctgagtgcacgtttggtttgcctgtcagtagaaaacataggctcaactcttgcatcatgatctttactggacaagaagccagcggattggcacattacagagaggaaggtaaacaacaacaaaagaacagcatcataacaaacaacataactgaacgaacggaatctgactacaacactctactacaacactctgctgtaacaggtagcaaccaaccgaccaagcattttattactgtcctttcttctcacaagacctgggattacaacggaaaggagtagccacgaaggtacttggaatcgacaccggattcgcggaccagcgccactcgccctgttctggcgacctgtggtcatggacggaatatgcattagcgaggaaagctgggtatattacatgtggatatagagatcggatttctatccattatctaaaaaatagtgaggaaagtaaacgccgcgagcatgggtgcgaaagcatacggatccattgtcccagatagaaaggagacggctagcaacctagcatatcatatttaaagacataaagcagatgttggcaaatgatttaaaattattttggtagtcaaaagcatgtgttcacttcggcaaaagtatccattacgtgtggagaatgagtttttgagacaatgtgtgttaatacggtaacagtatttgcgcagataatctgttgacatcatttcacatcacataaccacatgagcaacaaacggatgaggtgaaagaaaagtacaaaaagaattcaatatacctcacagatgccataaggctccaacagcctttgtaatgcaaccatcttgtcgagatccccagtaagctgcacaatcgcggcaagttatcaagtatgcagaagtcccacaataatttgaatgggcattaaatgagtaaatgacagttgtggttcagctaaacattcagtgtttctgcaggctctgtgctgctaaacagtaaagcacaacacaacttattaggacaaaacactagaattcctataacaatgctgcgggtaaaattatatgctggcactttgttatttgtacatagatcggtgttcttcgtaaatgaagctgattaagctaataaagaaaagtttaacaatcacaagccacattagccataaaattaaaattacctgtaacgtaacagtgtgatcagaaacatcaacagattttgcccggaagatttcagcaatatctagtatgtctctccgagcagcagtgttcacagaaaccttgataagcataagttctctttcagcaaaaggcaagtgagttatatcttgaacctgcacaaatcatattttttgaattaatgcgactttactaccacaattgactgctcttgaaaactgcatatgatttacctcatgcacatcaacaagtttgttaagctgctgaactaacttctcaatggattcatctgttccaggagcaactgttgtaatacgcgaaaggcctgacttttcagctgggcctacagcaagactctgaccagtagtatggtcttgttaacaactaatcaggcatgacggcgaggtaataactattcgaaaaaaagaaaacctgtatattgtagcctctgcgagcaaagacccctgtaacaatgttgagaacaccagggcaatcattgacaaggatggatagagtatgtgatcgaagtccacttgactgcaccaaataaaatcatatttagcttagaacctgcatccttaattttgtatacattaacatgtatatttaacactgaccagcttagagctacagagacatttatatatatatatatatatatatatatatatatatatatatatatatatatatatgactggttgctgattgtgaagatggaaaatgtgaactcagtgtagtcacattggaactagattcggttttgaatacatacaacataagttagacatagttttttttgtctcaaataaagtttggatatagttgccaaggttcatatgggacctaacactgactgaataatgcttttatctaaactgataatattgaaacttacatcttcatcatcaaggacgccccagtgagcatcaagtacttggttcatggatgaaccctcataaggttccacaggatagacatcgccctgaacaattaaatagtaaaagtgactaaatgttacaggaatcagtaacatattgcaatagacaggcatatacgacttgttatgttactcatttctggccatcaaatatattagcatataacttatgctatgactaatgcacagatgctataccaaaagttgaacaacgttagtgtgggggtgcctgcttatgtatcatcaggtctcatccaatgacataaggtactagtgaatatgcatttcagtaaccccaacatgaacgccacctgtaattctactccacagtgtgcttttcaccaccaaagaatatgttgtcttcagtgaactcacctcacaggactgaaggtaaatatttaaatagaaatatggaataagttcagagatatggcacctttatagcatactaattgtgtttatgcactaagttattatcgcttatagcattacattgttctggaaccaatactggctaacatctaggttcaactgcatttgttttcgtaccgagtaaaatgcactctcaacataaccagctaattattcaaattatgtaaaaataaaatagaactagatgaaggactcatgagattttttttctatttaaagtacaagaaacataccccagcattggatggttgatcaaaacttccattgactgtcttatttacagaagtaagaagagaatttttgggcaatgcctctatgagatctgggtaagaagcagcagaaaatccccagaagcgggcagttgctccaattttttcacgtctcaaagcaatctgagggggaaaaaagagtcagcactgtgaataacacatgtatgcatgcatgataaatgcaaatagaaaatggtcaagaaaatacttttcccgttctacaaatttcttttatcccaaatttgctgaggttcctttgcacagcaacaattttgccaggatctccagttacctacaacttgatcaaatacacatcaaaggaattcctacaatcatatgtatgtaaacctgttggaatcaggagtctttacctcgatggtaagggtgttctccgaaatatcaacaactttcgctcggaaaatatcaactaaaaccatgacctgacaatcataacaagattttgtgcagtacgagtgagttccaacatgcctgttgcttaattcactacacaaagtttttacactatgcaaatagcaagtcaacagcacatgttacctcaggacgctgatctggttcaacattaatttttataagcatcagctctctttcaacctgtggctccttagatagatcttccacctgcaatttttagccggcacaagaattaaggagagtataaaatcaagagaaagagaggttaaaatgaccatgctatccagcgttccagacttaactaccttgtacataggtgaggaatggttagtgcgatgtttcgtgtgaacacgggagagagagactatgtgatagataagggaaagcaatgaacattttcaataattgaaatgcaatgcaactattttaaacaaggtcacatggcagtatccacatatttatacttatcagatgctacagtagcatttactgtgctataactcaagtactcaacgaaaagcccaagatactcaggaatacttaggttataatagaaaacctggttatttggttacaaatgaaaacattgaattttaatttttctgctcccggactttattgcataaattgtgcagacaagagaaatagagcacattacattgaccagaatatgtctgtacgtgataaaatgcaagtttgacattcaatatagttagcgagatactcacggaaaagagttatttattcttactcttagaagattttcaataaagagggctaatgttttgaccagattaagataaaaggtttctgcccttggtatttctagctacaaaagatgctcaagagcaaggcacgttataaaatataaacagagttgatactgtagaaattccgctctttatagaacaatattcaacattggtatcttcactctgctgacaccaatcgctgtcaaagaatcttactgagggccggaagcttatcagatctataaatggcaaactaaattggtttaagcatcaaattcacatgaccccaacaaattttggagcaagggggctcacattcaagacgttgacaagcttgttgagctgctcgatgacttggttgagcaccctggtcgtgccggagacgacaatggtgaacatggccttgtccttgatgagccccac

SEQ ID NO: 36379 - DNA, 4188 bp, Oryza sativa
cgaccgcgcaccgcttggctttgggggattacggcgtgtccggcgtgtgcgagtgcgagtacgagcgtgacaccaccctccgcgcgcggccgcggcgcgatccgctcgcgatgggtcacgggtggccctgcgttcgcgttggggcactacttggccgggcagcggcagcggctggccggcgtgggggaccgaccgatattcggtatcttggtctgacgtcgacggccccggcggctgcggctcccacagctgcctgcttttgctttggaggctttcggcaattcggctccgtgtctacgctctctatgggtcaacatggttatcttcgaaaaataaaaagacccaacccatccaactcatgatgatgcgtcgaaatggctgaatttgcgaggttttcttttcttaagggtttggagggtgtaccgtgtacgtgtcaccgagccgctcgggtttgtaggtgaaagtgtagtatcacgcatgtgcgaagggtcgatatatacatgtgatgatgccaggtgccagcggtacggccaaaagatgatgccacgtgtttcggagttgctttttgtagttttgtttttcttgggcgcgcacgtcaatcgattcgttacgtggtgcaatgaggcggcgtttgctttactccatccaagtggttgggacgattttgtttttgtttacgtgcgtgggagctgtcacgtttctcgtgtgtttagcgactattttgtgaggaaaaaaattaagcatgagatcgtggagcatgtgagtactgttgtcatcgattcctctcgtaaatcgtagcacgccattttttagatgaaaccgagagatggcccgagaccatatgccaagagctccctccacgcgactctaaaaaaacagaaaatagagatatcaccggatctttttttaagttgcaaattaggacgtatacgtacacacaccacgctcacatcacacacaacacacgcacccacacgcgtgtttctaacacacgttagaatttagattggagacctatatcttaatgcacgggaaacatgtagtagtattaaacacgcacacatgtatacccttatatctgatcggaaccaatcgagtcgttccggaggaaagaggggaaaagaccccgggtgagcacgagcgattgcaacggacattcagcccattgtatttggaacgaaacgttatcgcgacatacttgaggcccattgtagccccttgcatttgggtcgaaacaatatcgcgacgtacgaggcccattatatctgcctaactgggccggaaaggtattgattgcctgcaacggtaacgtggcgcacgtgtagtccatcatatttgcccgttcgggccagagcggtatagtggcgaacgttgggtgggcgggccatttgtcgtgcaaggccgcgcatgcatgtgtacgcgcatcatcatccaccgctcgcgaagtcgccatctcgatcgtacgaagcgcacttgatcaatgcactggccaccggtgcacttgtcaaaatgagggaaacaccagggcggttctcccattcatgctgcatgctgatcttccaccacgcgagggcaaaacgaaacgatataatactagtactagtacatttactatcgtgtcgcgtcgacagcgacagcgacagcgagaagagaggatcgtgcgatctgatcgagtagctagcgctttccagtcgcgcgcgaaacccgcccgtcgcgccgggcaagcaagcgcactgcgactcaccatcgccatcgacgacagcgacgctctcgctcgcacgctgccaacatagggcctgtttggtatggagagctccacccaactctactcctagttttgttggagctaaaactgtttggctgagctccagctccaaaagagatagagttcgagctagagctgtgccaaacaggcccatagccccgcgtcccttgctccggaggtggaagtcgtgcttattacactccccctatcttataatatagcaaccttaaaccaaatatgacatattttttctatttcatattataagttgtccgattcttttattaatcaaaattctttagatttgatcaaatttatagtaaaaaaagcaatgtctacagcatcaaattagtttcattaaattaaaagttaaatatattttgataatatatttgtttttattgaaaaagtttgtattaaaaagtaaaatggcttataatataaaacggatgaaataaaatagtgcaacaaatataaacagacgggagtaccaccagttgttattggattacaccctcaaaactatattcattatactatgttacatccgatttaagattgttatattatgagacggagagagtatctttgttttttaatatatgcgctgttgattttttaatagacgtttggttattcatcttatttatttttttgcaaatgtaaagaatttttttcatgtttaaagaacaattgacgacaaaacaagttacaataaagtaaataataattacataattcttttatgaaacgaacgaacaaacataacttaaaagattaacgacactatatattaaaaaatgtgagagtatttcctaaccacatgtgctggagtggcatgtcattggcggctaataatttctctccattatcctgagctagaggaaagcaagaagaagctaactaccaaagggaacaaactgtgtcacccaccacggggcccacctgtcgggctgcaagtaggggcagcgtatcgatcaaacagtaaaagaaaattctgaacgaaattatgctatttattcctccatcaagctttgtcgtttggtggagctttcatggatgcgatatgataatccgaatccagcaggggacgggatattttcgatagctcatacgctatccggtattggtgagatgccacaaaaaaagaatgtgtcatctcaaaatctcaaccgaccggattaagcacgaacgtactcgatgcaatcgccattccaaacacggggcaggacactgttgccattgaggcgccggaaactaaaagatcccctaaataaagcaaaccaggattggacaccagaagccattatacgtgctgcgcaactgttctccttttaggagattccgcgaaagaaaatgaggccatcaatgtcatctctaacctttttttccctacacagaatgttctcctgaatcgtgaagggatagctaagtactacatcaatttaatacggtgtgtgcacgttgtaagtgtctacgtttgtaccgtgtcttttttctaaaaaatagaaaagtgcggataacggattgataatttcagaacagtctcttttgttcactagagcaagtaattaaaaaaaggtcaaattgtcaagctatatattataaaccggtacagttttattatttttttataggaatcagtctagtcttgcacgacaaagtgttgaaaatttcaacagacaagtcatcacacagcccagtagcccaccatccttccggttctccagctacgcaacaataattcaactccaaaccaaaacacaaaaacaaaaaaactgaatagtcgtcggcaagtgttctcacgaaccgacagaaaccaaataaacaccaccaaatccacccactccccactgacaggacacccacaagagagacggccccacccgtcagtgacacctatcgccccaacccccaaacccaaccagtaataattttaattttaaaaaacaccaaccacgcgcgcgccttttcccccacaccggaataaacaatatcccggcggttatttcccaccctctacctctcacctgcacggaagattttattaattaatgggatgtattctccccttctctcatcatatgcttcccactgttctagttccattccactgacaaggacgcttgatgattagtagtagtacgatttacgagtgctaatggaattccgcgtatactaatcgtcctccggtagtagtagcagtagtacgctcggttcgtggaaccccactctccaatccccaaaagcatccaccccacggcgcgagatcccaactgcggccgcgggattcttcggaggagtggtgatcgccatcggggtatggaggcggcggcgaagctgaagaggagcatatcgcggcagctgtcgtcgggggcggcgagggtgtggcggcagctgtcgctggagccggtgtacactcc

SEQ ID NO: 36380 - DNA, 1353 bp, Oryza sativa
atgctggccgtgccggagaacctggacgcgacgatgcggctgctgttcgcggcgtgccagggggacgtggccggggtggaggagctgctcagggacggggtggacgtcgacagcattgacctcgacgggcgcacggcgatgcacatcgccgcctgcgaggggcagggggaggtggtgcgcctgctgctcagctggaaggccaacatgaacgcccgcgaccgctggggcagcacggtactgcgccatccttttctcttctctcctctcctcgcattgctatccatggtgctctgttctaagttctggaatctggatgaagactgttcatgtactactgaacattttctagtgttcgttctgtgtgatcaaagtatcaaacattactagtaatcgagtattcattttgtttctgcaagactgcaactagcgaagtgtaaggcacgtacgcactatccatgaataagtcgattgactgatcgaacataaatgatgcgtgcaatgttcttatgttcagccagcggcagacgcgaagcattacgggcactttgaagtttacaaccttctgagagcaagaggagcaaaaactccggtactataatcacctacttaaactcctgaagcaattgattgttgcttacttgctttgatacatatatacagaacatatatagtgtcatgttttttttttctttttttgcttcttagaaacaaaagaagaccccgatgacagtttcaaatcccaaagaagttccggagtatgagctgaacccacttgaactcgagttcagaagaggagaggaagttacaaaggcacgctcaacttcccctgttttttttccagtaatttgtttattcatatgtttggtatttatcaacttccacttaagtgctaaggcttatgatacttaaaaggcatgtgtttgtgtatgacacctgatttatatctggacttacaatgattaataaattgtgctccactccccatggaaactcaatctagtgatggttcttagtattttcatcagttgattgttttgtgagttctatcttctaaattatggtccatgtcttttcttcttcacattcatgcaaatgcacatgccctttttttctcttatgactttcacagaatcttgacaaatcctacttgccataaaactttttacagggtcactatgttgccaggtggtatggatccaaagtgtttgttaagatacttgacaaagacagcttctcagacgccaatagcatgtattagctgcctccgtaattctccttactattgtaccttatttatgcctcatgcagtcgactattccctaccatgagtccatgatatacatcttctcttca

SEQ ID NO: 36381 - DNA, 12129 bp, Oryza sativa
tgtttcagtttgttggatatatcagtgtggaattccaattactcagtgacgtcatgctatttttgttcactaaacttgaccaacaatctttgttttcacagacaaaactaagagtaaattatattattgttattgaagtgatgcttgttgttgatatcataatggatgttattttcatatggtcagtgtgtaacctaaactaaaatagttttaaatgataaatagaggttccctattttccagatctgtctacttggtgttttttgcttttctttttttatttttcatgctgtgcttctaactctaagtttcattgctatatcaactcagaaatgaatttaaacacgagcttactttactggagaaggcccgccatccaaatttggtccaatttgtgggagctgttacacaaaatgtaccaatgatgattgtttcagagtatcatcaaaaggtaagctgttatgattgattcaactggaggaggcaacgattgtctttttacacataattatttcctaatcatattccttcaaattgataatttccttggtgcaatggttggcagtctatggacaattttcacataatcttgataagagtactatgaacttacctgaacagtatgcctcttttgtcatcaatgactaaatctgttttttttttcggattagggtgatttagccagttatcttgaaacaaaaggtcgcttgcagccttacaaagctatcagattttcccttgacattgcgaggtatgtcagaagacatattcaatagagtaaaatgaagctcatgtctgctagctttggaaacctgattttatatttttctacaaattgagagagcattcgttttttctcatttaggggattaaattatctccacgagtgcaagccagagccaatcatccatggcaatctgtcaacaaagtaagctgaattaaattaattttatcattgggttggttcaatgttttgaaccatactgtctttcaacttgtgcactgtatgttatgatattttggtaaggttgcagaagcattgtgcgggatgatgaagggaaacttaaagtggcaggctttggctcacgtagtctgattaaagtctcagaagataatccacaaatggatcagacgacatcaaaatttaacagtatgttgaactcttgttttgatgctacaccctgaaattgctcattggcagtttatatcgacttcagttcatacatattgggcatattctagtgtcagaaactatggcaaattggcaatatattgtactacttaaaattcctaggcgatgtacaaaagtgcacatttgattggggagtgactaatcgtgttacttattggtctatacttctttaaaataacatgtggtttctagagcctcatcagttgcccatattcactaataagccaaacggcttattagggaatatcgttgaaatggatatatgcatttatgcattttggaaaaaaaaagggggcactttatacgtgcatgaagcttataaccgattaaatgtactttaaaacctggttaaatggttataagttatttatgatgttaatcctttagacggaacatattcttttttttagataatggaatgagtaacatcccggcctttgctccaaagagctacagtcctttagtcaattttattggccccgttgcagctgcatctgttctttacgtgaagttaagacttatgaatgtttttctccctgtattgttttgtatcattttaactaactttccatggcctgtaatagaatcggtttactatgggctgtgtgcatgttttgtattttatcttctattatgtgcaaaagagtcacttgaacacttggtgttctatcttgtactcaacaatcttcataccgtattttgcctaggtgtatacaccgctcctgagatgtacagaaatggaacgtttgacagaagtgtagatgtatttgcatttggtctcattctttatgaggtatgtaaaagcattcatcttacacgcaacagaatcaatttgtactcctatatgctaaagagttgtcacagttgaatgtattgaaagagaagaaaaaaaaatccacagtggtggtttgatttgactccgatatttacttgaactggcatctttttaaaatggcattttctgcatggacttttatgattcagatgattgaaggaactcatgctttccacccaaaaccaccggaggaggcggcgaaaatgatttgtttggagggtatgagaccaccgttcaagaacaaacccaaatactatcctgatgatttgagagagtgagtgaatctttactataagcttttcaactagtaactagaagtagtttctatgcactgtattattaccttggtggtctcgcaatgagctttgtttctgctcaatcaaaattcgcaaccgagtttaatcgtttggtttatactccgctgataagtcgttttacggcttattatcaatccaaaaattaatttatgggtaaagcttttatatatgttctcttagcgatttaaaagccaatataaatatgataaaaaatcttaaaatcaacttaaaattaggttataaaaatcaaaattctggttccgttcgataagccaaaaggcaaacgatgtcgctttgcaaaagctgcttccttcacctttttttcttagcagctcggctgtactgtggaggtttagactttagcacctaaaacatcatcaagcacggtgttcttttcaatgcaaaaccgcctatgtttcattttgtcttcatgccatttgcctctcacggtggttcgttgcatgcaggcttatacaggagtgctgggatccaacaccttcggtcaggccgacgttcgaagagataatcgtacgcctgaacaagatatccacgagttttactaagcagactcggtggagagacacttttaagttaccatggtatacagctctccgagctctcaaactttagttcatctccaaactattttgaactttttttatttcccctgattgttctaccatcagaatctgcctggttctcacgttttcacctgatacaggaaacaagcttcagagagatagcctggttgccgtcaagatttccgccctttttgcatatgtgagtaaacacggtgaaaattgtatcgagttgtcgaggagatagtggtcatttttcacgtttttgtatttccaaaaaatatttgtaactataatcagcccgcttttactttcttatgaattatatcatttttaactggaataatgtgttaattttctgaacgttcaacgctgctcgcaagcatttccccaaagccccccttgccgatcaattacattttatatttgttgaaacttccacacaaatttcgtgagctataacatcgtaaaaagtttgaaaaggaagtctaatcaacctctttgttaagaggacattaccatgtaactctgcagcggaaaaaaaaaactagatatatccatgagctccattgcaggagggcaagcagataatgaagtacatgaggaatataccttaggagttatcatcaactcctcatataatggatccatgagctccattgcaggagggcaagcagataatgaagtacatgaggaatataccttaggagttatcatctgctcctcatataatggattttgacattttacttaggagtcgtattgtttgaccacttctcttatttaaaaaaatatggaaaaaaaataaaaagttgtgcttaaagtactctggataataaagtaagttataaataaaataaataataattttaaaaaattttaaataagacgagtgcttaaacagtgcaagtaatcttttatattagagacggagggagtactatcaataacgtgtgctaaaaaagaaaaggtagcggaagcatatactccaccaaataggctgctcgtattggcacctcatcaaatacaaaatacagagcataaaaccgggggaaaaatagtaagaccgtaacaaattccaagttctacagttattttaattttcaaaacttatactgtaattccaagttgcaggtcacaagctgagcaaaatattgtgaccgagttgctggaaggagtacgcgcctaccctagcagattctgatacctttgataggatataaaacggcttattagaaaaataaattacgggcaaaacttttatacatgtgtacttagcgatttaaaaaccaataataaaaaataaactgcaataacaaactctaatataccaactctaaaattaaatatttaaattcaaaatttgatagctgcttataagctgaaagacaaacgatagaaacatgccgattcttttctccgcattagaattggcttctccttcgacagagataactaaatatggatatgtaaaatgagaaaaaaataccacataattaataaagttttaattattccaaacataaaaatttgatttatccaatattttaagacaagctatatatatatatatataaataatttattcttttttaatagatgatgccattaacttttaaacacatatttgaccatttattttattcataaattttatgtaaatgtataatatataaatcgtacttaaactaatttaagtgataaattaacttataacaaaataaattataattaaatttttttaataagataaatggttaaacatgtgacaaagaaagttttttctgaaacatgtgaacaaagaaagttaacggatgtaataaacttcaacaattttagaaaaaaatgttaaatctgcatcttagacagtccccacatgtcattcgctgccgcgccgcgaaaactttatttccccctctccctattttctcgcaattttttctcttctctcggccgctgcacttttttctttctttcttctcacggcttgtctccccttctcccctccaaatacccagcggctgctcttctctctcgtccctcctcttctctctctcctcctcctctctccaaaaccctaacccctcctcgatccaagcagctcgacgggctcggcggcgcgcctctcgcccggcggtgagccgattcactctccacccccgctttacctcgagacgatccctgggcgtgtttttctttgatttctttcccctgggtttctctgctgggggattcgcgtttgagccgcgagtaggtcgttgggtggagtggatcgggagccgggtgggtgagctcgctctttgctcatcggtgtcgcgttctttttgtttttcttttgggtgatttggctgtggtcatcttaggattgatttgtcagtgttgatcaatgcaaacgaattagtgtttttcctaaaagttctttttatttttttccatgatgttgtagcgctacactggtagatcctaagtgccgtgtgtttggattgtctctgggttgttggttctctgtagctaccagaactgtatctttccctcgattatttgccttcacaggaattgtaaatgagtggactttaatttactgtgttacttgggttccctgtatctgtactctagcaacatgggagtagctggttccctagttccagctcgcgatagtaattttcttatctgttaggttcaatgaattgattcctattccattctttacatttgttagattctagcaaacttctaccgatgttagtgttgtgctgagatgcccttggatgcttgaagtgaatttctggtgatagctatcttgttgatttaaactcccacttcaacacaccacgtgcagtattgtgggaactctggataatccttatttcatcgttgaaaccagcaaatgtagggcctttgggggaaagtagcaaaatttgtttaaacattaagctagaattcttggaatgaatattgttcactcatatgtgctgcttctttcttttttccctttgtggataatccacacgtttatgcttgaattggattatttcagggtctttgtccgaaaaaggcatgaccttggccttctaattggaaaggtgtgaagcaattaagtatggcttcaagggcggtcatcagaagaaggaagtatcttttggatcatgttaacgcacctaccctctcattgtcccccttctctaccttccaacatggaagatctggttctgaggatgaatcaagaatcggacagcgatttcttgagcaaagctctggggattccaaatgggagcaagggcagtatggtgtgaaattgataaagggagatctactagcccttggtaatgggcttctgcggcgcccagcccatgggatttctctacctgcttatggaattggaaggaaggaatttgggttgcctatgggtgctagacatttgctgcagtcagtccgcacagcctcaactgcaacagctgggcaacctaagttggatattgaagatgaacagagtgaggatcagaaacagaacaaaaggaaaaaggaggcatccccagaagaatgtgatcaggctgtggaaggcctaagcagtgcaaaagctaaagccaaagctaagcaggtacaagaatctgtaaaggctggccaatcaattgtacgaaaattctgggcgaggcttctgggtattggtcctgctctccgagctgttgcttcgatgagcaggtctcacttccttctctttgccctccagcccataattttaagacaagaatattaatttcccctttccctttcttttattaacatttgtttctttttatgtgttcagagctgattgggctgcaaagctgaagcactggaaggatgaatttgtgtcaacgctgcagcattactggttagggacaaagctactctgggcagatgtgaggatttcgtcaagattactggtgaaacttgctggtggaaagaacctttcaagaagagagagacaacaactgacccgtacaacagcagatatcttcaggctggtaccttttgctgtgttcatcattgttccattcatggagttcttacttccagtgttcctcaagttatttccaaatatgcttccctcaactttccaagacaagatgaaagaagaggtatgtcagtgtaacaacttgagttacataatatgctaatgtgatcaatattgtttaggcgtttgattttctctacttggtgttgtcttactgatactttactaatgcatgtgtactatcattatggtaacaagtcaataggaggttgtatgcatcttccatgtttgctaatgagagatttttgcatctcgagtttaatttggtgtccccttgtaccacctatactggaaccacaaaaactattgcagtgcaaatcgattggtttaagaatgtagttcactcatctgtgcaggaagcgttgaaaaggaaactgaaagcaagaatggagtatgccaagtttttgcaagatactgcaaaagaaatggcaaaggaagttcaaacatcacgtagtggagaaataaaacaaacagccgaagatcttgatgaatttttgaacaaggtataagttctatacatgcgttgtttgtcactagaaggttagacgattttctgaatttgtttgtcgaataactcactttaaatggtaattaggttaggagaggtgaacatgtctcaaatgatgaaatcttgaacttcgcgaagctgtttaatgatgagctgactttggataacatgagcaggttaccattcttaatatacttgtaagttcatcatcacattacactagagctgattgctgattgatatttcttttttcaatttttctgcagaccacgcttggtaaacatgtgcaaatatatgggtattcgacctttcggtactgaccactacttgaggttcatgcttcgcaaaaaactgcaagagtaagtacttgcgtcgagaagattatatgacatgtatgaaaatatttaacttaacaactggagtgccaattagatttgcatatttggtgtcttaaatctgtttgacataaatatgactggaagtttggaatggtcaattttgaaatacagcgagtgatggatacctggggatagcttattgcttagtactttctctcataaagcttagaagacaaccatcaaatggcatactgagtgatttttgcaatcttgtagtctcttatcataattgcataatataagaacagaggtgggtggcctgcaaattgtaaaacaaaggagtgatttcaagcaaaagtctacggcacctaattcatatgcaaagaaaataaacagtaatttttttgctggatatgcaactgaaacttagtaaacaccagaatttgtatttgtttgtatttttcaagatctatgtaccctaagtggctgtggcatacatttgactcgaacagtttctcaggtttaacaactatgattatttgctgtacagataagatattttaacagtatcttattattcaatgcactagttgttttgctatttactttgctgccgtttgcattttccataatagtagggcgaaatatctggttattgtttgtagtgagggcccaccttcctgatccatagggggcgtctccccgagttttttttttttttggttgggggttggggggggggactggctttcgtggccttccccagcccccggtttcaggtgtattgaaatgccctgggggaggtctttccccttgggaccgagtttatttatttttggtttgtaattatattcttctatatgtagcattaagaatgacgataagatgattcaagctgagggtgttgagtctctctctgaagaggaacttcggcaagcctgtcgtgaacgtggtcacctaggtttgctgtcaacagaagaaatgcgccaacaggttggttttgcattgtttccgctatatgcatatccacacaatttattcactcttttacttgctggaattatttgttactctcgctgcctatacgtcactcttggcattcattcctttctcacattatatgccattcttcctttttgggacgaattagttcacacctttttccatccactgtccatttagtccaaacaacatatccgtgataatgatatctcatgcacatgtctaggcttaacttcggtcattttaacacacctttgattcttgtgtcaagaatgactagtgatgcggcatactcatttttgtgtttccatagattagagccatccatcaatttccatgccgggcttatagttttgttctacaaaagaatatatgtttgttctgtgcaaaattatttgtcctagttgttactttctcattctttagtttattacttattagtttgagacatatgatctcattagattatttcttcttgggtaatgttctgttaggtctgataggcagatgaaggaaagttgtaactagcacttagcttctgcatttccaccttgaattgagcacataaaaaacttgatcacatagcttttaaccatactgttgtgtgttacaaaaaactaactgctatcttgtaactgaatatttttctaagctagtaattttgcttcctgtccagctccgagattggttggatctctcacttaatcatgctgtgccatcctctcttctcatactttcaaggtaacattgattgatatcacatatttctcgtttgctatgatactgctgtttgatttgttcgtgcttgattctaactcatatctggtgatgttagagcttttaccgtatctgggaaaatgaagcctgaggaggctgttgtagcaaccttatcttctctaccagatgaagttgtggatacagttgggaccgtattgccatctgaagattcggtttctgagaggaggagaaaactggaattccttgagatgcaggaagaacttatcaaggtgatgtatacataatatggtcctttctttatgtacataagatatttcacttctgcttgtgcaaattaaacagttattcttggggcatttatgaaatcagtaaatcactttgattgtacaaatatcagccgatgcagaactgccctctgttaaaaatgcttcctgtgtttaatctttatgtaccatatcttaatttatattaaattgtatttgacctagttcagaaacacatccatttataggacaactgatggatcatctgcactctgcattctcagattctgatttgtgtgaatgttaggcgtattagtatttagtattgcatgttctgttgtgcccttgctaggtttcatgcttgaacctcataggatcttccatatcctcttggtaatgcatatatcagaaacagtacatggtttatactattcaaacttttccttgtgaagaacaaaaaaaagaatgactgaaaaaagagtaattggagaaaacaacacatatacgatagtgcatctaaattgtgatgcattaactgattcttgtgtgacgtgtgttttcacacgtgccaaagttagactgttaagtttctgtttatgtgcccatattaagaagtttggaggagtcattacaaattttactcaaatttagactgttaagtttctgtttatcagctaatccattggatgtaagaactataatatgctgtatttacacttagcttgagaagaacataagtctgttgatgaaatctgatgtgtcaactttagtttaatattgtggaaggaacatgctttttcctttttctgaaacaaattactttcatttcaacaaaatactgctagaagtaggacttaacagtatcccaattattttatgttctgcgtgatacttctaaaattcctatgttgaactgtagcccaattgttctatcttcaagatatattggctacattggattgtaatgcttttgatatgaaaataattccgtgggagagaagacgaacgagaaagaagaaaagccgaaccggagaaagaagaaaaggccaactcaaagaacaaaagcttgtgaggagaatttgctttgaaggaaatgactgtcctactgctagggaagaagaagaactgagagaagcaaaacagcacgataaggaaaagctctgtattttagtcgagcactggctgtactggcatccgcatcgagatgatcctagttaagccatactttcttttggtaactatacactgactatagtatccttataattctattgaaccactactgtttttatatgatagaaaataattatgcatttcttttactgtaattatgagcatacaacaggccatgtttctgacttccttatattgcagtctgttagcaaggagcgtcaagagttcctcagccttgtcaacaaagaggtatcatatgaacttgtaaagtgatattagagtgacaattgttcatgcagttatcttccatttttgttgcaaatacttgggagggttcaataactcttggtctttgttgaatgcagattgaactgtataactctatgcttgaaaaggagggtacagaaggtgaagaggaagctaagaaagcttacatggctgctagagaagaagtcggacaaggctgctgaggttgatgaagaagaaaaggtctcatcggcgctgattgagaaggtactgatacttttcatcctgcatgcaaattcatagtttaccacggtgactgaaatgccccccccccctcccccctccaggtaacatgcatattaggttcatctctgttttaaaatataagtagttcgtgtaaatctctctgcttgaaaatataaggagttcgtgtaaatcctaaaaagaggatcacttgaaactttgatttattgttttttgataagttttcctctatagatggaatctgcataattttattcccccttcatatgccagcttgagaacaaaacactatagctaacatcaactgtgttatacttcagatatacagattcaagaatgatatgccagcactcattctgaaatttctagtcttggttttttttattgccatgattgacttgttacatgttatgtactttcgtctttcttgattgacttatgtatgaacttcaccttagatgctggagatgtttctccaatactactattgctgatcaatacggtcctataatatttatgatttgcggtttagtcgttgacaatcgttctgtattttaggttgatgctatgctccagaaattagaaaaggagattgatgacgtggatgcacaaatttgaaac

SEQ ID NO: 36382 - DNA, 487 bp, Oryza sativa
  unsure (1)..(487): unsure at all n locations
agagcttgtcagcaacctctctaaagacaaaggtcctccctgatgtttttatgttctgctgatgatagtgcatgcacaattgtttgtgctgtttcctaactggtcctctgtcttttttaatatgctacagatggaaagatccgtgtggaagacattgtgaagctggcatcacaaacagatgaaaacaatgaagatgaggaagaaggccgccagtagatggaaatgcgtctggaagctttttggcctgttgagattgataccgtatcatttcagtcgaggcgaaacctttctagtatctcagctacttcatggctgtgtcgtgtgtaaatcaaaagcgacgcggccattttttgtgcatctcttctctgagcagagtagcaaactttgatcagtggcccgtgatttgccagggnnnnnnnnnnnnnnnnnnnnnnnnnnnnnnnnnnnnnnnnnnnnnnnnnnnnnnnnnnnnnnnnnnnnnnnnnnn

SEQ ID NO: 36383 - DNA, 758 bp, Oryza sativa
gcccaggtagccctctgaatttctgcaataagtttattttgcttccctctgtgtcttctcatgatagaatcatctcccccaattttaaaaactggtgcaaatcaactccttcgagagtttagaaaactcctttgatagtttagaaagcagtttatgctgacatgacatgttaactgtgatactcgttgagtcagtaggtgagacccacatataagcgacctccaccacatcccatcttcttccttgtccctcttccattgatgagctgcaacgtggccagcgcctccaagtccatcctaaacctctcccgctcattgtagtacaccagccattgtggctgcccacctctaccccactcccacaaccctcgccgaatggcgaggaaggacaccgacgacagcgtgtccatagcgaactgagggccgactacaccccacccctgtcgtggtagcccattccttctcgttggacgttgagccacataacacccagcatctgcaccatcatggttggttggcctcgcagtaagtgtgggtactggggagaagaaaatgcatcctagggtttgcgtaatttgggtctcgagggtttggggttggggatggttgtgcttgcctcaagaaggatatataggttttggttgtcggtggtgggaggctgtcctcctagcctcgcgaatggcgaggttgcctaggatgttaagcaagatgttaatgcatagcctaggagtttgagcccgccggtggacaagcgaggat

SEQ ID NO: 36384 - DNA, 740 bp, Oryza sativa
  unsure (1)..(740): unsure at all n locations
nnnnnnnnnnnnnnnnnnnnnnnnnnnnnnnnnnnnnnnnnnnnnnnnnnnnnnnnnttgagcttccatgagctaattgcgtcaacagtctgttgagttctttgctctcaagaagagttactatacctctgtttcttgcacggaatgttaatggaagcgattttttactgtatgttgtgccaactccctcctcctactataaaaagacataccttagaattcgtggggctctcaacgactgtccgcttcatctataaaaaataccataaatagaaagaccacaaggcacatataaaatattaatcatgtttaattatctaacagcaatgaatatacgaattataaaaaaatttcatataagacggacagtcaaagttagagacgcataccaagggtttgcctttttataggacggagggagtatgtgtctgctgtttagttcctgtacactggcttccactgatcatggttatttatttttattggttccccattactgttgacagttgagctatctgaaaaagaaattgtttatactcctcccatctcaaaataaatatatttaatttaagatagaaggagtaattgtcaacataatcaatctaaaccgtttaatagatatattttatagtaccacctcaaatacttcaactaatgctaagagaaattttttctactaatatttaacctataaataaatggtgagataaattctatttctctactagggattatattgg

SEQ ID NO: 36385 - DNA, 996 bp, Oryza sativa
  unsure (1)..(996): unsure at all n locations
nnnnnnnnnnnnnnnnnnnnnnnnnnnnnnnnnnnnnnnnnnnnnnnnnnnnnnnntataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtatatatttaatactctaaattagtgtctaaagacagggacttaagttaagtccctggatgtaaacaccaccttagatcagtgtcgacgtgaggttcaaggttctgaagttctacgttttccctagagaagaaaactagtactccattggttatgaagcaattaatcgcagtgggctgcaattgtttcagactagactgcaacaattttctcttcgaaagaaggtgctttacaaagcaatccgtagaaagattcagctttggattgtaaatggttcgagatagctaaatttgcatggtcaggtgttaagacaaagctgaaaaaaggacgtattgtgtgcgtactgttttgtatatcatcactatgtgttaaaggaagtgacttttcaaaccaaaatagaagtgatcttctatagttgtattgacatatttcagtgtgacatcagttgtgctcatggctaaataaatcaattgtgctccatgaacaatttaaataacattttttttaagttaattagactgtttagaactttaacattgttgaggggaaaaaaacatttcaacttcaagataacctggcatgctatatgccacaccacacctacagttatctcggaaagataccatatcaacaggcgatatcacacataaatgagaaaataatattcgttccgtcctacgacgtttaaaattttctcaaaaatannnnnnnnnnnnnnnnnnnnnnnnnnnnnnnnnnnnnn

SEQ ID NO: 36386 - DNA, 454 bp, Oryza sativa
  unsure (1)..(454): unsure at all n locations
ctcggtacccttaattagccgcactgtatttaacataccattgcactaggacactaagtataatgcattagagttcatgcagtcttgtacctgcagctccaggcatatcaaatcaacagattttcatccagaggcagcagagcacagatacaagttctagttcaagtgttcaacggggcaccctccgtatctctcgtctgtagatgttcacagtcacagcgacatcaagctacaactgaacaagtggtcatattactaatcacaaagaatgctatggcctcaaagccatttgcatcaggaaaaaaaaaaacatcatctacggtcagataagccttcgtcctaacaagtaaccgtgacttctttatgttgctttgggcacctactnnnnnnnnnnnnnnnnnnnnnnnnnnnnnnnnnnnnnnnnnnnnnnnnnnnnnnnnnnnnnnnnnnnnnn

SEQ ID NO: 36387 - DNA, 645 bp, Oryza sativa
aaaaaaaagaggtcgagaaaagcgacagcattttagaattctcttgtttggatgaaaagagccgtgggataacggaagaaaatcgtcgtccacgctcatcatatttctatgacaaaactgagaatggacatattgcataaggagaatcatctgcttgacttcttcgctaaaaatacttttttttatgcatgtatcatggaatcataatattgtatggtgaataatcagcatcaagcttgctggttctgtagttaattttatttcatcagtatcttgtaaatgattggtacagccaacaactagaccgaaatatttttttctacaaattgtaaccttggatggaagtatccatcacatcaaatattattacgtatgcggcaagagtagattttaaactctcgaggggatgttcccccgttgtttgcatgtaacttaaaaataagttattaaaattaaaaaaagtaagaagatgtattaatatgtgatatatcactccacaaacatataaaataaaattcaatttctaaatgatgtaacaaaaaatatgactgtgaatatatgtttgtcgacgtttgatgtcgcgattccggtatttacatagtatggggatcgttagtactagaatatacgcgagactgaggtaaa

SEQ ID NO: 36388 - DNA, 468 bp, Oryza sativa
gtcatatgataagaagtaatgcctcaactttcttgaagccatcacaattgcataaatcaacttttccacttctgtgtaccttgtctttggcccttgtaaagcttctgatacgaagtaaactggcatctgcttgttttctttctcttgcactaagactgcgcttactgtcactggtgttgccgctacatacattagcaaaggttgacctttctgtggacttgctaaagttggcatattctgtaggtatgtcttcaaatcatcaaaagctttctgacactcggctgtccactcaaatgagtttgcccctcttagggttttgaaaaatggcaagcctttctctgcagatttagaaagaaatctgctcaaagaagccattctccctgttagcctttgcatttcccttgtgttttttggtggctgcatttggtgaatcgctgcgatcttgtcaggatttgcttctatgcctct

SEQ ID NO: 36389 - DNA, 1556 bp, Oryza sativa
ttgggctcggaaggcaagttggcaacgagtgaatactgaaacgaaacgaaacgaacagacagactgacgtcttacacaagcggcctcaccggctaataatatatccaagctttctttttccccgtgtcaagcttgattgatcgcacccctcgttttttttttcctcatcctcaacaaagaaaaacctactccctccgtccaaaaaaaaaaggcaaaccctgggtttccgtgtccaacttaccctgagtttctgtgtccaactttaactgtccgtcttatatgaagtttttttataattcgtattttcattgttgttagatgataaaatatgattaatattttatacgtgacttgtctttttaatttttttaataatttttttaaataagatggacgatcaaacgttgtacacggaaactgggtttgttttttttttttaggacggagggagtaagtgcagggaatagggacggtgggggtggtaggtgccctgtcaatcgtttccgtgattcgtgcttctataaccattggatcaaggggaacgcacatccgctagtgatgctagcgagatccgattgtttatctgtaaccccattttaaaccaagtctgtccacttccttgctgatgatgacatgctgatcggttcatctgtaaacgagtgtatctgtacgcatatacagtcgatattactgcttctgaactccgaagttctgctcgcacgcacctgtcaacgaaaagcttcgctgcttttttttctgggcgacgattttacgaggaatgattccagattccaggcgcagaggcttcggaaaaggctggtggatttcaggcgccgctcggcacggccgtgtcacgacgcgatccctcgcgcggcgagcacacgacacggagtcgccaacacatggcgaccccgctcgggctcggttgccatcatccccacaataattcacctccccccggccacatcgcgaccgccactagcccgccaataatagcagcgcgcccaaaggctaaaaaaaacccacgacgcgctggtcagtagccaccacacagcggcacaggcgctgcggcagcggcagctgagcgagtgagcgccgaggctccccggccatgtccaagcccgatcgccgctccggcgccgccacgtccccgtcgctccgcttcctcggcctcctcaagcagcccgacgacggcagcggcgaccacgagctggagctcgacgagcgcgacgtcgtctggtcgtcgtcgtcgtcgtcgaacacctcgccctcctcgtgggcctcctcaaccaattcctcgccgtccctcaccccgtccgcgtccgcgggcgtgggcgtccgccggccgctgtcgtcgtcccacgccttccccgccgccggcagcgtcggcctgtccgccctcctcgccgacgatcacgcccccacggcgtccatcccggccaaggcacgcccggagaggcagcagcccccccagccgtaccaccagtcggcgccggtcgccgtgccggcctggcccaaggccacggacagcgacaggcgtcgccgtggtgtgcagc

SEQ ID NO: 36390 - DNA, 790 bp, Oryza sativa
cataggccaattcgcataagcacaatcctattttcaaccagcgagagcaatcgatacccagagccccttgagccaaaatctgcaaatggcaccttggccaatacatttcaaattatcaaacatcacaaagtacaaaggtgatacagatccaaatgaatatttgagggtgtatgagacggcggtagaagcggccggaggagatgacacaacgaaagcaaaaatacttccaactatgctagaaggagtggcattgtcgtggtataccaccattccacctatgacaatctactcgtgggagcatatgagagatacttttcgagcaggtttcattggtgtatatgaagagccaaaagaagcagataacctatacgccatgaagcagatgccgggagaaaccttgagaagttttatggtaaaattttcaagaataaggtgtcagatcaggcaggtagatgaagaaatgctcatagcatcagcaaaaagagctttgttgcctggccctctccgtttcgatcttgcaaggaataggccaaagacagcaaaggacctatttgaaagaatggaaagttttgcaagaggagaagaagatgagctaagagtgcaagcagaagaggctgcattgttgggaaagaagcagacgaagaacaagcaagtttctttaggggaagaacaaaaagcagaaaacactgcaaaaccatggaaaaaaaattcaagaacgattacaagcaagatcagaaaaaacaagtaaacttcattggagatgactcaaataatggagaaggaaaaggga

SEQ ID NO: 36391 - DNA, 542 bp, Oryza sativa
  unsure (1)..(542): unsure at all n locations
nnnnnnnnnnnnnnnnnnnnnnnnnnnnnnnnnnnccttcgtatttctaccaccattctcatcccttcttctcttgttacacattttagcaaaggggcagtgactccgctcttgtacagctgcccttctatcaccttgtacttccttgacattaactgtattcttcttgcttcttcttccttttctggaagttgttcactaaccagatacttcagaattggctctctccaatctatctcgccttgtatgtttgccacttctcttttctcataacttggttgaattaacacatcaaagaatgaattctccaatggttggcttgtggcagctgcttttgcaagctcatcggcttccccattttattctcttgttatagcttttactgtatcccaaggaagtgtttttcattcagccttgcttcttccaagtactttgtcattgctcttcttttgcttcaaatgtcttggaaaagtgacctgccaccagctttgaatcgttttgattatcaatcgtcgagcccctagtgctcttgcctttctcat

SEQ ID NO: 36392 - DNA, 420 bp, Oryza sativa
  unsure (1)..(420): unsure at all n locations
catgcaacgcctccagctcaagtgaagaagcggtagctcttgccgtcctgcctcccggcgcgcccttccttggtgcgcttgtagtacttgtggacgttctcaaacttctccttgcacttcttggcgcttctcttgtagcccaactccgcgagcttcctgaaagacacgagagcgacaaaagacccaagctttgctgtcagccgccggccgcttcacacttgcgtgcaaccaaagattgaaataacatcggggattaaatgatggcagcgcttactacgggcaggagaagcatctaacgcagaggcatagtaagcatcaagtgcttggccgactgcgtatgagtggtttttctcccggggagaaagnnnnnnnnnnnnnnnnnnnnnnnnnnnnnnnnnnnnnnnnnnnnnnnnnnnnnnn

SEQ ID NO: 36393 - DNA, 1470 bp, Oryza sativa
gtttgtgaaggcagctcatgactagaaatattggcagatgaactttcagaattttgcatagacatgtttaataaacctgtgtttgacaagaatagaaaattaatatctacatttgctacttgtgcagaattaatatttacatttactacttgtgctaaaaactagtgaaatgataagcatacccaacagcaacctgttatacaccgtaatcatgcatctagcatttgggggctggacatgtttcttttcaaagaaccgtgcataaatattcttgtgcacttttttttcaccttttgaaactccactaataacataatgaatatcaaatcacatctttgaacaagaaagacaggcctcatgtcatgtcaacacataaaatagttagctacttaatactacagtgaaagacagccacctaaatcaacagattagtagttatatggaactgaatgaactgacattcaaaatgttttatcctttgaccaacagcttaaaagtttaagtgctggattttctagatgcgctcaacagtcaccattaagcagcaaaaaagctgcatgcttaataaacatgacttagaggttgggacttgggaaagggtgcaattgcactgatatattataaacaaccatctgacagaattaattgcgaataacagaacattgctagcaatcaatttgtgtaattccaatttgttcaaatctccaacatctttttttttctttttcagtagcattgcagtataccagagatctagatgacttctcaaggttagatgagacattggtactgctaatttggcaatagcttcataagtctttacctttcaagagttaagacctaattattgtgactaatcctgatgtctgatggcacacatactacaatccagcagagtatgtatcacatgagacaactaagatgggacaccagctgcggcattaaacccaacagaaacccaccactcttcagcatctccaatcgaaccaacccacattatctaaaaatcgaaacaaagaaaaagcacaaaaatagccaaggtaccataccaggatgctcccaagaaccacttccaagaacagtccccctagctcaccgagatccaagatggaggtcacgcaaccgcagatctgccacctccctgcccacagcaagaacatatatcagcggagctcgaccaagcagagagagaacgccacttcaagaaacatgaaagatgagtcaccttcttgagtgagtccggcgactgtggcggcgaacggcggtgacggcgctcggcggtggcagcgaacggcggtgacggcacgcggcggtgacggcgcgcggttgtggcggcggcggcggcagtgcgcggcggcgcaccgcacacaggcgcgtgcggggagtgtagggtttggagtggagtggggatagttcgtttgttttggaggctaacccatgggctgaatccatggatagtcttcacaggcc

SEQ ID NO: 36394 - DNA, 4842 bp, Oryza sativa
ctagaactgactaacacttgactcacggagaactcggtattcgcggtatttccgattggcactttggcaggcatggttaaaacagtgatagttatagtccttttgaaaacgatacatcgacacgatcgaaatattccaagttaacaaataataattccgaattcacaaataataattccgaatccacaaataatgattccgaatcttgacagcaagcaccaatcgttctctttgcttttgggagagacaagacccggggggtaattaattaagacagacggttagggttcaccttcaccaaaaagtaagaatacatccagccagtatcatcttgatatcatttcaacaattgcataaagcagtattcatctagtatttaatattataagtcttttgattttttcctcaaactttttttatcaagtttgtagagaaaacatagtagtactttcaacacaaaataaacatattattagaatataactaatttgatgttttggatattgtttattttttctataaacaatatccaaagcaccaaattggaaaatgttagaatagatgtcgaatatactagtcctatttggttacggttggacttggagttgtaataggtgttagggggtggagttagagtcggagtctgtaacccggcatctctcttaaatagaaaggggggcaccacaatgtaaccatggcgactacaatgtagcgtagacacgcagggagatgatggcggcatggccatggactcgtagcggctaaaagctatattggttggggaggagcgcccataatcagagccccggggatgtaggcttcgggtgaacctcgttaacaaatatcgtgtgttcctgtgtcgtcatctggcatgtcttgggtgatcaatgattgaagcgatcgagaaggttagtcgtcgttccgctatatcggctaacttttataacagaaaaaagagtcgaaacgactcataatatgaaatagaggatgtaggtttttggtggttgaaaaataccgcgaaaaggcactgaatgcaaaaccagagtttattgcataatactacctccatcataaaaaaaaagaagcatcttaatttcagtactactagctccatcccaaaatatatctaattctcagtacaatatgtggtattatctaacactgtgaatctggataagccggttttaagtaatatcacatcatgtatgagacacttacattttgaaatagagaaagtaattccgagataaattagtggcatgtacagattcgtgctgctaggcaatatcgtatcatattctatattttggaaagacaaataattgcgagataaattagtagtagtgtgtagagatggcaacggggaattccctgtcggaggttactccaccatacccgcctccgcggtggagaattttccccatcaccatcaccgtgaaatgcaacggggcaacatctttccccatcaccgcctctgtgcgggtaatttatccccgtggagcctccatccccgctatcaacttactcaacagtcaacatgtatgcatttctcatatcaaacaataatttacatacaaaagattaacactcaaaatagcaattctagccatcaatttcagcacatcaacaacaactacaagaacacaagttcacaaattcagatcacaaattcgcaaatgcacatcatcagttcacaaatgcacatcatcaattcatcacttacaacagcagtgcagcaacaagtagtgcaacaaaagtgtgcccaagaatacaatatccatcatattcccagattaagcaacaacacaataatacatgatcattcatcattcatcagtcatcactcattagttatcaccacattgcagtagcaacacatgttgtcctaggcatacacaaaaccatagttcggagtaggtcttttgtgccaaatatccaaaagcattgccatggttttacaagtttatcatgacacataacaggggttacaaacatccaaaatcattgcaagaacagtgcatgtccatacattcatgtcttcaaacaagagcaagtccctaaattaaagaagtagcaaaagatattcaattagtcaagtattttataaggatataacaaataatggcagtaggagtttgattgctaattttaagttgttgaaagaatacctcaatctgatcttggatatcttgaaggcaactccaaaagcttgctgcttcttcattatcagctacaagataacaattataagaattattttgcatccattgcattgtaaaatctatgctaagcatgatgtatgaataaaacagcatatgtacctcgatacttgtttcgcagccaatcttgtgagcacattaaggcctccaagagttctggagtaagccggctacgatgctcactaagaacccttccacttgtgctaaatgcatattcagatgcaacagtgctaacaggaatagcaaatatatctcgtgctaccttcctcaatgtaggaaagcttgtcctagccactttccaccaatcaagaatcttaaagttttctgtattaattgaaaccaactcatcctctaggtacctgtctagcatgcgatggctggtccaacaccgcattggcgtcccttattgtggaccgccgaacgtgagttagtgactcaacgagacaacgatgcagccatggaagaggaatttagtggagggggagggggatatggtactgtagttaggcatctagggaggggtactaagttgggagtaggacagctagatgtgctcaccttgcatcgtcgtcggagcttagcggtggtgaaggcgaagccatggcggactcgagcggctggtcgtcgtgtggactcgtcgttttcccctttcttgccaccgaagccttcacctgcatccaccatcagcaaaacaaataagcctacatgatggatcagatattgacggagggtggaggaggaggccgacgtccggtggccggtgccgagtccacgacgtcctcggacctgggaggctgggactgggagtgaagggaacgggacggcgcggcgtggcgctgggacctggccacggggctcgggagctgggagctgggccacctgggaccgggcagctcggcgctggcgcggacgccgacacggcgggtgcggcggccctgcgcgcgggcgcgagatcgggagccagcgctactcagccgctgtggccgacggacgacggcgtggcgcgtggcggcgtggggattgggacgagcggggcggacggtggcgtgtggactggggaatggggacggaggggataaggattggaatggttagggttacacaattgctttatatactctatgctttgggctggtttttatgggccaaatacacaggatattactacacacatacttttatatcgggcctccacggagggcggggacggggacggtgaaccaaacccgccctcgccagacccgacggagactactttctctccattttattccccatggagacacaattgataccatcaccatcacctaatgggagaattctccacgggggaccggggaccgggtacccattgccatctctagtagtgtggagaaatgatcatattgtgcctcattaatactcttggttgtactatttccataggttttgatttaatgcaaactagctgggtagcccgtgcaattgcgcggctagcacccatacaaaattatctatttttaatatgatttattcaaaatttgttaaatagctatctcattgtcttaagactttgaaagaccaaaccttatcattctcgtgtttctaattatatagtttttaaaagtcacaccaattactaccccttatgtcatctccttctttatttgcttgctcgatctaccactatttctattcatacttcttggaacctttaaaaaatggattttatagtttttagagtttattgtcacgttgggttttatttttataatttctagatgtctcgtcaaacgttgccattatactcctctacggcccatcaactatctcatctctttattgtcattgagattttaaaaatcgaacataattatcgttttggttcatttttactttctagaagtcccaccaaaccgtcagcggctttgccattgtactcctctacggctcgcccgctgcctcccttctttattgtcattgagattttagaaccgaacatgattagcattgtttttttttactttttagaagtttcgaacctttaaaaattggacttgtagtttcattttttataattttgagaagtcccatcaaacgatgccactatgcccctctacaacccgtccgccgcctactctttattgtcctcgtgattctaaaaatcgaacataactatcgttggaattcattttttattttctagaagtcccgtcgacggctctgcaactatactcttatacaccccacctgctgcttctcctttttattgtcattgagattttaaaaatcgaatatgattatcaatggggtttgttttttttacttactataagtcctggcaaccgccttactcatttgcttcgcggcctgcttgacgtccctccttcacggcaattgtgttttattaacaatttttatatgtcgtatcaatcgccaccactctactcttttataggcatgttacttaacttatctcgtcatgtgttttagatggtcttttctttcaataatctttatttttatcaaaaaattgagttacttataaattgtattcctaattgaaatcttatttttctttttctaatttcagaaattttttaaaaaaattagttaataccgtattgtgttcttttaatgtttt

SEQ ID NO: 36395 - DNA, 2590 bp, Oryza sativa
tgtattcctaattgaaatcttatttttctttttctaatttcagaatttattttttaaaaaaattagttaataccgtgttatgttcttttaatgtttttattttttattttcaatttcagttgtttcaacattgtattcctacttgaactctcttttaatttttctaattttggatattattttattttttattcaaaattttaattaatctcgtattgggttcttatatggattcttctttcaatattgcttatttttaattcagaatttaagctaattttaaattgtattcctacttgaactcttcttttattttcttttgctaattttggatttatttttatttttattctaaattttaattaatctcgtattgggtttttatatggactcttcttttaatattccttatttttaattccgaattccagctatttttaaattgtatttctacttggactctcctttccttttataattttgtattttattttacttttatttcgaattttgattaatctcgtattgggttcttatatggaaacttctttcaatattactttttttaattccaaatttcagctatttttaaattatattcctacttggactctcctttccttttctaattttgtattttattttacttttatttcgaattttgattaatctcgtattgggttcttatatagaaacttctttcaatattactttttttaattctgaatttcagctatttttaaattgtattcctaccttgactctcctttcctttttctaattttagattgtattttatttttattttgaattttggttaatctcgtattgggttcttatatggaaacttctttcaatattgcttatttttaattccgaatttcagctatttttagattatacttctacttagactctccttttctttttttttctttttctccgattaatgtgggaatttttagcccccacagcgaacgtggtacctcattttcaagctgtcttaataatataatagatagatgctgcagctttgctgtaacctctagaattgtgttttttttttgaataaattttaaacgtcgtaggacggaacgaatattattttctcatttatgtgtgatatcgcctgttgatatggtatctttccgagataactgtaggtgtggtgtggcatatagcatgccaggttatcttgaagttgaaatgtttttttcccctcaacaatgttaaagttctaaacagtctaattaacttaaaaaaaatgttatttaaattgttcatggagcacaattgatttatttagccatgagcacaactgatgtcacactgaaatatgtcaatacaactatagaagatcacttctattttggtttgaaaagtcacttcctttaacacatagtgatgatatacaaaacagtacgcacacaatacgtccttttttcagccaagcttgcatgcctgcaggtgcgactctagctatccccaccatttacaatccaaagctgaatctttctacggattgctttgtaaagcaccttctttcgaagagaaaattgttgcagtctagtctgaaacaattgcagcccactgcgattaattgcttcataaccaatggagtactagttttcttctctagggaaaacgtagaacttcagaaccttgaacctcacgtcgacactgatctaaggtggtgtttacatccagggacttaacttaagtccctgtctttagacactaatttagagtattaaatatatactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgataggaacttaaaagttttagtcccatctaaacagggcctaatactaacaaattttttaagataatggaataaaatttcagcctatgcttaactagccatagcccaaaatactaacaaatagtactagccatcgaaacattaccccctacaatcccgagcttagcaagaaatccccaaccttttttcatacggatcatcagtaatccagtacaacacgaagcaggttgctgatgtgtggcggcagcgagagaaacctccaaaggttcatatcctttttcacaggtcgaggaagccggtggtgcgccacaccgcgttgcgcacgcgccggaggtcgcgccctttcagcgtccgcccggcgcccttcatcaccgacgccgccgccgcggggcggcgcgcggccatctcgtgcggcggcaccacgagctcgtcgtcatcgtcctcctcgtcgtgagggcctcgtgctgcacaccacggcgacgcctgtcgctgtccgtggccttgggccaggccggcacggggaccggcgccgactggtggtacggctgcgggggctgctgcctcttcgggcgtgccttgggccggatggacgccctgggggcgtgatc

SEQ ID NO: 36396 - DNA, 8804 bp, Oryza sativa
cccagtttccgtgtacaacgtttgatcgtccatcttatttaaaaaaattattaaaaaaattaaaatttcaagtcacgtataaaatattaatcatattttatcatctaacaacaatgaaaatacgaattataaaaaaacttcatataagacggacagttaaagttggacacagaaactcagggtaagttggacacggaaacccagggtttgccttttttttttggacggagggagtaggtttttctttgttgaggatgaggaaaaaaaaaacgaggggtgcgatcaatcaagcttgacacggggaaaaagaaagcttggatatattattagccggtgaggccgcttgtgtaagacgtcagtctgtctgttcgtttcgtttcgttttcagtattcactcgttgccaacttgccttccgagcccaaattagctgaatctgctgcttatttcttggacgtgcagagaccttcgaggtttatgcaggctcagacctctcgagatttcacagttttttcaagtgcacgtgtggcagaaggatggaagccttggagaatgctgcttgggaggtaaaggcgcttatcattttggttttgcaaagatggggattggtgaacactgaacagaacgacaaagactggcaaggttatttgtttgaccacctctttaagactttaaccatcgggaagaaaattacgtactaactttctgtattgttggcaaaacaaaaggacctgtcaggctcttacagaaaaataacagttctgtgatcggcataactcacagggcactacgcaagtatctgcaaggaaccaaactatgaacgtaccaccgaggcatctcatatactctccactagtaggactagtaaaactgaagataagagtagtacactatcggcagaactaccaatgtacagcaatgataaatgaaggggccaaatgaaatgagaattgagaagatacccaatacacttccagatcgggcaaggcattagcaatttcaatcaagtaagaatttacattctaatgatgttgtggtcccatagaagatcccaaggggcaagggcattgcactagcattgttagctgttacacttacatctcatgagttctgacatcagttcacgaaacaccagaattgtgcataaaatagcttctatcaactaatctcagaacaataccatcaaaataagttggaaggagaaacgacagaaacacacaacctgtagaaataggttcaggtggtggaagtatcatgagatcgccatctttcttgcttaaaattccgatcacgctcaatcgcataccttcagcgatatacctacaggttttgcattcacattttaagtttccaaagatgcaatatgcaaagatgctggcaaaatgtatatctattatcgagcaatttgattacccttcttcgagacggataagctgacattcttcagaaggaatatttctttcatccagccaacacctcaaggttgaagataactcagtgttcccgcttgtcgtaaccagaagattttcatcgatcaagggaactactctcgagtcgtgcccagctttcaccaaggctcttttacctgattttgcatccgttatgtagaaatcagcagcaaacctctgcccaactccacaaaatatttgaataagacaaacatcacactatctatggcatcttactgcctttataatgaactcaattttacagcaacagatacaatgacattagagaaattaaaagactactaaataaacaactcagacataacgcagatgagcaacagttttaaaattgtgaaaaatgggtaatgtctactcgttgatctacttatgaaatgtattgttttttttgttccattgtactatgcagtcaagatctctcgaactttacatacaactgagaaacggtattatgaatttccaatttatcaccaatattgcacaagtggaactggaactgaaacaataggttattactaattgtgtacaataataatgcaagctagtttatgaaatagtaatgcttttgtaatcatcataaaaaacaaacacactagtattacagttggattgaattgggctagcttgagtcatgataaacaaaaaggtgaaacaataattaaaaaaacaaaattttaatgacataaggtgcaagataaatgaaaatacccatgtgttctgtagactccaccacacatacactagaagcccttgagatagcaacaaagcatccttacctcagcgtgtgtcaatttccacttggaacagcggttcttaggattagctacttcagaaccccatcttccacattttcgcaataatgtagatgtatatacacaattctctactttctcgtatgaagaaatcagtgaaatatcaccgcacgcaacaagctgcataaaacaaggggcatcaccacacatgcaagaataacacattatctgattttttttaaacaatgcaagaataacatgctgaaaactgaacacaactaaaaagaatattttttgtaacaagagtagaacataatgaaaaacaataaatgtactgtaataggaaaatgtggaaaaaaacacaaatcaatgcatcacagcatacactccctaaggtaaaaggcacaaaatttccccttcagactagaagatacattcaatgtactaccagtacaaagttgagaaaggaaacaaagaaactgcccttgactggttcgatatggccagtgaacctactgcatacaaatctggacattgctgtgcttgctccccattgcacgattatggaatccataatttggcgcatcctatttacactgaactacgtgaccaccaaaaaacgaagaacactcaaggtgcaaacaaaccccactatgaaacaatgcaagtgtatccggtccacaattccacaagttacatgaaagcactatatgatgtagaattacggcaccaaatgcattattctccatgcatctagtggctccaccaaaatgctccttatcaattcagcaattcagaattcagagacttaaagacggaataaaatagacttattggatcaatagcagcacattcatggcaaaagaaagataatgcttttgcaaatgggcaaacatacaccggtgatcttgacgagctggtcgtcggtggcggagcggaggctggacgcgggcagcccgtccacgaaccgccgcagggcgcgccccgacgcggaagccgcggcattccacaggaggaacgcgacgacggccgcggagaggagcacggccaccacgagcagtgcggcgctgtgcacgacggcgaggacgagcgcgccgaggccgagccccaccgcgagcagcgccgcgaccgcccaaaccgccgccctcgggaacggcgccagcgcggggagcccccccgcatccccggcggtggcgcataggtcgttcagcgaggccgcggtcgcggcggcctcctcgtcggcggtggcgccgcggtgcttgccgccgtcctcgcctcccggaagcataatcagctcgcgccgctgctggggtgggcgtctcggggtcggggggtttcagtttactcctctttcttttttcctttttttcttctattggacctttttgtcctcaactcggtatggtgggtttggtttttggcgtgcggtttaaggaaaccaacgtggagcgcatcggcaactctactttagcgtgacatgtgggaccataacaaatctggcccgcatgtcagtgacacagacaaggctgtggggggtgagctgtggagtacacggcgtagttatcctcctctcgcttttggagcaaaaaggagtactagcaatatgacatgtggggcccgggcaacctgtaccgatgtcagcgagagcccgtggtgcgatgcctcgtgcgtcggagaacgtggaccacgggatcagggcattgcgtgctcacatgagctgctcctcatcactgggttgtgagtgactgacactgaagcggttggcgttgtactcgcacaatttgtgtccctggctagtggggcccggttcatgtgcttaccgatcatgtgtacttgatctagtactagtactcctagtaccgagtgatctgtactagtactatgcacaagtatggttgggggcaaatggtatagtagtacaggaggagctaagcagaagaattaagaaactgacacagccttaacctacgttttgggtggattagttaacagtaatctcatgacctcatccgacgagcggttttgagccgttgcgagaagaggaagcaaacagtcacatgcctaatcttttcgatactctcaagtttgaatcgccacttgccccgagactgacggtggtgcagactgcagcgacctgctctgcatcacaccactcgtatacatggaggcgctactgcgctagtggtgctagctagcgctgcgctgggccccctggatccgatctgcaatctgatccattcaattgtactcgccgtactctccctctcggtcaatgctactgtagtatcgtactcttgtggccagccgctggcgtccgtggtactgtacctcgactggttgacggaagcggcgtgatgccgtgcgtagaccaacgcgccatgtttcactgtgctctccgtatactgttcacaatgccccacgcagaaagccacacccgtgaccgctccgggtgcgtccggtggtccggcggaatttcgaggggaaaccgagccgagcgctgcgccgtgccggcgtacatgcgtgtcggcgagcgggggcacgcgaggcccagcaacgggtagtggcgagatgggcctcccactcggccgctcctcgaacggccaatactgggctagagaaaggctcatctgtaacagcccacacacggaccactcaccctagccgagttaattagaggaataagttcactctgactcccttacaggatttgagatccgtgagtattcactcgagtcccgctcagtgagagattgaaaggttctgtacatctctttagcttacgttggcgacaagtaagccagccgggagggcttagtacgtgatgtcaatgatttcatgcttacttgtaactgcagactgctcatctttagttccttcccaattgctatatacaatatgctctggtcaatcgaccggtactagataatgacttgctcctacaaagtttacacacaccacccccacctcaagagaaagcaaaggctttgcccggtcctcagtatcctcgcgcctacgctggcagagaattgacacttaccaaccaacctcgtcttttcggccacgcgcggacaccttatcacattaacaacaacgggatcgatcgatcgcgccgatctttagctaggtggccaccgccgcattgccggcgatcgataagatggccagatgggaggatggaagagacggcgccacacgacgtcgcgctcctcctcgtactcgcgctacgcgctgtcccgtctcgtcgcggcagctagcgcatcgtctcgccacgccacgcacaccggtatacccgatcggtgtggatggagctagagtaccaattaccaaagctctttcgtttggtccctgtcacgtactgcagttgcagggccagctcatgcatgtgcacgcttcgcgcccctagccagggtagctgctatctgcaactctctctccgctaaagcggcacactgctgatcgattgtaatttgatggtgattgctgaagctttttgccacaggcaaggaccaggcactgtgcaagctggatatacaagattctttacttcgcgcgaacgcaagtttgccatagcaaagctttcagtggcattaagctgaaggtcgctaagacggccggggacaatgcaaagaagtatgagtgcgattgcgaaagcaaacggtatgttacacgcggcatatgcaaccggctcgggtcaatggggaaaaaaacgatgatccatgagtccagttacgcactgtgtgatcagatacagacatggaccataaagcagtgcaatgatcgaatcgttagccacattatccttgcaaagtggtgtttgggcggttaacccaacggaaggtcgcccagctctttctctgtttttttgagagattgggaggcccagcttttcgttgcgcctttccggtgtttctagaagatttcacacggcctgaagctggagctccaagacaccgttggttttaaattggggttttaatcagctcccaaagtcgcagctttagccgtgttggactccttttgatctccttcttttgagcaggtcgccatcaggtgtaaaaagcacttttttgggtgaaatcggagatcagagatcaaaggataaagttgcccccccaatagcataaaaaatcggtctgttggtttgtcaattgtcaagctcgaattggtgtacaaaaaattctgaactagtcgttctctgtcgatcaaaacagtgctaaacaaatgtgtgcaacctctctttcacgtacattgccgtataatatttccgaaacggtgtacagatatacaagtggaataattttaaattccaaagagcttttgattggggataaccagttcgtcatggtttgtctgaagatctctctgataactaacgatttgattggataccttagtttttccacgtagtcgtagaagcagtggtttagacgtcatatgtattgagattcttctctaacaggtccaataccaaagcaaataagcaatgcccaccaatgattatttagaaaactggagtataacaatgaccttgcctgttgctttgactataatgatcatttctaataatgatcctttcaattctcctactaacctacgcatttaaagaaactaatctgtatcgcaccaaacagttaactaaccataagtgatcatcaattctctgagtctctgacccatcattggtcacgcatgttgaatgcgtgaatggagaacagcaatccagacagggaaaaagaataaaacaaaccaattaagcaccaacatataggccctgactagtcccaatatcaaattaatttccaacataaaccagcaggacttgtccaattcagagctagtcaggtttcttcataaataagcatacatccagccatatgatctgcacaagcccgtatttaccaatttaaagaaaaggcaagttcctttatccaaaaataaacaaaccactactgccaaaaatacttgtgctatcctacgcgtccacgagataaactccattttagaattctcaggaatatctgtccggcaaaaatcgttttacgtttcaatcatgacacagtacgggaggactggaggacccgtttcggccacacattcgagccaccgggccacggctcgagaactttctcctcgctgcctcactctcctgaattcctgatccgtgacgtgcaggcaggcaggtccagaagtactcatactgctgctgctagctatcgatcgatcgatcgatggatgtatccatccctttgggatttctcactcttttatttttcatgcattgtgcctgcacagtagcggccaattcgcaaagcggcaaagggggacaaaaaagtcgacattgccaagcagtcgaatgtttgctaggctccaaagcgaaaagccctggcacgtattcatctcctgttgatagtatagcaacgagacgacaacgacctgccgactactgggtgtagaacaacggcgtcctcttttccttgacgtgtagtgtcgtctcatcgcaagcgttccggacagatcacgcgctgtattatcaaccgtggactgaatgcaaacccagggaggatttgtttttcattcgctgagaactctgggtcagtttgttaaattttggcagggtagaaatgagaagatatttgattggtgttagaattataatggtaagagaaagtcctcgagtcttatcggctatcaccataagttgatgtatattattagtcggtccgggtttgagaatcattcattgcttaatactattgatatgatagtctctccattcatatcttcctttttgaaaacgtgctagtaaaagatcaatatatttgcaatgcctaaactttagcggagtaaattttccatgtaacgttttgggtttgctatcatacaaaaattgttgctttagccctactatcagaacatcgaagttttagctagggagcactataaatagataccatcttttttaaatagtaagcagtctctgactttgcataccagaaatgagaaccaaagttgtactaaaattatactgttctttttttatttgttccatcattatacatccttttattcaataaaaaaactactgcatgtgtgccgaatggcaaagccgaggatataaatcatttccatttatctaagtgagaattatgtgtttggtactccacaagaattttaaaatgtgttttaaactacatgtttggatataataatttctattgtctgagtgggaatgcataatagttgtaaaatgtgtttggttctccacaagcgtttctatatatgtattcattcactcatgtgagtgagaataatggctgcatgctactccctccgtttcacaatataagtcattctagcatttcccatattcatattgatgctaatgaatctagatagatatatatgtttagattcattagcatcaatataaatatggtaaatgctagaatgacttatattgtgaaacggagtaagtaagtagcactgaaaaactgtgagatatatcgaattaccacttgtgatcctatatatgccttgggctgagtcaatgcctatctaaaaatgacggggaacattttggaactctcc

SEQ ID NO: 36397 - DNA, 6533 bp, Oryza sativa
gctacaaattccaaaattaattaaaaatttccatatctatatctatatctatactattataaaaattgaagatgtttttgctggtattttggtacgtcgtccgtgtttaagtcagtttttaagattgttcgtttttggaaatacatatccgtgtttgagttggatttcaagctcatttgcttttggaaatagaaaatgagttgtataagaaatctctttttagaaaactccgcatgctaacttgagatgaaagtctgactcctagctgtagctcatgattttctaaaaaaaaatcccaagcgatatcccacagtaaattttaccataactaaatcatataacaataataagattaaatagcattcacccgttgcaacgcacgggtatttttctagttattttttaaaaaagggaaaatactattcatccaaatctattcaactggtataacaatattaggataagatgaatctctatcatttggtgtattgtatggatacccttaaaaaaatatataggtctaatatatagagggtttacactaccaactcaagctgatcgattttcatgaaattttgtgattttgaggtggctcaaaatgatattttgagggagatttgaatggtttttcagaaattcaaatttgaaattgtaaatcgaatagaaatttgatcaaaattggatgaaaattaccggttgtagacatgttgttagggatcaaaatccaatccccatggttttgtgaaccctactaatatgactaagaactatcatgcattctccactaactgcatattttcttagataacaaaaggctcaatagcaaatagcacctccgtatcaagagatgcacacaagaacataaccaacaattaatctaaattacaaaagggactttaaggcgagaaaattagcccgcttgaatgcaacacactagagtacaaaatctaaaacttcattgttttaaattaacatgcttgcaaaaggtaaataccatgattactcaacctggaaatcttatatacgttcaagagagcgatcgatcaaatgtgaatttgatgtgcttgcgacccattgacagtgagcagtaaaaaattcttggccatgcatatctcagactctcagtagtgttcctcgtcgagccacctcaaacctaagaaagatttctttcagttgctcatttcaaacgattcaacacttcagttatgaagaaccatgggttgccctaaaaagaataagccaatgccaaaattttaaatttaaaaacttaattttgagtttattttaaaatattttcaacatattttctttttcagcattgggttttcagtcactaagaatatgtctataaaaattttacaaataaattaaaccgatgaggcctggacaatatatgacagagtcaaaaggagcatcgctaaatcaagaggtcactagatcgggacatggaggtgtgaggagacttagtgaattagagttaaataaggagcaaaagagactaaggctgtgtttgagggagagggaattgagaagattggaaagatacgcaaaacgaggtgagccattagcgcatgattaattgagtattaactattttaaacttcaaaaatgtattaatatgattttttaaagcaactttcatatagaaaatttttgcaaaaaacgcaccgtttaatagtttgggaagcgtgtgcgcggaaaacgaaacaaacaatttccctatgttctccaaacgaacgcagcctaaggttatctataattttccttacaactttcatcaaaatccgtgtttggggtctaccaatcacactgaaactatggagtatatatacctaaataaactaagaaatgatcaaagttagcttggagaatcctacaaaatccttattatgttgacttcttacatgctactccctcatttccataatataagacacaactacattttctggacgttccataatataaggcatgcatgcatgcatacaattaattaggacctcttctccattaaattattacttttttaaatcttccatcctcaagatctcttattctattggatgcatgcattatatttattagggtgatacaaactatgagatgataataattgtttcttggtctttgggttaaatgtggttgtgccttatattttggaacggagtgaatatcatcttagtatatgcatgtgtacttatgtgtagatataaaactagtttaataatatcgtcaattgaacatctttcgaatagattactactaaatccgaattcgaagtgaccacaaaagatgcttgaattcctatgcaactcttccaatgagctcgatctagttttctccattttagcaccatccaaaacacaaagtccattggcttaattgcttccaaggtttccaccaccactactccaacgagattcctcttgcaaccccaatctacaaaccggccccacacgtcattgccacggccctcttttccctctctgtccaagggagacggcagatcagtcgaggagacgtgatccacgtactttaagctacatgtacacacaaattaacctagggtaatatactactctctgtctttcaagccaccgcattccactcgacgagcggccatggctcccacagctccggcgtggcgcagaaggactccgggaacaagccctcatcgtagtcaagctggtcgtcgcactgatccgactccaccgacacgtccgccggcgtggcgcacgtcgcgccgccgagcacgcagctctccggcggctcgaggtccaggcaccccgcggcggcgttcctcttgtcgtcgtcgtcgtcgacctcctcgctgcctgatccgttgcagctgctgctgcttgctgccgtcgtggcggcaccaccgttgccgctcctctcctcccgttccctcagcctctctcttagctcgtgcaactgcatattacatgcaaagagcaatcaagttagcgtttgaattaattatggaacacatgatctgcatgttcctacgattagtagctaagctagcttgcttaattcatcgttaattacctggacggtgagagcgagcttctcttgcttgagggactcgacgcgggagtggagggcgtcgtacttggagcggagtgcggcgtagtcgtgctcgagctgcttggagcgccaccgcgcgcgcttgttctggaaccagatggccacctgccgcgactgcaggcccagctcgcgcgccagctccgccttctcgcggggctccagcttggcgtggtgcgcgtggaacatggactccagcgaccgtatctgctcctccgtgaaccgccgcttcctctccccggccccgccccctcccggcgccgccgcctgccccgccaccgcccaggtccatgtactgctcgtccgccatcatcgccggcatgcacagctgcggcggcaccaccggcgcaggcggtggcatcaagaactggtgctgctgctggaggtggtggtggtcaccccgatccatggcgatcctagcccagctagctagctgtgttcgaccattcatccctctcccggctcccggcccggtcggccccttttataccggtgcgaggagtgacgtgtccacgtccggtccgggggagatgcgaacatgtggtctttgcgattgcgggtaaagaaaaccgccggggccccacgcaccgtgacaccgagcaaagctgcttttgtttcccgccaagtgtcacgaatccgcccgcgccaaaagctgtgcccctgcccccgatggttatccggccgcctcgggatcgccacttgacacgtggcgccggtgacgagcacgagtgcgagatattcttctctccttctcccgtaccggttccttgttggcctactgctaatcgttggctgctgtacaacacctccggatttctttttcgtttatttctctccctctttggcctctttcgatcgatcgccacctcgtgcaggaaattggtaccactgctgctaaggtgtacatgcagtagtcgttcactcgttcgtacgaagaaccggatgatggcgtgcgtgcatgcgccaatgggtggcggaaaggtgggtgcgccggagagagacggagacgcgcgcaattggaacaggtaggccaatggccgaggagagcgcggcgcacgcggtcgcggtcgcggtcgcggcgccaagtgtacggggggcttcgcccgaaaggctcgtcgaggtggcgcgccgcgtttgtcccgttgcgcgcgggcgccccgggctgcgcgcgcctgcgctacgtcgtaccagtgtgtagagctagccagcgcgcggtgccgggtcttttcggcttgatgtgtgatggcccgctgcttgttcacgtaccaacgagacagtggtgggggtaacaagattagagacagataattagatacggctaggtgataaccacttcgatatgaatgatcaactggatcgatctgattagtgcgcagggcttatctcgatggatcattatcgtcgatctctgtaccgggtgaattttctcctactcgatatcggcgaggaagagaagaaaagcggttcgtacgttgttcccaatctcttgtccggtcacgtgttggagtcgatcaggtaagttaaaagcggtggtgatccaatgtgttggatcaccttttacttggattgttcaattcgatcgaggggataatcacgccgcaatcgcggtagcgaacgagttaacttaaaggcgccgcgatcatctattatatactaaaactccataaaactttctacaaacgctctcaaaccgccacgtggcgctctaataaaatagagaaaatcctataaattctaagaaaaaaatagcatatatcccttgattttcacttaaattggtgggtccaatattatacaccgttagataaaattgatcttaaaacaaactaaataccatgtgtcccacctatcctctcctcccgtgcattggcaggtggagtatataccgtaccctcccccctttttttccttttttcttcttttttccatttatatatataatgtatatatttttaaaataatgataattttacaaacaaagaatctaccatcatataacttaagccggtgtactttttactctgtactattattttcaaataatgcactattttaaaataaattttacacaattacatcgtgtcctataaaataaacaatatctatattaactaatttatacgtgcacttaaactgatggctccattatataaatcatcggatctactttttattacactggtctattattctcaagtaatgcactgtcaccattatattgtgtacccattaaattaacaatttaaaatctatattaactaatttacacttacgctagaactggtggacctattattataatcatcggatctattgtttgctaataaataaagcgtccaaaattctctttttgcccactgcacaatgcacgtctgcacctttgcctttcgcacgtgtgacgaagcatagtgtctgagacatctaaggtgatcacaaccgctatagtactaccgctttgccacatattaaatcatatatggagatgattaattttgttaataacatgaaaaaaattaaaggtgtgatgcagtgagagaataattaagcaccatgggttgtgtttttctcaacactaattagctctgtttaagttgaaaacgagagttgttacataacaattataatgtatttgtgttatgtcgtattttgattttgtactatttgttcgtaaaggtgaaaggaatcattatgttataaatatgagcgcaatattgacgaatatcaatagaactcttactacgacaaaggtgataaagggagtttaaggccctctcttttttttcccgatttcatattttggatttttgtttgcacgttttccaagtttctaaatggtgtcttctttaaacaacattctaactttttagaagtcaattcattcgtttataccctcaaatagctatcacataaattatataattcatcaatttcagctatcctaaaccttaagtactacatattttttttcatgcgagccatggtgatcaataaattggtgaacaacggatcatcaaagtcgtaagatgaatatataagagttactctgaacaattgtaaataggtgtcaaaattaattgttattaattagacatctaatggcttgctagccacaaaattaatttctctctacatgtatataaacatggacgaagttggaacaaatattaccatatgtcccatacatatatattgcgcaattaacattctaattagtcatttaaaatttcttaaaatgctcttaagctgccacgtggtgctataataaattagggcaaatattaaattctaacaaaaaaaatcaaagtatctattattttatttcgcttaaatccgtaggtctaatattataaaccgttagattaaattgatcgtaaaacaaactaaatactacgaggtcccacctcgacataggtacgcacctacatgcgcgggtacgtacgcctccc

SEQ ID NO: 36398 - DNA, 1071 bp, Oryza sativa
aagttggaacaaatattaccatatgtcccatacatatatattgcgcaattaacattctaattagtcatttaaaatttcttaaaatgctcttaagctgccacgtggtgctataataaattagggcaaatattaaattctaacaaaaaaaatcaaagtatctattattttatttcgcttaaatccgtaggtctaatattataaaccgttagattaaattgatcgtaaaacaaactaaatactacgaggtcccacctcgacataggtacgcacctacatgcgcgggtacgtacgcctcccctcccttttttcatttttctctttcttctttttttcccatgcatatgcttccctccctttattactatatcatgcgtcttcatgagatgatttaatcaaaagaattttgagtatcttgcactcgcatttttaatttgcgggcatactagacggtatgtatatacatagactgtatgataattaactagcaatagtttcttatttactcgagaaaaaaatatgattcaaaagtcgtaagtaattaatccatctcctactcaaaagtttgtgaatggttttataagataccttaagaaaaatagaacccttaaattattataaaataacattatccaaattttagtttgccctgaatctataagacaatttctgaacaaacaataattttaccttttaaataatataagtgcccgcgtatacgcgcgggccaccaccttcctagtttcgggcaacagcatcacgtcaggacgaggccagccaccaactctgtaaccccacgaaaccacaccacgtcgatgattttcggattttctctccccgggccgggttcccctattctgattcattaattaaagacaaactaccggagttgaactaccacgttgataattaaacaagccattaatgacgaaactagcctgttaagctacaattaccgggatatatatatatatatatatactacagccgtggcggtggtagttcgtcccgtcaagaaagaaggatatgataattggacttccggccggcttagctagcttgggtgtggcttgc

SEQ ID NO: 36399 - DNA, 4008 bp, Oryza sativa
ccgggtcagcgtcgcgcgggtactcgtggctgctgcgcgcgtcggcgtcgcggcgtggggacgggggcgcgaaagcttcgcgcccgcgcccgcgtggccacaacttgggcgtttctttccggtcacgcatgcgccttcgattcgcacaggctgccgcgcgctctcccggccggctcccactcctcttacgtcgccgctctgggcttcccgttcagcaatgcgtagttgacatatggccctgttggtttaattctcggtgtggtccttacacagaagatcaaccgtgcacctcagcttatcgccctctctttcacatggatcagtttaacgatccgatccatggtctccttagataatggaatgaattccaaagaaaataggcaaaatgaactattgaatgatccgatcgacggctccttccttatcgttcttgttgctcggcgatggcgaggcgccgaggcgtatcttgtgtgttcacgctttcttctttcttaaccttcgttgctgcaaatgcaagccgggttttctgaagcgaaatctctggtataacacacgagactcttgaaaatcacatggcaaaatcatgcatttagtccgcacggcaacagagctatattctactactcgcacatacttttgtcagtaagggctggtttagttcctaactttttttttaaacttctaacttttccatcacatcaaaacttttctatacatacaaacttttaacttttccgtcacatcgttccagtttcaatcgaacttctaattttaacgtaacacaccctaacttcaaaactaaagttagcccaaccatttgaagaaacgcacgtttgctagctaagtggtccgtccagttattctggaaaccaaaacatcgctagcccctttgcagaattgcgctaaatcgcactgaccattagaattttgtaagattatcgtagttgattagctggccctaccagatcgcttgtgctattccctcattccatcgtttgagtttgacctctaacagtgcttcaaccttttctaatcaaggaggcgttgcgtacgtattaaagaaacatatctcaaaactcgacgtggaatttggtgtcgaccactctgagaagaatacatcggcagaaacccccaaaaaagacatttttacacgtaaagtgcaatattaattctaggtttctcattcgtgcatctttcttggtctcttatgcatgcaactgtacaacttggcatcttccaaatccaaactgtacgtgaagttcaatgcgtcgattcatgtccaagactaattagagtttttacgcaggtaaacaagtttgtacgcagaacctgtgttctttgggaacccgactatccaaacatgtctgcgagcgtcttaagaaaatgaaaacaacatgtttgcaagcgaaattcatagaatcaggttaaaggtgtggaaatcattaaggacccagacttaccttggccgcacaggcaatcaaagcctacaaagctcacagctcggaaacgaaagacgggataaatgcaaatgctctttagcaaaaacaatatcaatgaaaagaatcaaggtattctcctataatcactcgaatatacagaagcatcacagcattgtttgttcagtccaaattctcgaggtctgcacgttctgaacccactcacacaccccattagcaagtagcgaaatatagacaactcaaaagaaaaaaaaatcagttgttcgaagtggaaacagaaaatacagtgcctcaaaaactcgaaattcaactaattttacagcacttaagtagattgtctgctttgccggccaataagcatgcattgctcttgtaacagggagcagagtacatgtcccttgacgcggcaaagctcaccgtctattccacacccattgtgcgtgtttgcacctggtttaagcttgacagactttacctgtgtcaacgtcagctaaaagttagatattatccttggtagatgaaaatataagtgcaaataataatttagcccagagccccagagcatgttttgataactattcgccactgtcttaatttaggtgaactttcagtgatccatcaccagagctgacataaactcccagaccgcccaacaggtccaaacagctcatacttctattgacataacaaaagttaaaatgcactgcagactgctgctcttaagaagccaaaaggtttacgataataaaaaggtgaaatcaggtattcatgagcgtatatgataatatcctctcaacaaaaaaaaacagaatatacacattggaatatgtttgttttcagaatgcattcaactatgtagagaagttaatttgtttcaaacgtaaaaacggtatttatttcagaggacctaagtaataaacaggtattcggaaaatttgccactggtactcgaatgaaaaatcccttgtctgaaaagcataaatacaagagggtgaaaaaatagcttgagaaaagaaagaattgtgcatgttaccttcacatattccacataaggcaaagaaagatggcgaccaaattgcagaagtatgaaaaatttcaacaacttccatctaccctttccaccaactaagagcaagtccaaagtgttgtcatcatggttggcttttggtgcaataacctgcgaactcaaactttgcactgtcttgcatgaatgattgcaaactagaacaccaagaaagtgtcctttcctgactacccatttatcatccaaatttggcacaagttccactgatggtccaatttcattgtcttctggtggtccagggagttcaatagggtggtcagactcccaggttagctctgtatcccattttggcccattgtcccactttggttcagagtcccaaataggtcctggatctgaaattgttgaggaaatgtcctccttgtcatgaattgatggggctgcccaagataatcgtgtatcgttagtagtgacaccaactgaatttctctcagttcttgttttggacctggttcttggccagaatgatgaatgatgtggttgagggtgtaaaacttcctctggttctgaaacaatgttgcttctgcccaaagaaaggcgttttgcttttggatcaagaccacgaacatactctgaaggttcagtgcttgctgctgtgctacctgatgtatcaacgtccccaagtgacatccgacttggagtcataatagagtcaatacttgacaaactggaagctcgtggaattccttctctttttgatcggctgcgcattacattggtatatacatcagacacaaagttttcttgtcctataccttttccatggccagtcatctcctttgaagaaggaagatactctaactcatagaaatagcttggcaggcaaaaaaatttgagtattccagccacaaaatatcgaagagggccaaatttcttttgatatttctcagaaagctccaggactgcagcaaagtaatagtgcctttttcagcttattaaattattatgcaatcctgtactgctaaactacattgcactgctgcaaatactggaacatagataaataaactacactttaatgagcagtcattgaagaaacggagacaatagcaaatttaccaatgaagcatacaagttatctcaaattttacaattaagagtacagtaagataacttgtatgtgctaattgagtgaaatgatgaaagtatatgccagatcattagcctagtaaagctgttgggaagagcaactcagcatgcatcagatcaagtgtttagtataaggataagtactcaaggcggtctaatttttggtaaaccaaaagtattttaaaaactatcgtattctaaaagtacttttgtcagctaaaaagtttaccattgtcccaatacaacttatgaagcattccaaatttcaagatttatggaaaaaatggcaatgcaagatatatgaatctgagggatttagaatgtacgcaacttttgtggccttagcccttaggatatcagtgcatacagtataaatga

SEQ ID NO: 36400 - DNA, 6030 bp, Oryza sativa
  unsure (1)..(6030): unsure at all n locations
tatattatgggacagagggagtattaaagagcaaacgtcttgtacaagaagttaccatcactgataaaaccatagtatgaaacagttgtcccaaagtgtattagcccagactggatccactcaacagacaggatgtctagggcagtaaagccaccctgttatcaaggaacagaccttatgagaaaagctataagtgatctaataattttggacaaaattaactgaaaagccttaagggtgatgttgaaattttctcttcctgtaagaagaggtcgtgaaagattcacattgtaactttgtaagcttatagcgataggcataccttcacaattagtaatgatgctgaaattggatctttaactcccaaaacagtccaaacaagtgaattgtcagatcctgctgggattattccaactggaattgatacagcctctgctctatcacttctactgagtagaccgttgaagacctgcagaactataaatgtgggatcagagtcgactgcaggtgcagctatcatatataagttttactaaatcccattaaactataatatataatcatcaaggacaaacctcatttacaattccatcaccacctacacacacgattcctacaaaacatttaatacattatcaattcaaccagttgaaatggttgccgtgttgacctacataaactacttggcaacatctgtgctgtttataccatcagggaatgcgctaaaatcaaatgtagatgcaagagatttagcgtgaccagcatgagtagttttaaccacttccatgtgaaaacctgcaagctacatcagatgatacaaaattaatagcgggaaataaatgatataaagtttatgtaggcacgcatgaataataaaaacagggtaacgggtaaaaaatcaccaagttgagaaatgtgaatgcatacaagcaataaaaataatccattagcaaatatctaagaggagaggaggtgatcgagtcagcacaattctctcttttttttaaaggacatctcgaaggaggcctataagttaactgcgattatacactttcgattaaaaggtgaaggaagtgcaattttagttggtctaaattgaaaagtaaatttgcaacttgacagcctgtgctgccaggagaaagggggttaaataatctcccttaaccttttgtcaataaattttacccagctttatgtccaactccgttgctgcattcacaattgaatcctttactgctaaagcatcagatggaagcccaggagttttgtagagctactaaaatagaaggaatgtatgatgtcccccacatgtctagattggtagggcaaacaacaaacataaattagtcatctgcaaatctaaccgtggatcattattttgatattttctaaacttaacacttcaggttggaactaaaaatccattaaagagaaacgtgatatgctcttcatgagttcttcactgttggaactaaaaatccattactgggatacaaaaaataccaaacattcctctttagttggcactaaagaatctccatggtcaaataatctatacattaaccatcaatatgtttggaggtatctagattgcccgtaaaagaactacatcagtagatttgcatcataagaaacattaagttgtaacaatattaagttctacagagtttaattcaaagttacacatcatagaacatgaaacaaccaataatttcgatacagaaaagaacagaggtactattctattcctcatgacatctccttgagactaaacagcgaatggtttaaagaaaagcttcaaaaagaaagtttattgccaagaagaataatagacatatacagttagtcaagctatatgttgcttactgcagagcaataagtagaagcttgcattatgagagtatcagaaggtaccttaaaaataggttctgctttgtcatggaaaactttgcatgatctaccatgcccagaccgagggttcagtataacaagtatcctcggtggagttctacatttgatgggtgggtggtcaaataaagcaccactgaggggaccatcaaggtcttgctcggtactggatgttggagggagaggtagcatgttaacatatatgttttgttcggcaaagcatgttacccatgaaatggcctcctctacagtaggggctataaaccggaggtccttccgtactctgtgtgtctttccaaacaaatacttcttagaagggtatgcatgcacaatgaaatgttggacaccagaactgtaagatacctgccaacatataaacaaatcatcaaagatagatggtcagcccaagtggaccaaatagcaatagaattatagtagtgtcttggtctgtgaaacttacagagatgacatcctcaagactgagtaaagaagaaccccatattagggctttacttgtgagtcttacatcacttatatcagctttcccatttgctgaaatttgatctcctgtaattctatttttcttgtcaaaaaagagttttccagaatagatttcataacctgagaaattagacttctcatccaccacatcatttttttgctcattattttttgctttcttggaatctttattgtcaaaaaccaagtgtttctgcctcgaagattttgatttgccttttttctctggaaatacagttggtgaagattgttgcccggctgacttttgagaacgccgactaccagaccgccgactggacttctgggatgagcttctggaagtaggattttctagatcagctacttccatctctttcttttaaagaggacttcagagcatcagtatagatcaggaatttggcatgacctcataggtgtatgatcatggcatcaatgccatgtcaaagttgctaacaactaaaaatagcctgcaccgaaaggaaaacagaacacctataagatccatctggctggtacatgtgcatcatttgttgaccaaaagcagccgttcagaaaaaatgagtacatccgagcttcatctccacagataactaagaaggtagtcacaaaaggctagcacctaaacagcttgggtctaaagaaaaaggtcctcaaaagtttgtcgtactgaaagtttgaagcatttctttagcaaataaaattctgataatatttaaatatttatatggtgatttcctatcatatgagcctgatgttcaaatatgtgcgaggaaaccttgtgacgaatctaacaaaagaacttttgctccatgtttaactgtgtgcatgcctacttgggacatatcaactactaacatttgtattcatgtgttgaatttgagccactaccctaaggactgcaatcgtcaattgttggaagctgatatgatgtgctatatcaaactactccctcagttccataataataagttaatctagtacaagatgtgacacatcctagtactacgactctggacatgctattctgggtcggaggaagtgctccagttcactgccatgctctagaagacggcattaagatgagtcatcacagaggctatggtgctacaattcacttgacttcttttatagggaaacacctggacacttatagggacacttacagcaggaacataggctaaactatttcacaaattaatcggttgagccctcaaacatagttctaaaatgcttaatagcctacagcgaaaacatataggtatataaacgctaacagcaatcagttccccgataattgcaagtaccaagtagactgtatgagcactataaaatagcatgtaccgctgaactctcaagcgtcagcaatcaaatgatgagttgcacaatacagaaaacagttattctagtgcagtacagtgagaagtgcaaagacgagcatataggtgataccagcaacagatctccagaaatacaaataataaaatgtgtttatagatgagtatagaagtctaaattgtttggttcagtaaggagaaacgcaatcacgaatatggaagtcttagcgcaggaatagcaactacgaactacgggcaccacagatctcgattagcataatttcgaatgccaaacgcccggcgcaccaatcggattgcgaaggcgaaagggagaaacacgacgagcaatccaatcagctagccaccgcccacctaacacggagattgaaacctcacgaagagagggagcaccatcaggcggatcgaagccacccaacgagacgtaccgaattcggcgcccccccactggaaacgatcggatcgggaggcggaaccagctgaggacgcggccctcggtccaccccgccgccggcagcagatcgaacgcctccggactcacgtcggccggcggcgcgagctctcgcggttgacggcggggcaagaggcgaggcggtggtggtggtaggaggaggaggacccggacgcggcggtgtggtggagccgtggaggggttgattgggtgggcgacgggtgagggagggccggggtggtggttcgatgggttttggcgtgcgcgttttcagctgaggagacgaggaagaggaggagaagaaaaaaaatggcgtggcggacacgaggcggcgctgttccggctgcgctgttgttgttgttgttgttgaggggagagaagccagtggaaagaaagggacggtgccgccgtttcctctgttctttctttgctccgctcgtttctcttctcccctccgcgcactggttttcctgtgtttggagcgctgctagtgctcgctcggttggcttttccctttgatcagctgatgatgcccattggaaacctgacgagccagcccagaaagcgagatggtggatggtgagataagatgagatgctctgttaggattactccccggccacgcctacggcggaacgaccgaactgacctacagaaaatttctcggtggacaccgacaggttgaccacttggagtatgtaggacagagcggacactggtgaaaccatagggaatttcagttgcaacaaagctgtaacgggcagtctgtgctcaaattaacccaacatttcacggttgaaatgttcagtttatgtcttggtttgatccagtccaatttggctggttcgtcttttggtagaaaaaggtggtcgtgatgaggttggcaattttggcatacgtcggttgtgttcggaggagagggttagcacgcaaaacgaaatttgttttattgcatgattaattaagtatttattgttttttaaacactttcatacagacagtttttttttcataaattacaccgtttagcagtttgaaaaacgtacgtgcggaaaacgagagaggtgggttgggaaaatgggcgaaaaacgagagaggtaggttgggaaaatgggggaaagaacacagccacggtgaaggccttaggaaaacggggacagaaaaatcatttgctttatttcccttcattattcaataaaagctcaaagttagtgaatgacctgcgactttaagctcaccgtgttcattccagtcgtcttttttatacaagtccggtggttcaaagagagtactttaattccttctagacgatgattagagataacggattccagctctccaaggtcgcaactgagggagctatatatcaaaataggatattattctttgtttgtagttgagatttcttagatttgagtaaatatttaatgagtaagaagtcgttcccaagcggagttcttgaaaagagttgatttccgaaatttatatatttggaaattcgaaacttgtttggtcatttgaatgtcttttaagccaggggaaggtgaggaagtggattaaacaaggaccaaggcggtcttcttagaattcaatggttcgtcagaccaagcacactacctggtcattacatagcttcaaacatggcaatgaccaaatttaaaatgaagaatgagtacgtcgccaaaacattactagggttagccaaagttaattttcagtgcagtatattagctttaattctaaacacaannnnnnnnnnnnnnnnnnnnnnnnnnnnnnnnnnnnnnnnnnnnnnnnnnn

SEQ ID NO: 36401 - DNA, 1633 bp, Oryza sativa
aataaaagctcaaagttagtgaatgacctgcccctttaagctcaccgtgttcattccagtcgtcttttttatacaagtccggtggttcaaagagagtactttaattccttctagacgatgattagagataacggattccagctctccaaggtcgcaactgagggagctatatatcaaaataggatattattctttgtttgtagttgagatttcttagatttgagtaaatatttaatgagtaagaagtcgttcccaagcggagttcttgaaaagagttgatttccgaaatttatatatttggaaattcgaaacttgtttggtcatttgaatgtcttttaagccaggggaaggtgaggaagtggattaaacaaggaccaaggcggtcttcttagaattcaatggttcgtcagaccaagcacactacctggtcattacatagcttcaaacatggcaatgaccaaatttaaaatgaagaatgagtacgtcgccaaaacattactagggttagccaaagttaattttcagtgcagtatattagctttaattctaaacacaactataaaaatatgaagaggacatataactaatgcatattacaagccaaaacttaatgtctagggccatgtacccctccgtcccaaaaataataataatcctagcaacaaaactggacacatgcgtgtctaggattagtctttttttttggacggagtagtagatctttaccaaattcgatatagatttataaatagacttgaataaatgttgttttctcaagtggtggtgtttatttagtgtttttatcctcacttttttatctttttttttgcggggctcacttttttatcttagctgctactgttgagcaaattgtgtaataagtgattataacttccttcaaacaaaagccaaaattaatattccattattaaaagagctatacttctttttctttcattacagtgaggaaataggggcattttttgagtccctgacccccggacaatctgggccataaaacaaaaatatgagtcaaagtttcaggctccctaaatggaaataagttcacttgatgtccctcgattttacattgagtttgtttgacatcattatttccaataccagaaatcattacccctaaactatacaaaaccgtgcaatttagatcctatagcagaaatgcaatatagatgactggtttagcttatgtggcatcctagtcaggaaaaatttcaaaaaaaaaatgtggacccaacatgtctgtgcccttttctttattctcattccttcccaagcctggagagagagaggtggctggcatgagaaaggagagagaggcggccggcgagcctgcttgggacttgggtcaagctccacgcccggcatcgacccgactaggctcttcaccgcgactggtcttggtgctcttcgaccagcagcatggtggaggatagtagtgaccacgttgctgaggaccagcttgcggaggaggaggagcactacatcgatgacgccaaccacctcgttcccaacagcgtccaagaggagggatccagtggtcgcgacatcgtcgtccccggcaaccacgatggtgaggaggactaccctgacaaccttgaccttgacatactcg

SEQ ID NO: 36402 - DNA, 13444 bp, Oryza sativa
ttcccgtgccaacgtttgattgtctgtcttatatgaaattttttttataaatagtattttcattattgttagatgataaaacatgattaatactttatgcgtgacttatctttttaattttttttcataatttttttaaataagacgaacgatcaaacgttggacatgaaaatcagggtttgtctttttttttaggacgaagggagtacgtatgttgctttttgtcttgtactacctataaaacatagcacgagaccttggcctgggtcagcttgcctgaatcgggagaccctgaaacaccccacccctgtgaccaagcagcaacaatgtgcaccgcaggtcccttcactcacatcagttggtgcttgtcggaaattaaagaatcctggccaacgctagaacagcgagcgctacgaacccgcaaagcacaaacgctccgggccaacggtcgaattaggcgtgcatgattcaaaccccccccccccccccccaaaaaaaatcatatcaaattaaagcagaactaattaagcgtgtcacgcgctgtttggtccgtctcgcctccagtagctgcgtacggcgggggagaagctacagcgagctacgtggagtagcttgattgccctaggagccgcacgaggaggggcgcacatgacgaagcgttggacattggcgaggaccttgtcgcggcggggtttattccgcggtactactgtctggccattcgcacggcacgttaggtgcgctccccacgcgcgcgcgtcgattagccggagccacgagggccgacacacatcaaccccccctactactacgcgaccgcggcgtttacggcgagcaaccagatgagatgaccaaatcgcgcgcgccgcgcaacgcagcgacgggccggcttgcgcacaccgcagccatgcccgcccgctgtctcagggggatatatgcaaggcgaactgcttagcaaaaggccagggaagggaagagctagcgcgcgctagctcgatcggggaacagagtaacatgcgtgccgttgtgcgtccgtccattagacgaacaccgaaggcgtgtccttttgcggaaagcgagcaaccgcttttgcattgtgatgcaccgctcgccgggctggctggttaagatttgaagaagagctagcagggtcatgtgccggcatgaggggcgagccaagtaaaagccaacatgataaccccatcgatctgtatagatagaaacgagcccaagttgcgttttgttagtttcgggcacccacagctagccctggctgtgctgcgtgctctgaaaattttactcccactactccacacaagtgtaaactcctctttggatgattggagcatctgtgtacgtattaagcctgtagtttaaactccaaagtgggttcaggtgtccacttaaacgtagaataacaaacacccacccatcgtcggagcctgtttctagacatacagatgcgatccgtccacgcataaagaaagaagctagggggaagataacaagagagcggaatcgaaagggaggggaaaaaaaaagaagaccagcagcagtagtacgtggtcccgatcgatcgaacaccggagatggcgggacgcatccaatgatcgatccaacgcgggagaagcgatcgagcggctaagctaagctggggcgtgtgcggagaagcgagcgacggatgactagagcgtcgcatgcagcgctacagactggagggggtggcccgatctccgcttgctggcacgtaaatggagcccataactttcacgccaaacttcgcggattcgatcggtccccccggctggccggaaaccacatatggatatgcatcggagtgcctcgcatgggcagcaggacaggtttgccttggtgcgtggtaaatctcaagcctaaccagtaactgcccgcgtaaaactatacagagtatacaggtgagctagcagataacatctgcagaattcagtttccagatgatggataaacatgtctacagaattcaatgttctataagaagaaaagaattaatttgactctcgggttactcctaccattgattagctttctctcatcagtactacataagttgtggaatcgctagtggatcataatgggatatttttttttaaaaaaaaaagaggtcgagaaaagcgacagcattttagaattctcttgtttggatgaaaagagccgtgggataacgaaagaaaatcgtcgtccacgctcatcatatttctatgacaaaactgagaatggacatattgcataaggagaatcatctgcttgacttcttcgctaaaaatacttttttttatgcatgtatcatggaatcataatattgtatggtgaataatcagcatcaagcttgcatggttctgtagttaattttatttcatcagtatcttgtaaatgattggtacagccaacaactagaccgaaatatttttttctacaaattgtaaccttggatggaagtatccatcacatcaaatattattacgtatgcggcaagagtagattttaaactctcgaggggatgttcccccgttgtttgcatgtaacttaaaaataagttattaaaattaaaaaaagtaagaagatgtattaatatgtgatatatcactccacaaacatataaaataaaattcaatttctaaatgatgtaacaaaaaatatgactgtgaatatatgtttgtcgacgtttgatgtcgcgattccggtatttacatagtatggggatcgttagtactagaatatacgcgagactgaggtaaaagaggcggagacgaggatttttatacaggttcgggcccctgaattgtcaggtaatagccctacatcctgttggccaaagccgatcgttgctcttattcattataatcacaccagtacaatatttggggtagcctatctaactgttgttgacatggcggtctgaaggtctgactcgtagtcgacaacaaggtagtcttcctcctcgagttcgtgcccagcgagatcagagacatcgctagatccctacggccggcctctgtaggtaccggatagggtcgatccaggcatatctatgatgtcgatatccggcggcttgtcttggcgtatgttggcttgtatgttgtggcttctgttgttccgtgcatgttgattctctcccctctcctcctagggggtcttgtatttatacccataggtgttcccttgtccaagtagaactagggagaccaatatgaatacaatccgagtagtctttgtcgtttctatgtagaactctggttgtccttccttatccggaactcctcctatatccgaaggttgtttccgtataagacatggtatgtggtgggtcctgccgagatttagtcaactactattaggtatgtggtatccataaccctgacaatgttataactagctgtagtttaatttgattttttgttacgagatgtacaaattgaatttaaatttacatgtttgtggagtgatatatcacatattaataagtcttctttttttttcataatcatttaagtgacgtacaaataatgagaggatatccctcgagagtacaaataatgagagaacatccctcgagattttagaatagttatccgtatgtggcatgattagtacgtgtatcattggctcccatcggatggcccattaagtcaaagaaaaaaccaaattttaaattttcaaacttgattttgagatattttcaacatagtttcttttttagcattggtttttaagtcaccaagaacacatatataaaagttttacctataaatttatttttatttcctaataaactgttttggcttattagaaaataagcgaaacgatggggcccattgttacagctagctggtaaattaagcttcacatgttgttcgagcatccaaagagatgtagctgtgttcctgcacctcccagaatcatttctgcaggaatcacgataagtcgatagctacgttctaactatttgcttgtggtgatatacggcagctaagctcttgatatgtattttaaaatggtcggcaataaattttatgtaattatttgttcagtgcttttactatagctactggcgaaaatgacatacgtgctgcaagtttcagaaaattaaataaaaaatgaactggagatcagagactataaatcttattgtttaatatatttttctgttgtaaaaagaaggaaagaacatatagtaaaaacataagtttaatttcattccactatctttattctacttaccgttgaaactgggtgcaacactgccaagataggcttttcaggcttcagacttcagctgatgggtttgtgcacattctgcattgcttacaattatggacgtggcttgcgcataggcgaacggcacggaccatgcaaattaaatggcatgcatgctcttcgcgcaccagcatgaatacacattctggctgaagtgtctattctctaggaccggagtatagtaggccacggtaataaattaactctctcccgttttctgaaaataaagttatatgcatgaacaatttaattacctttcaccagcatcataaaatttggtagagctcaagtggtaatggaagcagtacttgtttaattaggttcatgacaactttatccatgcccatcatttgcctacttggatatatgcaaggtccacttttataatgccctcaagggcatcatcaatcattatcacctcgagttaacatggatcacgctgcacaatcacagcaacaccgagggcaggaggtcgtgcgccacctggatgcgcaggagagactatagctagattccacagcaacacatgacgcacatatatacccatctatcctccttccaaagcttgctttggttatgatcaataacttatgattagggtatagaactactactactggtactaataaccgaatacctgtactgctggagtagtagtttgaagtggacaaatggtagcgccgcccggattaatgatgggctggctggcaaccagaatgtgctgctccaaacctccaaccatcaaagggcaacgctaaattactactttactcggtgtagatcaacttcctgagttgtaaattgtactatctcacggcttagtttaagtcactcttgcgtataatataagatacaccatacatgtgggatagcttgctgcatctgggtaagcttccaagctagatgcagctcggtaccatttccttgcaagtacgaatcttaacgcaggcacgacagattgaaacaaggacaaggggaaaatggcgcaagcatcccaaccacccttgtctgaccaccgagttacctgaaacactcatgcttgtttttattatacagctgcattttcattatatttacgtttcgtacatttttcagcgtttgttatccaaagaaggcataattttacttggaaaaaacgcgaaagtcgttttactctttatgatgtatatacccgttctttacgtatcaatagtaattagttatggaaaaaaataatagcaatgatagctactcctatgtgatacaccgtaaaccaacaaactagttcaaatgcaacctacacaaattgataaaaaaaggaaactaaccatgaatagtaaatttgtactatttagtgaataaattgttttcctttcttcctatgtggatcgaatttggaattgatttttttctcagcacaatagataagtgatgtattcaacacaatcattttctatatatttttaattatttgagacgtaaaaaagggaacatacccataaaggaaaaatggtagttccaaaagtaggttgtgttttaatatactcacatgttgcaaagacatagctagtcccatcatttttatagtagctgattatgagccataatatttattagcgacttaaaaagtaaatttaaattaagggtaaagttaacctttaaaatttaaattttgcctgcagcttgtaagttgagcaaacgatggatcgtaatgtggtacttaattattgatgttggtatgaaagtataatatagtattaaacttaagactgtaaaaactcttattttttttgtgtgcacgcctatacagattgctcaacagatccaacttcataatttggtagtagtagttaagctatacccacacggagaggagtaaaaaccaaactaggctgtgttattccctcattttcctaacccacctctctctcgtttttcacgtgcacgcttttcaaaccgctaaacggtgtgatttataaaaaactttctatatgaaagttgtttaaaaaaaatcatattaatccattttcaaaaaaattagttaatacttaattaattatgcaataaaacgaacttcgttttgcgtgccggggaggaggggttcccaaccctctcctccgaacacagcctaagagcaagtacaatagcagctataagccagctataaccacacatcgagaagaaaagataagagagaggagaaagcgggctacagatttatagccggctgcaacacggacttcaagacgttatgtgtgtatgagaggggagaccggatattaacggtgtagtatatttttatagttaactattgtataaatgggttattagattagctatagttgtttaaagctaataatttgttttactattaaacttgctgtaaggaaacagaaaaaccgatcgactagctggcggggttgattggccgcgtggttttcttccaccgcgcgcgcgagcacgatgcatggatggtgcatcgtgtggtggtattacctggctggcacgagagaggaaatttcggatggaggttgggactttgggagggggccgcgccggggttttggtgggggatccgcgataagcgtccgccatgttctgtagcaacgccaccgcctcctcccgtcgcgtggggggtggaccccacgccacagctggttcggtgtattcttgtctcgtacggttcttttgcctgccgcctcccccgttctctccttccttctccgtcccggcccgtctctctgtaaatctgtaatctctacgtctctgactctgcccatggcgtgattaaccttttacccacgtaacaacagtaattaattggtcgatcgatcgatcgtctgatctgcaagttccttctacgtctccaccatggagagagagagagtgagagagagagggggggggggggaggtccatagcttgttgaaggtcactttttccccaaataagtctgagatacggtttgtgagattatataatcagtttattgtggatatgcagagtattatatgtaatcagtttggcaggtggagtatattggagtcttaatcaagatcgtagaaaattaggaagtatcgataggccctttttctgcatgcgcacgcaataattcggcagacaataactctcatcaaatgtaggaatagtattaacatgcgtgcctattagataatggtacagtataagatcgagtcataacagcaccacaacaccgaacattatctctttagttagatactctcagttcatattataaagcgttttgatcttttcttacttatattttgttaagtttaattaaatttaattaaatctcttcagtgatgacgctggctgagtaatgtatttacctctttccctgcaaaaaaaatttgattaaatttataaaaaaaagcaacatctcaaattagttttagtaaatctaacattgtatatatcttgattatatgtttattttgtgttaaaaaatatgtcgggacccaaggtcacggacaagattggggatagacgggaaaacatccttttcccgtctatcctgagaaatgagcccgaataccaaatgaacacacactaagtgacaagacttttagtattccgagatatcttgcctgctacacgctttttgtctactttatatagttcacagctttacatgtgagattacaattgcgccctttgttgggcccacataaaattacaatcatgcccttgctatatcagctaacactaagggcattttggtacattatggaggtcattatagtcttttggtgccagctggatgaagtggttgagtggtcctcgggaatattctcttggcatctttgttgtccaaattgccttcttcatgatcaagagtcttttccaccaccatgggtcttctcctcgaccgagggtcttttccaccaccatggatcttttccatagcaaatagtcttttccagctcgaccaccctttccgacttatccggtagctgacctgttgttaactcaggaaatactcaaaacggataatgagatttagtgacaagaatgtactcgaacggtattttccgactcgaatagtattttccaattcgaacagcgttttaccgttaccctgttcgaatgaccatttgccactcggagactattctaactcaatctcttcctctacagtgttttgggctgaatatagaggagcggtggtgaccccctgctacaacaagcccctcacgggtaagggcgatgtgtgttttcggccgaaaccgtgttcgaatcaaaagctgggggagaaccgccgtcctcctattcggtcgaaaaaacactgggacataaaaatttgaagttcgaaggtggttattcttgttaatcattatgcatttatttgtttgttatatatatatatattatttattttgtgtatacatattctttatgtattgaatatgcacatttattatgatgcttgaatgtgtgccacatgtcagctttgtattggatggttggaaggtgaagcgccgcttcggggttcacgcccgctcacaaccgcgaccccccaccccccagacctatataatgtccgcaggggtcgctttcagccggctactgtgccgtcctatacttgactcgaatctgtctttgctcgaaaaacactctttccagttgaagacatctttttctcttgactacccttcttcgtgatgggaaaagacaagcagaaaacaaataagaagggcaaataaaaaaaggtcgaaaaacccgagagaagtgggattgtcttgggcccttcggccatcaaagacaagcatttgaatgaccttgttcaaaatggggtcgtttcgaaccggaaatttttggtttgacctgttggcgagtctgatccttctcccaagcctggatatacactagttttcgaaggtatctttgaggctggcttcagatttccgtgcagcccctttctgatcgaagtgttaaagatattcaaactcgagttcccacaacttacccccaatgtgcttgtgcgcgtgggaatcttcgaatggatgattcggagttgtggtgggaatcctcgtgccgaggattttgcatatttccacagcatccgccgctacaccaagcaaaattcgaagttcggttgtctcaacttctccccccattcgaagcatggatgcccttggccagccgtacttgccattcgaattaaatgggggaacaaatggcagtctaggtggttttaccatcagatccctgccaaccttcttgctgacaaagagtgtcctttcactttctcttgcaagatcgctaaggttatagtcgaaccgccagcggctcttacagcggattttctttctattcgctctcgaatggaagaacttgtctcaaagttcagcgttcgagacttggtggaagaatttgtttgccttggcattcagccactcacagccgagtggactattctcttaggacaagtgccaagagaagccgcttcgactttgcctccctttgaggttgatccgaatagtaagttttcattttctctttcggtcgaacacattcatgttatttattaagttcgaacattttccttcgaatgttttgtacttacattatgttttttttgtttgctatagctgttattcctacagacattgtccacccttgtcggaaatatcttagtccttataccaaagatgagcacgcaaagtaccaatccttgcaaaatggtttaaggatgaatcgagtgatgtccgcccttggactcgatattcctgctcgagttcatcctgagattgtccctgactcgggcaagaaaaagaaaaagaagaaagctgcgaggaaaatgtcttctgatgaagacgatattgaagttgaggaaaacgaagaaaatacagataacgacggtaatgatgggaatgaagagcatgtggagaatgaggaaaatgaagggaataaatccggcgaaggtagcttgagcagtgatgatgactcgagtgacagctcaagcgatgactcgaattcatcgtcagatgaggaaattgcctcggtcgtccctcctgcccaagctgctccaagtgttttgaagaggaaaattagtcctagcggttcccttcagattgttgtcgacagtgatgatgagattgacaaagacaacactctagttgacatttgtgccataaacgtcactccccttcgagctgacgccagccttgccacgcctgctaatgctatcgcccctttggatgtgcttgcatcggttgcaacggtggttgagaaaaatgtcgaagctgatctggtttgagcaactgattcgagcaatcttccccatggtggtgacaagtctcccactattgaacttcaaacttcggttcaaatagctcaagacttagagagtgggaagaaaattgttgaagaaactgttcaacctgaccaagtagaggagaaggatgccgaaatacattcccctccctttctatcaactccttccccccagataatccaagatgttctcggtggatttagtgagcgatgcacgaaaaatggtcgatggctaatgggactacctaatttctccgatttgggggaaaatagccatctcggttcaaatttttgcataaattacctgaaatatcgccacccgctcggttctgttggggatgagctcaagaaaatactcatcactcccgaactggagaaggaatttgtcgaggaaaacgatcttatgtcttcctgggctgcacttgatgtctctgccgctcaggtattcttttcctattttactcgaaccgattgttttattacttcatttctatgttgctcatagttcttttgctttttgttttttagacttcgaccatcgcctggcttcaatgtggtgtttccatgaaagcactcacagcaatatgtgtccggcggaagaaatcgctcgaacgcatagctaaacttgagaaagacagagaatttctccgccatgaagtcgagcgtgtctcagatgagaaacaggttgctgccgatcttgttcgaaaacttagcagcgacaaaaagggtttaatcgacgagaaaaggtctttcatcgaagagaataaaaaacttcatgcccacataaagattctcgaacagtcggtggctgatcaccaagaagtttctcgggaaagagccatttctgcagataagcttaaggagcaacttgctgcttcagaaaaagagaacaagcagctcgaactggctcgtctgaaccaagaagagaagaattcctccctcttgaaagaactcgaagattgccgttcgaagcttttggagagttgcaagatggttcaagacgctgtgcaaaaacttggagctaatgtaagccttccggccgacaatagtacattgtctgttcttgccaattgggtcgaagaatcatcgactggtttggttgatggtattgagcccttcgcctctcgttgttcaaagatctccgccgaggctttatcggctagtcttctttcgaacggatgtgaccatttctctggtttaaaggaatccatcaccgacttacttggcgatgagtcaaaatttgctcaacaccgtgcggcaattcgatctgtcgtcaaagcttttcaagtttggtattggaaaaatagaggctatgaagatacccttgcttctctctgggcatcgttggcttcgagctcacacaccacacaatcctcttcgagccagccagacgacggtggtgatgctcacatatctgattcgcaggtgtgaagtttttagggtgaactaactgggaaaacactatatgtgtttgaaagtactattattttgcttgatcgaacctattatggtcgaaaacttatttgtgtatattctaaatatgcttgggtatcactagctattttctctgtatgcctgtgcttcaccatcatttcgtttttgtcggggatgcaggtttatttgaaccgaaaagttgtggttcgacgcaacaaatgtcgttcaactcgaaatgggaagcacatagcatttcgaacacacgaggagttgctttttcctcaagcaactaattgtgatgatgaagagaagaaaatatattacgatgacacttgtattttttcttttaaatttttccaatggcaaagagaacatcaagatggcagtttgcgcgacttcgttgtcgagtttagaaaacgacgttcgaataatgctttgagtagcattgatttttggcaaacttttagaccatctgagcgtcaacttagaatatggaaaaggcgctactcaattgtcccttacacgggaatgccttatcctctcaatgtcatttttccttcttcttttcctttttaaatagggaatcagatgtaatttgtcatgttatcttcaataaaacttcttccgaatacttttctgattcaagataactaaggtagagaattgttcgaaaagttccaaacttctcacctttcgaagtagtgacgaggtcgaaaccacgctttacctcgtcgcgtgaattttccacttttcgctcgaatcggataagtgtttgagcgttttatcattaagttttcggacgaaggtaaaatctgttcgaaaaccgccatcctccttaccttttgaagaagtgacgaggtcgaaatcacgctttaccttgtcgcgtggattttccactttttgctcgaatcggacaagagtgttcgagcgttttatcgttaggttttcggacgaaggtaaaatctgttcgaaaaccgccgtcctccttacctttcaaagaagtgacgaggtcgaaaacacgctttacctcgtcgcgtggattttccacttttcgctcgaatcagataagagtgttcgagcattttatcgttaggttttcggacgaaggtaaaatctgttcgaaaacccgccgtcctccttacctttcaaagaagtgacgaggtcgaaaacatgctttacctcgtcgtgtggattttccactttttgctcgaatcggataagagtgttcgagcgttttatcgttaggttttcggacgaaggttaaatcttggcgcgtaggatttactcaattgttatcgagtttagcttttctccgaagcatgcggagtgttttctcgattttctatcgagtttgattttcctctctgaagcgtgcggagtatttactctttttgctatcgagtttgattttcctctccgaagcgtgtggagtgttttc

SEQ ID NO: 36403 - DNA, 1726 bp, Oryza sativa
ttgattttctctccgaagcgtgcggagtgtttactcgatttgctatcgagtttgattttcctctccgaagtgtgcggaggattttctcgatttgctatcgagtttgatttttctctccgaagcgtgcggagtgtttactcgatttgctatcgagtttgattatcctctccgaagcgtgcggaggattttctcgatttgctatcgagtttgatttttctctccgaagcgtgcggagtgtttactcgattcacaaacacacaagacaagttttttatacaggttcgggcctccattatggataacaaccctacgtcctgtttatatgtattaacatcgagaagacaacagaattttacaaggtggtcggtgttgtacacttcgagcaacatgttttcctttttttttctcttctttttttttcttttcttattttttttcttttcttcttttttttcttttcttcttttttttacacatagaatttcttcaaggaaatagcattccaagtgtgctttaactcttctccatcgaggtgtgccagcttgtatgctcctgtttctaacttcctttttactatgaatggtccttcccatttcgattccaacttttcaacagccacttcattgagtgttttcttgaggaccaaatcaccttcttctatttgcctgattttcacttttttgttgtaatagcttttggttccttctgtgctttgtgccattttttctaatgcttccactcttatctcgtggagcatttccaaggtgatttcccttccttcctcgtctttttgatcaaacacaacttgaggtgaattcgctcccacctcgcttggtgtcattgcctcatctccatatactagcctgaatggagtcatgccagttgatcgaacaactgtcgttcttaaagcccaaaggactgacaacagatcttctggccattttcctttggtagaaccttccagccttttctttatagcttctactattttcccatttgctctttcaacggcgccatttgtttgagggtgacccacagaagcaaagttgatttgcaagttaagacctttgcacatatctttgaatttccctgactcgaattgttttccattatcacacactatctccttgggtattccaaatcggcatataatgttcttccaaacgaatttttgtaccgaagcagatgtgattcgtgctactgcctctgcttcaatccaccttgagaaatactcaattgccacaatgacaaaacgtaaatctccttttgctcttggtaaaggacctactatatctagtccccatctgtaaaatagccgaaccgggggaattggttgcaactctcttggtggtgcttttgacgttgcaccaaatttttggcatgccttacatgttttaatgtacttctctttgtccttgatgatcgtgggccaatatactccttgtcttatcaccttcgatgcaactgatcttggtgcttgatgggctccggacaacccttcatgtatttctaccaccattctcatcccttcttctcttgttacacattttagcaaaggggcagtgactccgctcttgtacagctgcccttctatcaccttgtacttccttgacattaactgtattcttcttgcttcttcttccttttctggaagttgttcactaaccagatacttcagaattggctctctccaatctatctcgccttgtatgtttgccacttctct

SEQ ID NO: 36404 - DNA, 2592 bp, Oryza sativa
tgtaaagcttctgatacgaagtaaactggcatctgcttgttttctttctcttgcactaagactgcgcttactgtcactggtgttgccgctacatacattagcaaaggttgacctttctgtggacttgctaaagttggcatattctgtaggtatgtcttcaaatcatcaaaagctttctgacactcggctgtccactcaaatgagtttgcccctcttagggttttgaaaaatggcaagcctttctctgcagatttagaaagaaatctgctcaaagaagccattctccctgttagcctttgcatttcccttgtgttttttggtggctgcatttggtgaatcgctgcgatcttgtcaggatttgcttctatgcctctcttggacactaagaaaccaagcaactttcctgctcctaccccgaaaacacacttttccgggttaagcttgactgaatattttcttaagttctcgaatgtttcttgtaggtctttgccatgactaaacgcctgtttgcttttcaccacaatgtcatccacataagcttctacattgcggcctaactgctttgccaataccttgcctattaaccttgcaaaagttgctcctgcattctttaagccaaatggcattcgaatgaaacagtaagttccaaacggagtgatgaacgatgttttctcttcatcttccttcatcataaagacttgatgataaccggagtatgcatctaagaaactcatcaactcgcagctagctgtagcatctactaactggtctattcttggcaatgggaagtcatcttttgggcatgctttgttgagatctgtaaagtcaatgcacattctccactttccatttgccttcttcaccaagacaggattagccaaccattcaggatgcatcacttctcttatcacttttgctttgagcaatttctcaagctccacttttgttgcttgctgcctgtctgttgacattcttcttaacttttgcttttttggcttgtacccttacttgattgccaagttatgttcgatcaggcttctatctaccccttttagttcttctggtgaccaagcaaagacatccatgttgcttttccctactttcaagatttcctcctcaacatgcttttccagattttctcctaacaaaatgtattttccaggatcatcatcatctaactgtacattcctagttttcccttcaggaactggtttctgcaacttagagtattctccatgcttttgatcaacgacatggactcctttgacatttggcgttccctaaagctcaaactttcttgccgccaactggccaccttagactgttatcacccctcttggtccaggaagtttcatgcatatataattgtgatgtattattgcctcgaagatattgattgttgatcttccgagtatcgcattatactgatacggcatgtctaccacatcaaacactatttcctctttccttgcattgttgcctttcccaaaaaccacttgcaaaggtattttcccaattgcatgtacttgttgtccaccaaaaccttgcagaggcactcctgcacttgtcaatctgtcttcgggtatttgtatctttttgaaaacatcatagaataacacatccgctgagcttcctccatcaaccaaaactctttgaacttcgcattgtgctatttccactgagatcaccaaagggtcttggtgggggaaaagtattccttccgcatcttcaggcccaaaggaaattattgtcttcgaatgaactggtggatttgactgatagcttgtccctacatgatttacttgtctcacatatgcttttctttgtctttttgactcaattcacaaggaagagcatcctgttatggcatttatcaccctttttggagcttcttcgattgcttctattttcatgacttgtggtgcttctatagcattttgccctcgctgatctcgggccccctcatacttgttctcatattgactgacatgcttttccactaattaagccatatgcctacattcctcagtggaatggcctcctagaccatgaatttcgcaaaacttgctatagcattcttccgtagaatgaccacctagaccatgtgctttacaaaacttgccatgatcaagctgatattattttcctccgcttctgtcattattccaccattgtcctctacctctgccagaattccaccattgtcctcgacctcttgcagactgcccccaattgtttcttcctccacgagtgttttcccattgtctcttcccttttccttctccattatttgagtcatctccaatgaagtttacttgttttttctgatcttgcttgtaatcgttcttgaattttttttccatggttttgcagtgttttctgctttttgttcttcccctaaagaaacttgcttgttcttcgtctgcttctttcccaacaatgcagcctcttctgcttgcactcttagctcatcttcttctcctcttgcaaaactttccattctttcaaataggtcctttgctgctttggcctattccttgcaagatcgaaacggagagggccaggcaacaaagctctttttgctgatgctat

SEQ ID NO: 36405 - DNA, 1804 bp, Oryza sativa
tattgctcttgtgttgtttctagttgttgtgagtgaaaaaagggaaaggcttgatgctgttggttagggttttgcattgtctgatcatgtgatgcttgcatgtaaggtatattggcttggcgtgtttgtacttgaggaatttgaatatgtggaatttgcatttgtggaatgttggtttgggtttgggggatttggttttgaggaaaatgggtctggttgtaaaactgtggttgtatgagctgttgggtttgaatggaaggtagattttgagtagtttgcaaggtttgagtggattgcggaatttgggtggaaagttggttttgaacggattgtgggatttgagtgggaagttggttttgaggaacttcttgtgttgacttatcaactggagcattccctacttggggattctctttttccacatttccaacatttctttggatctctttcccgacttgattcggttgaccttcatcagtgtttaatgtctctgcctctctgccagatcctcctgctcctatggtttgatcatgcaaagcttgaagcctttgcaattctctttgcagttcttcatattgttctttgttcaccataacagccccttgtgcttgcaccatctcggcgagctctacttcacttggcgggttttctcttgtttcctctcttgttggactgacagtatttccgcctggcattgctttctccactctggtttgtgctgattgtccagttatctcttcccactctttcaagtgttgctgctgcgcttgcaaaagtgtcagtgtagcggattggcactgacttttgcctttgggaacgtttcatttactattcaagcccactccaaggagactacacgtccccacggacggcaccactgtcgtgacccaaggtcatggacaagattggggatagacgggaaaacacccttttatcacctatcttgagaaatgagctcgaataccaaatgaacacacacactaagtgacaagacttttagtattccgagatatcttgcctgctacaggctttttgtctgctttatatagttcacagctttacatgtgagattacaattgcgccctttgttgggcccacatgaaattacaatcatgcccttgctatatcagctaactctaagggcattttggtacattatggaggtcattatagtcttttggtgccagctggatgaagtggttgagtggtccttgggaatattctcttggcatctttgttgtccaaattgccttcttcatgatcaagagtcttttccaccaccataggtcttctcctcgaccgagggtcttttccaccaccatgggtctttttcatggcaaatagtcttttccagctcgaccaccctttccgacttatccggtagctgacctgttattaactcaggaaatacttaaaacggataatgagatttagtgacaagaatgtactcgaacggtattttccaactcgaatagtgttttccaattcgaacagcgttttaccgtttccctgttcgaatgaccatttgccactcggatactattctaactcaatctctttctctacagtgttttgggccgaatatagaggagcggtggtaaccccttgctacaacaaaatattatgacatttttataaatctaattaaatttaaaaaattttatagaaaagtcaaaacgattcagaataaaacggaggaagtactatagttgaaaggattactatatcatttgcgctcttccaagctgacaagcaattgcgtctcaacactcaacaggcccttgtttttgcgctgccccgagaa

SEQ ID NO: 36406 - DNA, 1767 bp, Oryza sativa
  unsure (1)..(1767): unsure at all n locations
ttagtttatattgcgttagttagccaatgattagtttgtcgacctggtatggcgtgaaatttcaaccaatcgtacataatttttgttcggtttatcctggctcttctacaataattgttgacgacacagcatattttgtataaatgtgttatatcttgtatacatgcatccgccaataaatcccatttgaagctagatggatacaaaaacatacaattaatctgatacgtgacagatttgtagacatgattaattgttgacatgtgaactctaggactggacgtttccaaaggaatctgaaaaaacaagcagttgctagcggtgggccgcgggtggtattttaatttaccgtattagcataccccagctggtgccgtcgtacactacctgcatactcctaaatgcagatacgtacagatcaagtgcacgcaaaaataaactaaaggataatttgcccatgtaatttttttcagataaaagtctcgcgcggtcggcatgtgtctgtatatactccgatgcatgggcgatttactcggatgaacaccgtgggcctacaggtaccggcccaccaccaaccacgttgtaccgcggtgttcacctcaatcagaacagtccactttcgcaagggacccgtgcattagggagaggtctcccgtttcaagccgttagcctctcccactcccgtacgtttctgtgcgttttcaatttcttgtgatccattggtttatcgtgttgggagatatttatacgctccgtgcgtccaggcaccgatattacagcgtatgaggatcgagatgcatggttaataatgatcatccatgcaaaggtaaaaggttcgtgcatgcaaggtattgcaactgccaccatgccaaacctgacgaaccaatgcttcttgtgcatattcctagatgtgtcggtctgatatagcctgatagagtaaaaaaaatgaggtcctggagagatgattaaattcgtgcagttactagccaacacagtcggcccgggtagcccgagaccacccaccgtggcacnacgcgggcgcgcgcgcgcggcgagtaaatatataggcggcgccgccgtctggttctccccggaacggaggcctctcgcgcgcaccgaacgtcgtcgtggctcttcaacgttgggatatatatgtccatgcacacgcggctccggtcattctatttccaccgcccgcgcgcacgggctgcacgcgcgcgcgacggccgcgcaccccgtgcatgccgcgcgcgtgaggagggtagggtagcgtggccgcgcgccgtgttccgacttccgacgcgcggcgcgcgcgatgtcagcgcggcccagttgtccccgggcgcgggcgccacgtcggccgggcgccgcatacgtgtccggtgaaccgagcgagagactctcctcatctcattccgtttcaccgctgcggctgcatctgcatgcatgcgcagcccacaccgtacccgcgctgttttgtccccatgccccccgctctcataaatctcagcatgcctatcgccatggacccccacaggggaggctataaaaacacggcacggtccctgtaacaaacagtgagtacccttcctccctgcagccgcatacacgcggtacatgagttgcggtcagtaattcgatcggctgtcgttgggagatcgggaagagtcgtcgccgtagcagggtagtgagggtgtatacgcgcatacacatacacatccaccagcccttccttttgtaggcgctccctgattactttctctctct

SEQ ID NO: 36407 - DNA, 14766 bp, Oryza sativa
cccatgccccccgctctcataaatctcagcatgcctatcgccatggacccccacaggggaggctataaaaacacggcacggtccctgtaacaaacagtgagtacccttcctccctgcagccgcatacacgcggtacatgagttgcggtcagtaattcgatcggctgtcgttgggagatcgggaagagtcgtcgccgtagcagggtagtgagggtgtatacgcgcatacacatacacatccaccagcccttccttttgtaggcgctccctgattactttctctctcttccttggactggcctcctccctctccatcccccaccatctttccttctttctttctcctttggaccctttccagttgtccacgctcccatctttttcaccatctcctcccatctcccctcccctcccctcatccggcgttccaccctgcccgcccttggccgcccggagtccccttccctacttgtaccagcccttcttttccaatttcatcctctccctccaattctactactcccatcgccacagtcgccaccctccctccctctctctctctcgccgcccacaccggcacactccactcggtgtgtgggagggagaggggaagaggaggccggctgcttgcttgcttgctagctagctagaattgcctacaattcagtaccgctgcttccccaattgctctactggttgcttgtacagctctacaagtacgcaattcaaggtgggggagggagccaagccggccggccatactagttctcgcctcccgagctctggtggtctctcctcctccagctggtgggcgttcaaggcggaaaagtaaagacggcggtgccgtggggcggcgcccatgcagcagcaccagggtggcgggtcccagtacggggccgtgccgccggacatggggccgttctcgccgacgcatcatgcttcggcgccggcccccctgccgctgagcagccggccaccgccggcggcgttgtctcagccaccgccgccgcagcagcagcagcagcaaccgaggacgagctacgacgagctggccgccgcgaccagcgccggcgcgggcggcttccccgacgacgacatgctgggcgacgccggcggcagcggcggcggcggtgggtcgggagcggccggcaaccggtggccgcgggaggagactctagccctcatcaggatccggtcggagatggacgccaccttccgcgacgccaccctcaagggtcccctctgggaggaggtctccaggtaagagagagacacacacagtgtgcatgcatgtgcgagcatggatgagagagagagagggggagggagaacgaatcccaaacacattcgcagttgagcagcacaagaatccttccttccgttcctcgggcataatttttccctgcagaaagcggctaacggtttcgtggaatttagcactcgtcccacatgaaatgatggataattatccagttactgcccccaaattctccaaaatttccaatttctctcccaactctaatcaaatacttctcggtttctgcgagacgggggaggcagggagtaggtgtaggtaggatgatgataagaatctgcgcgcctggggatcgtaccacggtgtgagtgctagcgcaggcaggcagcagctgctgccgcttcagtctgccacactgtcgtttttttgctttcatggtttccagtttttgggaaaagaaggaaggcagccttttgctcccatcccaatgcggcatcatcttaatttaagcatttcactccccctcttcactctcattttttttcactgccatcaacttcatcacatcgatctcctcctgatccctaaaaagacgagacggcctgtgattaactaatctcccttctgcatatacagcaccctcctccttgcctcctcttcgccattgtcctaattcccatctccttgtccctttctccccgggagaaaaaccactcatacgcagtcggccaagcacttgatgcttactatgcctctgcgttagatgcttctcctgcccgtagtaagcgctgccatcatttaatccccgatgttatttcaatctttggttgcacgcaagtgtgaagcggccggcggctgacagcaaagcttgggtcttttgtcgctctcgtgtctttcaggaagctcgcggagttgggctacaagagaagcgccaagaagtgcaaggagaagtttgagaacgtccacaagtactacaagcgcaccaaggaagggcgcgccgggaggcaggacggcaagagctaccgcttcttcactgagctggaggcgttgcatgccgctgcgccgcagacgccccagccgcagcagcagcagcagcagcagttgccgccggttacaagcagcgcacccgcgatgcacgccttcgcgccgccggttcccgcgccaccgccgatgagcgcaatgccaccgccgccggggccgatccagccggccccgatatcttctgcggctcccgcggtgcccctggagctgccgccgcagccgcccatcaacctgcaaggcttaagcttctcgtccatgtcggggtccgagtcggacgatgagtctgaagacgacgagatgacggcggagaccggcggcagccaggaccgcctcggcaagcgcaagcgaggcgccggcggcaaaaggctggcgactttcttcgaggggctcatcaagcaagtcgtcgacaggcaggaggagatgcagcggcggtttctggagactatggagaagcgagaggcggagcgcacggcgcgggaggaggcgtggcgcaggcaggaggtggcccgcctcaaccgcgagcaggagcagctcgcccaggagcgcgccgcggcggcctcccgcgacgccgccatcatctccttcctccaacgcatcggcggtcagtccgtacaggtcccacccgccgccaccgtcatccagatgcccacaccggtgcagctccagacccctccgccggtcaagcaacctgccaggcagcaccagccacagccaacgccgccgccgccgcaggcggcgccaatcccggccgcgcccctccagcagcaaccgccgcagccgcagcacaaggagacgattccccccgaggcagtgacgccgcgcagggcgccaccgacgtccggctcatcactcgagctggtgcccgcggcggagcagcacgtcgagagcgggctaggaggaggggagggcgggtcggcgtcgtcgtcgcggtggcccaagacggaggtgcaggcactcatacagctgcgcatggagctcgatatgcgctaccaggagaccgggccgaagggcccgctctgggaggagatctcgtcggggatgcggcggctggggtacaaccggagctcgaagcggtgcaaggagaagtgggagaacatcaacaagtacttcaagaaggtgaaggagagcaacaagaagcggcccgaggactccaagacatgcccgtacttccaccagctcgacgtcatctaccgcaggaagcacctcaccggcggtggcggcggcggcgcttccgcggccaatgtcgccgccacggcaatcgagcaccagaacccgaaccggcacgagatagaggggaagaacataaacgacaacgacaagaggaagaacggcggaggcggcggcgcgcaggtgcccaccagcaatggcgacacggcaccgaccacggccacgttcgacgtcgatagcggcatgaagaaggtaatctcaattctcgcatagtactctccatccaaccaatttctgctagcgtttcaagctcaatatgcgaatgttcgtgcggaagctaaccggaaatccgcttgccgtgaagccagaagacattgtgagggagctgagcgagcagccgccccgggagttcacaacggacgagaccgacagtgacgacatgggcgatgactacaccgacgacggcgaggaaggcgaggacgacggcaaaatgcagtacaggatacagttccagaggccgaacccgggcggcgccaacaccgcacctccgccggcgacaaccccggcgtccgcggtgccaacctcgactccgacgagcaccttcctcgccatggttcaataggcgcgcgaacgatgcatcaccaagtacgtacttgttcaaagaaaaaaaatcaaagcatcgccatcaccatcgcatcctctcactacaccaccaccaacacaaacaccatgcatgcatcagcaatcagcaaccactctccttcgagttgggatctctcctgtaatgcatgtgcggtaagtgccaatgacatgtgggcccggaataggtgggacccacatgccagtgacaccagtacagcagtggatttgcatccctctccttcaccttgtaattctcccgtgccattccattatttattgatttctctgtgtaataagagccctccctgatctcaccttaacccgaggaagcagagggggtggtagagaaaatgagtccgggtaactttatctctataggtcacctcgtcgtggtaaaggaagaattgtacatcgatgtaacagtccctgatgtctctgttttttttttctctctctctttttctccttcccctccggcgacggcggtatacaagtttgtatacgggtatacaacaattacatacatttccagcaatttggagcagaggtcagaaggtgtcttgtttttgtttcttttctttctttgccgtggggaattttgtctccttttaacccgttttttttgcagtggtataaaacgttgttactgtgcacattgtgtggttactcttcgtatactttgcatttttgctcattgtctctgcaattaatgtagagatttttgtgtactctagcttggttttgccttcctactgagaagctatttaattaagcatcacatgcatgcatcccaaaatgactgcagaaatttaccagggggatatagtattatagtactactacttgcagggttaatataaaaaatggaatgcttactatataatcaataccataacctttgttgcttttttgcacttgtttttttccccagcgggatcagttgacaattcaatagtttcttttgccagctctaccatcagtcgtcgcttcacatgatacagtctttaatagtcagtccaagaattgtagaattattctgtagtcatactgtagttgttctgatgatataactagagcctagatcgaagggatataagcacatcactgttgctgtgagcatgctgcaggcatcagggaaaactatatcctgtaagaaaaaatatacttcaaaacagaaataggagcaaatctaaatgcatcaatattttttctagtagaattaatcattcaactagtatttttcttgactgaatagaacaaaattctatgaatgagccatgtgaaattaatggtaccaaatatgttacgaaggatatcttaccaaagttaaatgtgtgcagccttagcgtgtgctagggagctcaatatcaggtgtgtgaatgtgatatgcacatgtattgataagcatatgctatatgtgtgtatatcttccgactaagaaaaaagataaattgacagtctttgtaaaaaagagataggggtagcagcattcttcttatgagtagagggtactgtagatggtaagaatcaatttatttggattgagtaagtacgcattttggtcctcatcactgaactggaaatatagaaatttgatgtagaaatggacaatcatgatttttttttaaccgctcaacttactgctagtagtgttaaataaataagtttattttgggatggaagagtacaccttttagaaacttaagaaaatttatatatccaagtagtactactccgtaattttctctaggccaaaggacaccgagacaagatgtgatgtgcatgtcggcacgtgtcaggctgacccacgtcccgttgaggcagtttacactttagccctcataaacttgtttgttccagagagggcccatcgcagactagggaaggggaccgctactgtaaatcacaagtctgttcggcgtttgctcctcgatgcattgaacgccaacataaacagacgaaaattaacagtagcatcagatcatatttcaggtattaattttggcacatcaccaattggaacgcgtacatacttcctggacatacgtggtattttcgttcttccagtaccagtatactttcttctccaaaaaaaacacattttaaatgtggatttcatacataaacacaataaatctaatcgggtttgtctatattattgtacaaggttgtgtcacattttttttaaaaaaaattgggacgtaggaagtatgccgtaggcagtttttgaaccatggggagaggcaaaaattatcgaaccatatatatagaactcagaaattaatggtgatttaataggatctaagcatgataatggacctttatatcatgcgtttcttggaagtaggcatttcttttataaccaatgtgaaactgcgtatttaaattttatctagagctagatattaaaattttgattagattcgatattgatcagttcataatatagccgtacaatgtactaaaagcgtaatccattataaatctatacttagggagtgtttgaggagaaggggattgaggagattgggaagatacgcaaaacgaggtgagccattagctcatgattaattgagtattaactattttaaattttaaaaatggattaatatgattttttaaagcaactttcctatagaaattttttgcaaaaaacgcaccgtttagtagtttgaaaagtgtgcgcgcggaaaacgagagccaatctcccctatcacccctaaacgaacgatgccttacaccttgatttttctttttctttttaaatttttgggtcaaagactgaattcttcagtgatagtataacttgttgtgaatatctacatgtattttgagaaaataaggcagtattcccttgaaagacaaaaatattttttcatgttaaattatttttgcatgattagttagttatactccctctagttttagtgttttaacattgttaattttttatatacatttgaccattcatcttattttaaaaaattatacaaatataaatcttgataaaacatatcacaaaacataacaaatgattacttttttatatagcgaattaccaaaagcatgtccaaaagtcaacgatgttaacaactaaaaaactaagagattatgttcttatgctaaattacatataccttccaaaccacataaaaactagtcatatcatttttacactataaagtacctacacttacattataattataatgttaatttgaaaacttacacggtaagtattgtaaaatttctaatacacaacatataagaaaattaggattaaaaataagttactatttacttaaagtagtagataggataataatatgtgagaaattttatactccttgagaaaatatttcgagatacctaaattttacactaaatttttttacatcgaggtactaaattttaattagaaaatatgatacctcctgatatctttttacccaaaaacatacttatatataggagagggagcaatcgtaaagaaaaaatgactgaaattaagagaaaaatacgacgctataattttagcaatcatgttgaaaaaatatgtggtcaagcgaagcccgcgtagcgacaccaagagctcaaatcaaatcaaaagggatacaaacgggaaatatttccaattaagcgtaaccaagctgtaaaaggctagtaaatagtatctaaacaaatcaatcgtgcaattcaaccggattagacagcaaagtgcagactaagcgaggccaagtcaccactcgcgcgggtggataggctgagaattaagaacgcgcacgcgcagggcgccagatacaaatcaatcaaggaacagggaaaagaggtccctggttgcgagctccgattgaacccgaagccgagaatcattaggaggcggaaagtgaccgtaaattggcggtaagtggccgataatgaccaccatgctgcctaacaagacgacatcatcggttcacactgaagctcttctatacttatctctcctcgcttttttattttgtccatctttttcccggtatgcaattgtgtaggaatatgaaacaccttaaacttcatgaggaaacctgccgagtcaacatggaaattaagctcgtcaaaaagtgttttttttcttgctaaattatgcttagcttttaagtagtttgtactttatggaggacgccgacatcactcgagctacagtaaatccagcggagttcaaatcagcagggttggtgtacagtgaatccagattctttttcctgggatttacatatgttccaaagtactaacagggaatcgtatagaaaaaaatattgctttttattgcgaggaagaaaaaatagtttgttgcttcgagtagtttctccaattttcgtcattatattctgcactggctcaaagttaaatcgggaccatgcgccccacgaataactcagcatctcgcccatgggtccatgcatgtcgcgaaaaatcaaggaaattcatgtcttaacagtttggacaaatcaataattgttggatttatactcgttctctgaagaaattatatttgttgaaaatttgcatctactctcaagtttttgcacataaatacatacatcgatctctgatcaagtgtactcctaattgctagtatgtgattgcagcctactcgctagtaccaatttggatcaatttcgatgtgttcgatcgataccagtaccagcaataaattcgtaaccgagctagattattattacctagcacgtcactctgcgtgcatctttcctcaagctaataggaaatagctaatccctccgtcccaaaaaaagacaaaccttggttttcgtgtccaacgtttgatcgttcattttatttgaaaaaattatgaaaaaaattaaaaagataagtcacacataaagtattaatcatgttttatcatctaacaacaacgaaaatactaattataaaaaaatttcatataagacggacagtcaaacgttggcacaagaacccacggtttgtctttttttgggacagagggagtaggtcgctactgctcctgcacatatgtatcactgctgggatgggacaatgtttacctaacaagtaatctgaggcatctgtacgtattctgtggcaccgtgtatacaaacccacctaacgacgatcgatcgctaggtacccttacccgttagtagttgtcacatgcgtgcgctagctcatctatgctaggctacacatgaggatgtatgcttgcatggatgccacaatataatgccaccccaccgtagctatatatgtttgtccaatccacatccaccctcctttgcctaataccacggtcgcatgcagtgttgggggagtggcttcgacttgaacaagagagatcaccggtaccccctattaatttcctagagtaaccttgctcctcggaaatcaaatctctcagaggcctttcggagagcctccggacgtgccaagccacaatgcgctttggtaggttccggcggctctggataggagtccaaggcaaggcatccgaagaccccggccctggctatggagccaaagatccaaccacggaagccgcccgtgggagctttaatggcgcattgatcgatgtgctcagctacctcctaacaccctccgcacaataggtggggttgaggccgagacgtctcgttatcacgccatggcctcgagaagtgcaccctgcggaacataggagtcctcgagatggcagtctaatggctacaattccattcgttgtcccctagggttttacctcactacccctacctaggggccacctgttggcttctaccaaggggtaggcttagggagggcaatttgactcgtttacccatttacatgtaggtaaaaacctaatagagttgggtttgttctctatttagtacccatgggtttcttgttgggtcaaaacatgtacccaacgggcaaacgggcacgggcatgagtagtcactaactgacatgtggaccctcagttaatttcaatataaaagccaccacctagaattccagggtttctttcctttccttcccctttcctccacagccgccagccctaatttaatttcagtataaaagccaccacctaaattgatgagcttgtaatgtttgtatggttgaagtgctgaactatctcactgcttgtggagaattgtggttgaacatgtggcgggtaaacgggtgtgcccgcaggcacatggctcccgcaggtgacaggcatgggcagtgttccttgcccgtcatgtggtaataggcatgcccgcgggcgagaattacctcgcgggcactgggatgggtagtcacaacccatgcccgtcgtgcccgattgccatccctagataggctaaggaggaatactgctgtaattttctataactttgtactaagtgctatataactagatctcgccccccatgagggggcagatgaaagagagaaaccataccactctttcccggtgattggatccccgttggatttggttccaacacgtagtctcagtactccaaacaagtttaactaggaggaatgtaaccgtaatttagggcttctaatggttacagcttgtcccaaaaaaaacctttaaacaataacttttttatattctaaaaagatttaattgtagaattcagaaaataaactaaaacaaagatgaaaaaaatcaaactcctcaaattctcaaaaggtgactaccaattagttacttttcataatcttaagcttcttcaatcaggctcttagtgaagaattaggtagtgagtgaatcgaagagaaattaattaatcaggagagaggctaaattggatcgcggtaacttacggatgggatgagatgatagggtaagctatagctaggcagcagacgaacgaacgggggagcgcaatttgcatgactccatgttccgttgtcgatcgatcatgtcggcggtggccctcaccaccacccagcagctagcaatcgagctagtgcgcatgcacgcacagtcacgcacggcacagtgccttacaacccatgcgtagtatacatgcttcgatcggttgctgattagcccggccaggcggtgcgacgcgccgcacgcgtcacgcccacagctacctagctggctaccgctatctagcttaacccccacagtacaccaccaccaggccaggacacgcagcgcagcgccggtcgcatggccaaaccaaaaacgcattatatgcgtttcgtacgcacgcacacgcacgttacgctagcaatcacgtactctctcaaccataattccggccgtcccggcgctgcgtaattcaccgccgcctctcatgccactgctaggagaacggttttttccgtgtggtcaaatttaattttcacgtgtgatggaaaaatcataacttttgtgaatgggtggtgcacccgcacgtaaaaatcggtgcaagtacttatgttgcccgcacgaaaaaacaaaaatccggaaaaaaattcaaaaaattgaaaacctagaatccggcgccgccgccgccttctcatcgtcatcgtcggcctcctcctcctcctcgtcgttctcggcagccgaggatgctgctcccgccctcatcgtcgatggcggaggcctccgcgctcccctccggccgcaccgttgccgacgcccctcccctccgccggatatagggagggaaagaaggggaggggagccggatccggggggaggggggaggcccccggatccgtgttcccctacggccgcactgccgctgccggatccgtgcgagggttggccaccacccaccggatctcgcacgccgttgccacaccaccgtcgccacctacgccccccgccgccgccgttgggactcgggaggagaggagaggagaggacgggaaaaagagatagagaggagagaagaaaaagagatagagagatagagaggagagaggagagaggagagaagagaaaaaagggaaaaatttaaagtgggtaggagtgcagagagagtgtgtatttttttgcgtgcggctctcttaataggctacacgtgaaagcttattttttcagacgctctacaatttaaataggctctgttcaggaaaatcgttttttagcggtgcgcgcgcggccggtaaaatctcgcgcgcaccacaccactcgcgcgcgcgttgtacgtttggcaggagagaccacgagcacgtcaacgagcgtacgcgcgcgcccaacggcaacggatactgcgtggcgcgtcgtcctcgtcctcggcggccgatcacatgcgcgtcgccggtttcactcgctcgctcccgcctcctttggatttatatacaccagcactggtgcggtcgtcacgtactttttggtttgtttacatgatattcccttctgctgctccctcttttggtggatgaagtcaaactgctctagctgttggggttttattccagcataattttgagctagctagctagccatatgtacgtacgcatgtataaatacttggggtacaatggatcggagaagataattcgagttgttttatcgaccggaaagtgcggataatccagatagataggcagattagtattagatgggggaacacttgtatggatgcctttttttcgatctttcggagagacagagggaatcaccgcgctagcaagtatctcccccttgtgtattcgaacacgagatcgattgcgattatgagaagatgtagtaacttgcaagtctaggtttaaatactggactggaccaacttgaccccgaataaggtactactattcggttgcttcatcactgcttgaattgcctatgacactctggcatcatgcgtctgtttacccccaaaacaaagcagcgggctccaggtagtactatctatatatgccaggataactacgcgtagtgatgatcaatctaggtatatattgcgccgatgtgttctttactttaaagtagaaagctttagcattcataaaacccggccgcaatccgcacgaacctttgtgagctgtgacatcatgcacacaacgcttaaaatttacagttcggatttgggggacaagcccatgcctcatcaggttttttttttagtaattcttactacatctcatcagatgcagatgggctgccgctttggcattggactaataaactaatgcctcatgatccgagcttagctactactaccctcctcccctttttacatctgagagagagcgatgctttgatccaaagtcaccatcacatgcgcggctaaggaaaatggagttgctcctgcctctccttcccctccctctctgatgtgagttgctatcaccgtgacaacataagcagcaggcaacttcagattggacagacactaaagaaaagaggccagtggcatggttaatcttttttttctttctttctttctccctcactggctttattcttcttttagtacagcatgagcagtttgtgacgctgatgatgcctagtaggggcccctagcaacatgcaactgggaattcaacttggaagtgctgaagaagaatattatttgttcttactttcagtgtcagtcagtgcagccacaactgaattttatatgtccagctgattgggagcttggagtcactcgcatacccagctgatgtcaacagattggatccacgggttcttttgaagtggataggtttcctttcccttctacgaaacttttcacagcatgctcttccttttatcgtgttcgaaaattcgatgcggtaactttttgttgtgctaaataagacgatctagtgccaacgcgtcactgtgacaccggccagaatagttagttaccttaacaccatcaaagtagaagcgtgtccaagatagtgtctgttccagcccgaagccctgaaatgtagttccaaccggatgtttcaggtcagggacagacagagggactacatgattctgatcagtcatgattattaatgcagcataaataccgtaaacttttcttgggaattcacaaacagttggtctaggtttcaaaaaaaaacaaaaaaacaaacagttggtctgatgagaaaaatatttccgtttgttcagaagagtaaatcagaatagaaataacctgtagaataatagaattacacgattcagacttcagagtgttagtacatagaaaaaggcccattcaattcgtatggtcattgccgagaggttatgggttctgatgtggtctgagcctgcctcaggttagaacgtgtagaaggggaaaaatttggaatagtctaattcatctacctcatctcatgctcctgattaaatcgcttccctcaatcataaagctaggtataacgtctcccccgactttgaaaaccgtgcaaatcaactcattttatagtttagaaagtggtttccgcttatgtggcaggttaaccgcggtcgactcgctgagttagtaggtccaacttgtcaacgacttctgcctcatctcatcttcttccttgcccctcctatctctctttcctctcttccctcttcatcctctcttgagttatgtccaggtgaggccaaagtggagctcggtattgtggagccagctgaggtggtggcgtgactagccgatgcaccgatgaggaggtacggacgccgaagatgaagaccatacatggcgggggtgggggcgggggtgggggcgggggcgggggcgtgtggggg

SEQ ID NO: 36408 - DNA, 11363 bp, Oryza sativa
  unsure (1)..(11363): unsure at all n locations
nnnnnnnnnnnnnnnnnnnnnnnnnnnnnnnnnnnnnnnnnnnnnnnnnnnnnnnnnnnnnnnnnnnnnnnnnnnnacagcctcccaccaccgacaaccaaaacctatatatccttcttgaggcaagcacaaccatccccaaccccaaaccctcgagacccaaattacgcaaaccctaggatgcattttcttctccccagtacccacacttactgcgaggccaaccaaccatgatggtgcagatgctgggtgttatgtggctcaacgtccaacgagaaggaatgggctaccacgacaggggtggggtgtagtcggccctcagttcgctatggacacgctgtcgtcggtgtccttcctcgccattcggcgagggttgtgggagtggggtagaggtgggcagccacaatggctggtgtactacaatgagcgggagaggtttaggatggacttggaggcgctggccacgttgcagctcatcaatggaagagggacaaggaagaagatgggatgtggtggaggtcgcttatatgtgggtctcacctactgactcaacgagtatcacagttaacatgtcatgtcagcataaactgctttctaaactatcaaaggagttttctaaactctcgaaggagttgatttgcaccagtttttaaaattgggggagatgattctatcatgagaagacacagagggaagcaaaataaacttattgcaagaaattcagaagggctacctgggcttttgttcggactgtttacaggcttcgtgagagtttacgggcttcgccagattacagtatagcccatacaaatatcatccaagagaatacaagtttttaccaggtccacgtttccgacgaagaaggggaaatttcgtagtgtcgacactcgacacgggacaaaaagcagatttcgaggcaggttttgaacggtttcgatagattcaaattcaaaacaataaattcaagcaaattttagtcaaaatttcccaaaaactgccttaccgccggagatcgggatcccgtggtccatccgaatggtaaatcctggcttgtccaaaatcttacaccacgatctgtagttgctctgacatattaatctctcaaacaattacagtaaatatattgtctagctcgagcacagagcactgttttgtttgctttcttcaacttgcctacagtattctctgtttgtaatggcccctttgagctacagaattcagacaagacaaagacatatcaataatcttcatccagcagtgcaaaacttttgccttgttagtcagaacgtcttatcaaattgaatacactaattatccgatgggatactgtatctagataatctggccggagacgtatctctgtgtgcttctgtacctgcctataaatatctgtagcgcgttgacgcgtgagtattattagcatgtttcattcaagtaacacattgatttatcattcgtttccaagccatgctttctcagggatgttcctacacagacagtgatacggacgtgcgaataaataagactatggtttttttttatcaaaccctggaattaaacaagcgattgccgcatctttgtaccggttagttgacgaacagcaagcagctttgcaatccgagcaccgagcacggagcatcccagtggaagtttccgatcgcaccaaaccgatcgtgtcacacccggaccaaagacagcgattatcttttgcattttgcacggaggacacgaacttgccgtgcgaaaagagtgctcctcgtcgtactggccccggatcggcaacagtgtgacagtccctgatactgtggttgacacattacgacaggatggctcgagacaagagtttgttattcgtcagacgtcgatcgatcagtgcgacgccgacagggcgacaggcgtattgccttgttggacggtgtatgcacaggcgatctaagagaatgcacagcagtttgttcaaaacggatcataattttaatttttctgaattttgtaaaaaaaaagttggatacaatagtttctctataaggataatatctccgtttttaatatataacgatgttgacttttgacaaacgattgaccatttgttttattcaaaacttttgtataaattaaaaaaattaagtcatatttaaaagaacatttgacaataaatcaagtcacaataaaataaataatattacataaatttttagataggaccaatggttaaacgtatatcaaaaagttaacgacattatatattaaaaaacggatagagtaaaaaaaaagatgaaatccacaaaaccaaagtcctcggtctccacacctacaggaacatgttcgctcgcaataggcctctcgcctgtgatctcatggaggggagggtgggcgattgcgcgggagagttttgttattttaggagttaagtttaagctatctcttataaagaattatatcttttatgttctcattggaaattgaaaaagggatttaggggatagaatattgaacatttgttggtgaggggagggcgcgcgattgcgggagagacttttgttattttgttaagttctcattgcaaattctaataaagggatttataggggataaatgctctaaaaacaaatcactcaaccggctatgagagcatagacgattgtaatatataattgagatatagcacttgaaatgaaaatatacaattgttttcagttcttggtcggctgaaagatagatagtgataagcctaggaaagagtcatattgaagtctaatttagattaattcaattcttaaacaagatcacctttccgctttgcggaaaattactgatttacatacctccttgggaagccattgaagctgatacttttggttcttctacttttttttttaaaggagggcaaaagctttccctcgtatattgatagagatggagaaaaatatagagcgacagaaatatgtacatggctagtctaaagaactaaacccgtaaaaagtgagggttaagtgatatcacctaaaattccaaactcttgaagcttcgaggctcctgcttttacccatgcccgaccttcctccttgatcttagcgaggatggaagccggcagtgaggcagtgtttcgaaagattcttgtatttcgctcgcaccaaatttcccaagaaaccaagatgaccaacgttcgcgtgggaatgcgggggttgttgggagagtctaccacaaggctccaccatagttctaccgagtcgcaattactccatttgttcatttggaggtcggtttgagtccacctttgtatttctgtctagaccttctttgtaactctgcagtgtgccagcaggtgaagtgttgactcgtcgattatgcagcacaatgggcatatcttctggttttgtcatcctcttttctcaagtctgtcagttgtccagagcctgttttggatagcgagccaggagaagaatttgcattttggcagggcccacgctttccagatcatttgattgaaggcagatctcgtggcccccataaattggagcctatatgcagattttgctgagtattgtccattagctatcaaattccagcgaatattatcttggtcttcagtcgggggttcattcttctgatcatagtccataaacggacgaattgttgcacgtgatccccctgagtgatatggaggatgtcgatgtctctgacccagttgctttcttgtagtgcatcatggactgatctattctttcgttttgaggctacatagatgtctggagcaatttttcgaggagtttggttctctagccatttggagtcgcagaaacaagcggttctaccgttgctgattgttatggttgttacaactgaaaaaagctccctgtcttcctgattgcacagactgccgttcccacccaagatttctccggggccgtccattcataccatagccacctaagccgcaatgcggatgcgaagcgctaaaggtctattactctcagccatcccaggtctttgggcctgcagattctttttcagttgaccttgcatttccccataaatgttttttcttcccgcccagagaaatttccttcttattttgtcgatgtctacttgccatgcatgatgcatccttttgttcttcttcttttctttttgaatcctccgctttgagtaacgccatagtcgaggcagatatgttggcttcatcaagttatggtcgccgatatcgatggttttcggccacctgtacttgcagtgagatagccacacgaaccccttttagcatatcaatcgggcgattaggttttgaatttcagcgcatcccctctcccctacgacctccccgttacattacatagtgtatactagtgaggctcagcggtttatctcctattaaaatttaattaattttcgcactgatcaccaaaagaacaattttatcttttttttcttgttaggaaagaaaattgattagattttatctcttaccaaactgtattggtagtatccgataaaatcaactaacaagtaacagatgattatggtacaagaggctagttctagttctacttctacttctacatccgtcccttgctcatagcctcatatgcttagctggctgactttgacagcagcacaaagagaagaaagttgcctcttttttcacgcgtacacgtctcaaatggttaaatggtgtattttttttaaaaaaataaacaaattacttttaaaagcatattaatttatttttaaatttaaaataattaatacttaattaatacgaatgatgtattttgttatgtgtatcttcctaatgttatcttttactccctccgtcctatattataatggattttgggtggatacatcacatcctggtactacgaatctgaatatgcccctgtccagattcgtagtaacagaatatgtcatatccacccaaaatcacttattctatgggactgagggagtactttcctaagaaacacacatttaggcatgtttagttccaggggtgaaaagttttggcgtgtcacatcggatatacggacatacatttgaagtattaaacatagactaataagaaaacaaattacagattcttcttgtaaactgtgagacgaaattattaagcctaattaatctgtcattagcaaatgtttaatgtagcaccacattgtcaaatcattaagcaattaggtttaaaagattcgtctcgcagtttacacgcaatttgtttaattagtttttgtctatatttaatactctatgtatatgtccaaattaacattcgatgtgatatgatgaaactaggaactaaatagagcgttattactgttcttgctcttacactatacgacaggaccttgatcgacgtacgaaagactgttgcgtgggccgatggcattcagctcctggcacgaagcttccgtctccggggccggggcgccgggctcgcgtttttctatcgcgccaaccgggccccgtgtccgtcggaaccgcgatacactggcggtgcgtgcccgccgcgaggtctacaggcgccgggcgcgtcggtgatccgcgcgctgcgccgctgttcggtccccctggcgcgcgcgcgcatggttgattagccgaaatcatcgcaccgcctggatttgtttccggataaacggagcccaacagccagagcagatcagcagaggtcgaattagagattggattcggagcacacggccgggtgggtggcggtggcgcatgcatgcatcagcatgcgcgcgcggaggagagtcgttaggtgagtcaacgtcggtcgaacgagccggaagcgcgtgcgcgcgggcaggtgctcgccgtgttcgccttaaatttgtagtatcgcgtatctggttggccccctgtagatttcatgggcgtttttcttgtttttctgtgtcccgtggcacgttgcaaatgcgaaggtaggttgggcgcacaccgaagacgcgcgcgcgcccgccgacgcgccttgcgcgtgtaacaacaaatctgagtgcgctgcagtgcacggtgagactgcacacaggagggaatcttactatgccttgtgagcagcgcgctgatggcttctgtagcacgcgtggtgcaaaggtgttcgtgcctgcgcgagtggacgacacgtggtaggtggtgtttgtcctcgcaacctgctggtttaaccatcttggatagggtttgttattactcctactgctgcaatccaaccactgaaataagtatggcttgtgttaattgtctcctagtatcttcaagcatccaagttgatgtagtttcatgtcttagagaggtgcactgcgaggttattactgtcctccgtgagcaagtaggatgtaaaatgataaatttatggctcgtctgtattattattataattattattttgtttcattgtttagaagacaaatgcatttttttagctcagtaattttcagaagaaagaccaataatatgaaagtagtagtattacctatgtccaaaataaactacggggtgtttggttcatgatcacactttatcacactatactttgtactactacaatttataggtatgtgtttgatttacttccataattgtggcttgtcacatttttttaataacatgcctcatacatcatagactcaatttccttatcaactttatcacactctatggctaacaatttatctaccataacttttgtggctgctacagcttatctaattttagttgtggtaaagtgtatccgataaccacgctatgttttttcgtttttctacaaattcatagtcaacacgtagaataaagttttcgttagatagaggtagtagaaccactttactagaatgctactagtagtcatttattaatcagtgtcatcttgagttctcaagtatggtcaagagagcacgtttcgtagcaaattcaggaaataaaaagatcagaattaagaaatagaaaagcaaatgcaggtgacgtccttactcatcatccctcgctgaaagaatcgcctttctttttgcacaatgattagtggtggtccactcttacaataacacgagatgcaaagaaaggcagccacaaggcaccaccctggcatatataaacctgcaagtatgcatttgactcgtagcaagttagcaacacaagagccagggaagccagccactagcaattctttgatctggatcctctgcacaacctgtccccttcttatccagtaaggcaaagccaagaacgtagctacaactaacagcaacaaagctgaaagctacacagatcaacgagggagaacttattctccctccactcacactcctcgcctcgcctcgcctcacttgtacccttcgattctctcccgtttcgtcgccctccagagctcgtggatctctcacttcggggcgggcgcgcgctagcacaatgttcaccggatgtggtctcttcgcctgcgtgcgccggtgcgatggcggcgacgtcaggaagcgcggggaggcaggtgcaatgagctcgcgggtggcggccgatccggccggcgtggaggaggaagggagctgcaagaacgtcgccgccgcgtcggcgaggcagctcgcgtgggcggacgtggagtccgtcacgggggggttctcgtcccgggtgatcgggcacggcgggttcagcacggtgtacctcgcgtcgctctcgtcctcccgcctcggcgccgtcaaggtccactgcagcagcgagcgcctgcaccgcgccttccgccaggagctcgaggtgctcctctccctccgccacccgcacatcgtccgcctgctcggctactgcgacgaacgaggtaattatcatcgcgcatcaacaccagattttgcaaagctcgctgctgaattaaactactgcccgtatcaagtgtgctaacgttcttgcgtctcgatcttctcacagatgaaggtgtgctggtgttcgagtacgcgccgaatggtgacctccacgaacggctccactgcagcgaggtcgcgggcggcgtggcgtcggtgctgcctgggcgcggcgcgtggcgattgcgttccaggtggccatggcgctggagtatctccacgagagccgccacccggcggtcatccacggggacatcaaggcgtccaacgtcctcctcgacgccaacatgaacgccaagctctgcgacttcggcttcgcccacgtcggcttctcggccacggtggggtgcaggccgtcggcgcgcgccgtcatgggctccccgggatacgtagacccacacctcatccgctccggcgtggccacgaagaagagcgacgtgtacagcttcggggtgctgctgctcgagctcgtgacggggaaggaggccgtctgccgcgacaccgggcggcgtctcactgccgccgtaggtcccatgctcagcgaagggaaggtggccgacgttgtcgaccggaggctcggaggcgagcacgacggcgcagaggcggctgtcatggcggagctcgccatgcagtgcatcggcgacagccccgggctgaggccgtccatggccgacgtggtgcgcgcgctccaggagaagacctccgcgttggcttcggccgttggatcgagattggaccgcaagatgatgttttaacttttctgggtgtagactgtgaatagtaccagtattttagggtaggtaggagaagaatgtgtgtactgtgtagtttgagaaggtagattagtttaagcctttggatcagatagaaaattttgtgatgtcatggcatcttgtagcaccagtgaacgtatattagtagttcagtaattaaattctttccttgtagatcgcgtgtattaggtagtagtactttagatggttggtggtggacaagcaatttggtttcattttggttgatgacatagtcaaattaatctgctccaataatcaccaactaaataggtgtcggtagtcggtacacatgcatttgacattgcaggataggattaaacaagatcaattatttgcctgaagaaatgctcgaacgatgtttcaccaatacgcattccacataatgctcaccagaaagctttatcgccaaagctagattctacatgtgtttgtcgtgtttgagtgtgtgtaactctctttttctcctttatgtgtttagctagcaacagtgaagtgtctgatttgttggatacctcaattcatcttagcagtattcaaaggtgtgctcagcattttttttcctgcatagaaagagtcattgcacaatgcactcatataatctaaatataactttgtcatgtattttaccgagatatgctacatttttcacttgctgactgatttttttttctatggtttcacacttcacagcactgaacccacgagaaaacagagcagatggcaggacaacaatcactatccgtgtgcatgagtgcatttgtgaaagcgtggatcgtgtggtgttttttcttcttaaaaacagaactgtggtcagcgagtaacgaaaattgacagccataagaaggaaaccaatgaaaatgatgcagattaccaccaaagattagattaggtgttgcgtgtgacatcctaacgaaccagtaccctgtaggcgaccagaaattagaaaaaacaaagacatccgacaaagagaaccaaaattatttggctagctgtgactcataaattaaaggccttgctgttgcagacttgaattcgtacaagtgtgcagtaggtgcccaaagcaacataaagaagtcacggttacttgttaggacgaaggcttatctgaccgtagatgatgtttttttttttcctgatgcaaatggctttgaggccatagcattctttgtgattagtaatatgaccacttgttcagttgtagcttgatgtcgctgtgactgtgaacatctagagacgagagatacggagggtgccccgttgaacacttgaactagaacttgtatctgtgctctgctgcctctggatgaaaatctgttgatttgatatgcctggagctgcaggtccaagactgcatgaactctaatgcattatacttagtgtcctagtgcaatggtatgttaaatacagtgcggctaattaagagcggcgaatcggttgagttcggatgtttcctccttcatagtgacatgcaagtcatggctgcatggctgcattggaccaaactgaaacccactgaaaatctgacaacggggcaaggggtgcgggcctgttctgctgactgctggcctcgaaaatggttagctgagggatgtttttttgtccacaattaaaatctcctactaacctattgtttatgagctgtttatacgtggtctctgttccaaccacgtgcagaatggatcttgctttgcacagcttgcgtcaaagaacaacggatagtaaagtagcataacagtatgtgcatgcttattcattcttttctgtaaagaaaaggatatgtgcctgcggcgaagatgagcgtgcctaaacaatggaccatctgtctcatgtgcgaaaattcatcgtaaagcgaactattagtttttggcagtagagtaaaggtcataaaggtccaaggttcaacacgggcaacatcagattttcacttttttctaagggttattataattcgtatatctgtaaaaggtgactataattttacagtaatttaagatatgccaccactaaattttttgattgattcatccttgtcttcttcattcttccttcctctctcttcctcatgtctagataccctctcgcggagaaggccgccacgtcaaagctccttttacatggaccatgagggagagaggggaaagaagaaaagaatgaggaagaagacgagggtaaaatagtctaatttttttagattgcattgaagggataaaagtgacaaatcttaaaatattataaaattataatggactcaatataaataggcgaattataggatatattcccaccattctaaaaagagctaaccttttgttcagattcattgtactaggaggggtcatattttctcttagattgtttttttttggacggagggagtatttttaaactagagaatttataatgttggtatggatccttaaagtttttctaaagcaaacgcacatactacaaactgccaccgcttttgtatccgatatctgtctgtattcacgtacaagccaactctgaaatctggactatcgcaattctcaatgcttacataataaggactataattccttttcttctgaatacaaacgccatgtttgttagctgcggctatattgccatccatcatcaacaagctagtccaaaacatacgcaccattgttttgttttcttattgacgggactgattcctcttctcgtcaatcgtgtactgacgccaagactttcatacgttggcacggtgaag

SEQ ID NO: 36409 - DNA, 693 bp, Oryza sativa
cagccagcaatcggtaggacgtaaatgagtgttgctatacgtcggatttcctcgtccgacccccatccaatccaacctaatctaccaatcgtttcgctccacgcagaccaacttctctctatgtgggcctctatgtgggccagagcagttacggagtagcagctaagtgctggtcggacataccagtcatatgtatagcgattttcgacgttaaataccctcacacaaacacaataaatcgaatagagccttctaatactccgtatatacgtttgctatatatatattgctattcttctatactcttgtactgctagcagcatgcatcgccgcatggcaggcagccatagctatatttgtcccgacaaagtataggtgaaaatttaatggaccgattcatcaatgcgagagtagcaccgttttcctgacaatgcttcacatgggcagccgcactctctgctaatgctcttgcttgaagaagggtaaacgaaggaaaaaaaatcgctgtgacctgtgagagattgatgatggtttgcttacccaacgggacattccagcaagagaagacgaggatgaccccgagcggctgcggctccagctgcgcccttgccgggaacgcgattagcggcacccagacctgcaaccagcgaggcgtcagaactcagaaccaggagaagcaaaccattcatgtaa

SEQ ID NO: 36410 - DNA, 4516 bp, Oryza sativa
  unsure (1)..(4516): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccatagagtccaagaacgccaaattccgagacccgagtcaagagatatcgccgttttattaacggtcggttgagctgaaaagtgacctgcggtctgaccgtgggccttaggccggtctgaccaggcctgttagccggtctgaccggcgtggtaaagccggtctgaccggcccactggtctgttgcactggtttggtttttggtggcgatacaaagccgccagagccgcaaccggtcagaccgagccgacggcggtctgaccgagccgttgacggtctgaccggccactacactgcggtcagaccgaccaggttgagtgggctcaatgattgccctgtaacggctagctttctagccgttacaaagtagtccggtctgaccggcctcacaacggcggtctgaccggcagggcacagagttggggatttcggttccaacgactagttttggtggttgggggtatatatacccactccccagcagcaagggtaaggttttggcactccattgcattatcttgaacccttgcaagagctctcacacccttgtgcactttgtttatctagtgaggtgttagagagtgagttaagccaatccaagtgcattgcttcattgttatagctagtgtgacacttgatcatcctcggcaagcatcctagacttgttactcttggaggttgccgcctcctagacggcttgtataggtgttgctcggtgacctctccgaggagattgtggaggaggcccggtgccgtttgtgagtggtttggagttcaccaccttcggagtgaaggaagaactaccccgagtgatcgaggcttgggtagtcctctccgtgggccggctcccgccttgcccaccccttgacgaagggggcgtgcggtggtttcgtggttgagcggtggagttgggctcgcctcaacggggattaggaaactggcgagtttccgaacctcggtgaaaaattccttgtctgttgtctcatttatttgttgcatttacatttgtgctatttacattcatagagacatatttgagcccatatcacctaggtttgcaaaacttaacttagttgcttagttaacccttgcaccttaccttgcctagcaacttaggttagttttgtttaagtgccattaagttttaaaaccgcctattcaccccccctctagtcggcctccttgatcctacaagttgtatcagagcttggtctctcattttgtggacttaactattccgagagaaaaggatggcttctagagatatagtacacacgggtggtgaccctcctatgtttgatggcacaaattatgcacaatggaaaatccacatgatttcttattttacggccatgagcccaaaaatatggtggattgtagatgtgggcttttctcatgctttggatgaccatgctccaacaagtgggcaagataaatgcctacatctcgatgctcaagctactaatgctttattttgtggtttgagtgatgacatgtttaatgaagtatgcaatctcaagagtgcacatgctatgtgggtaaagcttaaagaaaaatatgaagtgcccacacttgttgagaatggttgcacacaagaatcgatgtcgggtgaagactccacctcctcaagtgatgatgaggagctcccaataccatccacatcacctcattgcttaatgacaaattgtaagaatgaggtaaagaatgattctctcgatagtattattgaaaatacttgtgttgttgatgatggtggtgatgatgatgaaccttcatatgatgatctttttaacattcttagggaggctagtaaatccattgccaaagagaagaagaaaaaatcaaattttagagaaaactcttctctctttgaaagactcaaatgtggagctaataaattcttataaggaactttgtgattcttataagaagataaaagaagcttatgagtctcttctcattggaaatgcatttagtaagccaaaggtggacataggcatcacatgtaatttaattgatgatgatatgccatgtgtagctagctcatgtagtacatctaaggctagtgtgtccacctcttgtgatgacttgttagatgtaccttgtagctcaagcatagatgaaaattcttgttcttcctcctctatgtatattgttgctaaccttgtagaggaaaacaagcaattacaagcccaagtcaaagatttaaaagaagacttggatagaagctacaaagggaagaacacacttgacgaaatcctaagcaagcaaaagagcacaaatgacaagtgtggacttggctttcatcgcaaggagaatgctaagaagacaagacacatgcctagatatgcaaggaagcatgcatacttaagaaatgatggaaagaaaaatgtgagtaagaaccatcctcacattacatgttttggttgtcatgagaagggacactttgcctccgtgtgcgcaaacatgaaggatgagaagtgcaacttcaaattgaggcaaaccggcaagaagcaagacaaaacgacaagtcatagaggtcaaaacctaacttgctacaattgccgcaaaaagggacatattggtaaaaattgtcccataggtaatactcctaagcctaatattatttttgatgattatgtgcttaggaaaaataggcaaggcaatgtgtttgctagatatgttggtttacctagacttgcacctagaaggaggaccatttgggtgcctcgtattttggtaactaacattgatggacccaattttgttggggaccaaaatgtgccaaaatgagaatataggtacatgagaggcattggagttttggcctatgcgagaaaatgtgattctcaccaagttcaagaattggagccaataatgaggatggagaattcacatcaaggaccaatgccatctcggtaacatgcttttggtttgtaatttttttatatagccttgtgtatgttgcattgcattttcatagttccaaaattaaatttcctcttcttatgaacatcatcataaatgcatgttgagcataatgagtagtggcatatgaagctataggcttgatcatattaatgcaacatatttatcatcttgtgcttattgtcaatcttatttgatctttattggatcttgtgtttatttgctcatctttgttgggttgaagggaatatcgcattaagggaaagtattgcatttcttacatatgcactacaacccttagaatgtgaacaaagtaatccaagtggtagaaatgttttcaaaacgcccattttgaccaaaagtcaattttttgagaaaaactataattcttgaaaactattacttggaaaatatttcaaaaggcctctaatatgttttccaaactttagtttgcaagaaaaagtatttgcaaagtaaaaatgcatttttgactaaaattctagtttctaggatcttgttttcgagcaaaactatttttctctctacagggatatctaaagagaatttgaaatggagcccaaaacaagttagatagagttggttatttcaaatgtttttggtttttgaaccttatccaaaagaccaacatattaaaagaaatttgatgtcaaaactcaccaaaaattttaactagaccatatatggtcactttctatcactttggtgagtttatttcttaaatctgaataattgtatctttttggctcaaaatcatatttgaacttcatgcatattagtttctctcaaatatcatctcatttgcttctttttgcacttttggaggaatgtatttgaaaagagagcttgtgtagcctttttctcaaacttggcctttagtatcaaaccttgaattcatgaagcaaaaaaggagagttgcatcaagggggagcaatctgaatcaaacccatattccctttgctcccaaacatgaattttccaaaaggttgcatccataccctttcaaaagagcctattttagacaaaagtcaaaaatcttatttaaatggcccatatatgtgaaaatcctttcaaatgtatcccaatttgtatttcaaatgtttttcaaggcttttggagtcaaaatttccatttgtcaaacaaaatagcaaaattggtctcaataggatcttttagggtcttgttttggttgaaaatattttatttctctaaatcaaaatctattgagttttttggaaaagctttccatacaaaacttttagagttggtcgtttcaaacatttatctagttcaatgttttttccaaataccaaccatttcaaactctacaaccattt

SEQ ID NO: 36411 - DNA, 20555 bp, Oryza sativa
  unsure (1)..(20555): unsure at all n locations
nnnnnnnnnnnnnnnnnnnnnnnnnnnnnnnnnnnnnnnnnnnnnnnnnnnnnnnnnaaatctgtttcaactcatttcgatttgatttgcaaagattttgactttttctcgttttgctcagcttgctgaaattttcagaacaaccatgtttttgggctgatttgtgatttttgtatctccaaatgggttgcaaatttgaagaagatcacaatatggcttttgatcctcaatagttgaagtttacttacaaatttactcagaattttagctggtcatttggatgccttttcaacctcattttcagtctccaaaaatctgaaaaagtctgaaattttgagttggctgaaagcttgtgagatttgtttcttcaattcggttgagatctgggaaaggaccccaaaatgaaatttttgtatttttacatgaactatctccaggatttatggcatatttttccgagcttagttacacaggtttctattgctaaaagacgtcgccattgctatgtgccttttcagctaaacatggatttcaaagttcatgtcacttcttgttgattatttgagcatggtggtgaaatataagatgtttcaaataatgagatctttgttattttgaaaacttcatgaatccttgagctatgttggatatgttccttatttgaactcttttggtttttgaaatgcccatgatacatgaaaccacctaaactcaaaagtttttttttttggacttctcaaaaccaagccttcatggatagactccaaattccaatctttgccaccaaatacaagttgatccttgctaccaaagccaactaccattccttgatcccaaattcgaattcctatacacaagtggtctctcaacaaatggtagtatcccttgatcatcttgaacccaacactagctcatcattgtcattacttgccgatatcatgcacttgagtaaaattcttccaaatagccttgaccaagctcttctcaatttttgacattcttgaaaaaaacctttgatgagaatatctcaagtgaaagttcaagtgctcaaactcaccccttctacatatgaaacatattccaaattctctatccaaagaaaagactctatgagtaagggggagtttttctaaatgggctatttctatatatatatatatatatatatatatatatatatatatatatatatatatatatatatatatatatatatatatatttggccttgtgagtctttattcctttttgggattttgtaattgcctattttctagccctttttcattttttggtgattaatgccaaaagggagagaatatttgtgatctatttgtgatctccttatgatcatagctataaaagggggaaatattctaggatcccacatcatagcattacatatgcatcatatgcatcagcatgtcattggcatatcaatataatgttgatttatatccttcatatccaaatgtggttattatcaatggatttgtcatcaatcaccaaaaagggggagattgtaagttcaagtgccttaatttggttttggtgattaatgacaaatctaattatatgagactaacgtttttatgagcctttctttgattagtctcatttggatatgaaaataaaaatgatgagaggtatgtattaaacttcacatattctaacttggtctctcttgtggatccaaaatatagtgtgagctccctcattgatcttgattgattatgtgcatatgtgttcctttatatccatatgtatgtacacttgaggggagcttattctatattttgtttattataagatttctatcttgatttgaaatcatctttcatctcatctctctatattgtttatatcgaattattatccatcaccaaagagagaaaagattgaaagatcttggattaaacaatttgtgtaattgttactttggtgatagatgataaaccgatgtttataggattaacctctcttttgcataagttgtctactaggttatttcccgataatgagatgtggaagacttgcattcttttgtaccattaagttttaaaaccgcctattcaccccccctctagtcggcctccttgatcctacacgggggtctctcaaccagttctctccaaaaacctcgggaacgtcagaactcctctcgctgctgataacgttacattcagagcgcatggggactagagttcatggaacaggtaccactgatgttagtaactaaaaagctttgccatgacaaggctaatgtgtttggcacgtcatggattgcgggtaaagcgtacatttactgcagtaaagtataaatgaatctattcgaatagccgtgctcacggatttgagcattgggactcatatggtatttggttagaaacttaattccaaactttattaaatattgttgtatttaaaacattctaggctttcttcctctatattctttgctttctgcaagtaaacctagctctactcagatattaccatttcatgcattcattattgaatataatagcttgttgagtacgttgtactcacccttgcttcaacccccctttttcagagtcaatttgatgttcttgctgaagctgggagttcaatcatataagttagtctcattctaacttagttctcaagtatagattagatagatggtttaagtctatagcaaaacagtagagttgagtcattctatggcttctgttgtaacagttagccacaatcttgtaaataccctaatattattatgtaataatatctcctttgaaaccttgactaaatgtatgcaatgaagaaccagattgttgaacctgtatcaatctactgatccagggcttgatacagttttaatatgtcggtttccgaattattagttttgggacccgacagactggtaccgatatcgtggtctcgtaggaagcggttcatgttatttttcctacgacacactcatgtcaggtgccgttgtatagtggtgccggattagggtgtgacagatcagtacatttgtagtactaggcaaattttgctaacttctatatcgtgatttcgcgaatttagttgctagacacaaaaaaaagttaatctttgaaaaaaatcactctcaaaatgtggttatttgctatacacccttcattagaatattcattcctagttgaacaggagagaaaaataatagaaactatcatatcggcatcctccccttttctcatcgtctttctgcttgcatcgtgtagcttcgtagcaagtcacctagggccaagcgaccgacagaggtctctcatcctccgtctctctccccaatggccctagcgactggcatggacatcttgcctccaccaatggtgaaactgcgaaaggtagaggcgtgcgtacagtgatgacaaaggcaacgacgtcgaaggatagcatcggtggatctcatgatggccacaggtaaaaaacaggggtgttggatccgtcatccgccccgtgtaccaccgcttcaggatatgttgtcacatgcctcggcaacgtcctctccgctgtctcaccaagccagggatggagtccaatgggcttaggggggttcacaggcgcccagcctaattttcagatttagtacttaccccctattttcaccacatgggaacccctcgacccaaattcgtgcaccacccctggcccatgagcaagtcatggaagacctgaggcccatgaaaatagcgccccatctgggccaccgggagcgagagcgacgcctcgagcgttaatcacagccacgccggcaccgcacatcttttcgactcccgtttttcgccttttgtctttctttttcccgcgatacggcatctgagtggctgtgtgtctgttcgtctttgatccaacgcaatctcctctcaccacagtttgccgagtcgccgtctactcctgtcgctcaaccgctggtcgccgactcaccattgctcgccgtcctagcctgctgctggtcgccctagctggcagcccgcagcattacggcggcactgcggcagcgagcagccagactacaggggcagcctgcagctagcagcggagcactcagcagtgcacaagcaagagactaaagagaggtattatcttccttttagtttttttttttgagaacatcttccttttagttagttccaaactttcaatttaccctctcttctagttctagtcttattttaaatcctattaatttgatttgtaacttgttgatagcaccctttcaatatccaaatttatatataagctagggtttaaagtttgaagaactgaaagtttcaattgatttctggaagggacaaggactcctgctgtcctgctgccatcagtccatcaaccatcacttagtaaaattgtaagaatattgcgacacatttatttttatgtttttacatcttcattgttggatataaatttttagttgaaaactaagatgtttctgacttctgttctgcttttattgtaggctattatggattacttatcgatgatattgagattgacagctttgagaccggggatgtattttatatagattgaacgtcttttatgtaatttttgatgtttcccttcgcggtttcttttcgtcttatatttcagtaagcacttttacttgctactcaacgattttttttatcaatagttatctacaaatgaacaactatcattatttagagtaaatgccgccatctatacagtaaagtagtgcaccacccttaatatggttccagctccgccactacaccaagccgccaacaccggatctgccgtcgctccatccccttgacgtaaaatcggttgtcactgagcgctctgtgtcatgatatcggaatatataaaggctggcggaaggggcgcgcgatggggtgtgccacgtacgcgttttgctacagtacgcgtggtggaaatttacaaaaaagccctctgttttgttcgtaattcgtccggcgtccctcgccaaccatcctctgagctgtaggggtgggcattcggtctaaccgagaaattcggttcggtctttcggtctttttaaaatttcagtcatcaaaaactcaagaccgatcggtcccaaaaaaaatgaagaccgagcacttcggtcttcggttagttcggttcggtctcggtcatgaccgaactaacccgagagcagaagtctctgaacaaaaaaaatcacaaaagccaaacaacaaatgtatggttgacaaatcaaaaggcaactcaatagatcaatagagagatgatgcatctgctgatctgcacatgcaactaggaaatcaagcagattcagaaagacaaactgaaaagcaaatcgagctaggcggtgaaggacggtgtcggcgcggtggacgacggaggcggcgccggcgtggtgaaggcggagacggcgcgagggaggcggagggcgggcagaggtggaggcgacgccgacgcggtgggccgagggcggacggaggcggcgccggcggcgacgcagtgggccagggcgaacggaggcggcgccggccgccggcgcggtggagacggaggcggcgcaggcgcggtggaggcaggcggcgcggtgctagagcccggaggcgcggcgcgagagggaggagtggggagtgcggctgtgagggtgagggagccgagccgagtgggagactaggagtagggttggtgatttagggtttattttagtgggcttagtactggcctactgggcctcctagtctattgggctagttcggttattttgggtaggaataagtccattttacctccctcaattctttccctttgtcgaatttcatccctcaaccataaaaccgggtatattacctcctccaagtgttaaaaccagtacaaaacaactccctcgtggtttttgacagtggttttgctggcgtggcatcccagtcatcaaaaaaattaaaaaaatatgtgagggcccacatgtaagtggcatttctattcttcctctcctccaccactctcctctctcctccctcttctctctccccgaacagagcacggccggggacggcggagccggaggcgtgggaggtgtggggaccgccggaggatgcaggagcatgccacaagggagaggatcgccggccgcggcgcccacgcggggagggttcacctgtcacggcgtcgatctgctcggccggcaacacatcctcctgttgtctatccgcgccgccaacctccagcaaaatacataagctcatcaagctacctttcgaatagcatgtcatgtgctgactgtggagtgcaaaagattgagctgccacctaaacacttggagggggataaaccggcgaccatccatggagcagcaggagtaacaactgaagatgatcatgatccatcccaacaagtcgccggagcaagtggtagcctctttcgagcttcgacaccacacgaggaaaaaatcagacataaaaaaccccatgaagaacaacccaacagtaacaaaagcatcccccctccattagctgcatgtccttcctggaattctgtttttcttctccaaagagacaacgtgagatgcatggatgaacaattggcggtgcgcctactactgcccggactcctcatcggactcgccgtcgtcgcgctcatcctcccggtcctcctgctgctgctgatggtgttggtgatggtggtgcgggtgcggcagttgaccggtggcaccggcgccgccgacctggtggtagaactggctgagcgactgtgcggcgagcacgccgatgtggccgtcctatgagagtcctagctctagccctggcatggtgcgacggatgtcagcgccgacaccggtatggtccccgtccccgtggcggcgacgattgccggctccgcctgctggagcagccactggacggtatcgccgtcagacttgtggctgagctcccgcgtcagctggaagatccgggcggcgcacagtgccggcattcggatccgccgtccctggccgtccaccttggtgtgttgggtccttgttcgagctccgcttcggtcctaacccctgcatcctcctctcctccaccgccaccgctaccacctgcatctactgctactgacagcggatcctctccctcgcggcgtgcacccgccgcatcctccgacggtccccacacctcacgcacctccggcgcctcccctggccgtgctctgttcagggagagagaagggggaggagagaggagagtggtggagaggaagaatagaaatgccacttacgtgtgggacctcacgtattttttaatttttttaatgactaggatgccacgtcagcatcaaaaaccaccaagggagttgttttgtactggttttaacacttggggaggtgatatacccggttttgtggttgagggatgtaattcgataaagggcaagaattgagggacgcaaaatggacttattcctttcgggtatttcggttaaccgagcccaataaccgaaatacccgaaataaattcggtcttttgatgttagggaccgaacaactacccgaatttttcggtctcggtctcggtcttttcggttcggtctaattttgcccacccctactgagttgtatttttacgtttaggcccttcgtagatccgggtattctattagaaggtgagaaaaaccgtgaattaggtctgcgctctaaaatgtggaagctgaggggttttttcgcaaaacggcacgcactagcccaaaaccctaaccgccgccgtctccgctttcccctcgcgccgccacctctgcttcgcgccgtcgccatcgtcgtccgcatcgtctcgcgcctccgccgtcgtcgccgccgcctccgccgccgtcgccgtctccgagcgcctccacctccttctcccccctcgcttcgccgttgtcgccgagcgcggacttcgaggcggacgcggagaaagcgacgaggcgaacactcctctcctcttcccctctcgtctctcctttgcctgcgaggaactgtgcctcgccgccatcgtcatcgtcgtaacctgcagccgtcgtcgtcaactggccggtctagccgctcgccgcacgtggtggccgatggtcgcgcctccaccaacttcttcagcacgtggatccagtattgatgttggggagctactacttttcctgcagtcttgatgttttgattcatttggagttttagtttgctgtgctttgatagtgtatttttcttttggttcgatcagcatcttctgctcggtgccattccattccccaagaccttcttctgttgaaggagcttggagtttgcggtgtcgtgaactgaacaaatcctactagaggctggttcccatgtgcctgtaagaggtatactagctgagtaaattttacccacttctaattagctgctagctcataaataaacatcaatggaattttggtgttccattatcactgattgacctatgaacaattttttcgtgtgctcgggcacttagtgcggtaaggttttattagggtatggtatatatctgcaggtgcttctcaatatatgatttcattagctaacgtatgttttcatgtacttacattccaacatgtttggattcttcagaatatgatgggatgctgaatgtaatcttgaaaagttgggcccattattcttcagttaccctatttgcaaaaacccaaagtgtatagcaatgtgtaccagggattatttttctattaattttgggttattatgtaataaaaacattgtatattcatgtgaaccaagagtctgtaacgaaccgaaatttcaacagagatgctctacgttgataataaagtgtccatctgtagtaggatatttattacggaaaaaggcaatactaattacgatgctattgatatccacaagagttgaactgtaatctatgatgtcgcttatcaaattttcatagatttccctcatctatttaccgactgattgtcgttttagtccgtgcaggcggcgccccagcctctagtcctatgtaaagatttgccgccgtaccagtcttctcagaacttcagggaaaggccttgtcttcaactgaaagtgaacctcttaattccaccagaaaaaaaattgctggatgagagacgggtaagagatactagtacccccacaatgataggaagaaaacaaactaaatgaagtgatgaggggggcacgacatggagggccctaactatcaacttctccaaaccacacgagaagtcgagaacagatgcatcagcctgcattgtctgcactcctgaacatatgcgcttcgtgcgtccataaatttgtccgcctcctcaggaaggtgtccggaacatggacgcgtgaagggttcagtgattcactgatttgggctttgttcgaatgtgcctttagctttagctttttaatcgtataaaaaaatattagcatataattaattaagtatatcctagcttcatcctaaaatattatgattctgtttagttttcttgttctaaaatactgtccagatttgttgatgtagaatgggtataatatgactcacccttctagtttgtaacattttataacggagggaatattactcactacaaatttaaaaaatagtttatttttttaaaaaaatctatataaaagattttttgataaaaaatatcagtttgaaaagtatactcgtgataaacgggggagttgtaaaagcaaaatgcgctgtagaacacagccatacgtactgattagtccttttcattcagtacggtgcggcggtgcggttcttcgtgtgattagtccttttcatccagtattcgcatgatatttgctattgctacagcttgatttttactatctgctcgaggtctcgaggctatctcgcgtttgcatatgatccacagattatccatccatctctgcgcctacttgccgacgccgagatgcgtttcacgctttcatcagaggccactgttactactttccgtctttccggactcacacggtcacactgccgccccagcatatttttagaaaataggataaacccggtctctacatcggatcggatgtacacagccattgccgccccagcatacggaccgaaccgccgggaggacgcacgcgcgcgcacacgctgcggccgagggccgtggaattctgtcgtgatatctgtgtgtcgcgatcgcggtggtgggctggtggcgtgtgggcgaggcgagcacacacgcccgcagaaaacgaaagggggaagcagccaaagcccaagcggcacggccggtgtgaagcttgccgccccaaccccacctcgcgcgcgcgcgggggcacgccgcttcgcacgcgctcgcttcagttgctttgcttgcgccaggttgagaaatttgcgcatacatgccgccgcttggcatgccatggcatcatcatgcatgcatgttcttgctcgcggccagtttgcttacgtacggtcgccggtcgcgtgtgctccttagccaccgcggcgctatagccttggctcatgcagctcaggtcgtcgtcgtcgacgtcgccgtctcgtcgaggaggagaccggtacgaaggaaagcaggagtactaatactagttgtttggtacgccggcgagttaatgctttttctgttgctgtttattactgacagacgactgttaatggttcaggtcgcgagttcgttcactgtcgttttgagttttgacgaagctttcttgacagcttcgccttcgcggtctttttctcttccttcttttaccggcgtcacgtataattgcaggttggctcttagtttaaaatcgttcgatcttgctttgaaggtctgattgactgattcttctttgttgactttgtttttataacctttgtcatttcgtaagcattcagggtctgctggtttgcttgcgcgtgagtggcgggactctgcctgtgtttcttgcacggaatgttaatggaagcgattttttactgtatgttgtgccgactccctccgtccaaaaaaaaaagacaaaccctagtttccgtgtctaacgtttgactgtccgtcttatttaaaaaaaatatgaaaaaaattaaaaagacaagtcacatataaaatattaatcatgttttattatctaacaacaatgaaaatacgaattataaaaaaatttcatataagacggacagtcaaagttagagacgcaaaccaagggtttgcctttttataggacggagggagtatgtgtctgctgtttagttcctgtacactggcttccactgatcatggttatttatttttattggtttccccattactgttgacagttgatgctatctgaaaaagaaattgttttatactcctcccatctcaaaataaatatatttattttaagatagaaggagtaattgtcaacataatcaatctaaaccgtttaatagatatattttatagtaccacctcaaatacttcaactaatgctaggagaatttttttctactaattatttaactcataaataaatgggtgagataaattctatttcttctactagtgattatattggtagataaaaacattaccaaacctccttgcttccttttctgacgaaacaaaaccaagtatacgctatttctctttgccaatcacttcccctttcttttgtgacgtgctattcagttctctttctcaccttcagtttcgtttggctcgctgttcttgtcttttcagttggagcaagagcaagagagaatccaggctaattcaggtgggtcttttttacattatctttctggaatcctcgataccacactgaagataaaaggcagtgattttctttggagaatcacccataaaaatttcatctttttctttgcccctatggatttcttgcactgatccttggcgagagagcgcacttgttcatagcttcgttgcttagcacaacggatgtagaagaacacaagtgaggagctcactagctagcatcatattcgtgctaactcatcctcgtactgaaaaaaaaaagatctttttgtttcaccgacccttcattctctcattcacatgcctccgctggaactcggacacgggggtgaatctgacgccggaaaattctttccgccatgaagcaggagaggcggaggaagcggcagcccgggccgccgcgcctcgagctggtggtagcgcacccgcgggaggaggagatggccgggctcgacggcggcggcgacgccgaggagggggccacgcatgcccgcggcggcggcggcgcgccgccgccgtggcgggagcagctgacggcgcgcgggctggtggcgagcctggccgtgggcgccatgtacagcgtcatcgtgatgaagctgaaccttaccacgggcctcgtccccacgctcaacgtctcagccgcgctcatcgccttcgtcgtcctccgcggctggacgcaggcgctcgcccgcctcggcttcgccgcccgcccgttcacgcggcaggagaacaccgtcgtccagacctgcgccgtcgcctgctacagcatcgcagttggaggccaggaccaccccccattgcatccatcctccattcgtcgtctacctagtctaatggagatcccgactgattggttctttggatctttctgtgcaggtgggtttggttcttacttgcttgggctcaacaagaggacttacgagatggcgggcgaggacacggagggcaacgtgccggggagctacaaggagcccggcattgcgtggatgactggattccttctcgccgtcagcttcgtcggacttctcgctctcgtccctcttaggaaggtcagtgagcttccacagccttactctgtatcttcggtagttctgccatttgaccagttctgttcgtgttttactgcttagtttatatgtgtagatctaatgatgcgctcatgctagtttatatctgcaatgtcttgatttatttatagaataaattaaatcattatatgcttataatttcaacagttctgccatttgaccacggttcgctgtagctccttactccttagaactgcaattctacatttcataggcgtttttgtcgttcaccagttcacccttgtgagaatttcacaaaattgtggtaaactgaccatcatctccatttcagccttttctatcttttgtcccttcaacatttcgtaggtgttttaatttcatttcacgatgtcacagattacataagctaaaaaaaaggacaattatgcctgtatttagctaggtgatagagttgaagtgcagctagtattttaacgtatctgattgatggccttatggtccctgttgaatctggactgctgattgaattgttcttgtatggtcttgtttagttgtttgaaattggcgtgctgaatgaatcgttctggtatattaaataaatttgtctctgtcatgaaacctctttcagtctggctttattaaaccacctagttggttattggttaagacataccaacatttttgcttaatcgattgatagtgatttgtgctgaaacaaacaataccaactcattagcgtgtggtacttctctagtcccctgaagaaaatatagctattttgcttgtggtttgagttgtacttttataaataaaatatatttttttaattctgaaaaaaagcatacttattatttgaatcttgagttgcagttgaatttaattgaaagcataatttgaagtccacatgcaaagacttattatgcgtgattctggacatattctccttttcatttcacaacatatttatcttgtgaatacataaaaaatgaacagctggcagtgcttttccacatgtaaatggatgatttcatttgttaccaaacttagtaaaattccagatcttgataatttccatttgtttcttaaacttggtaaaatttcaggtcatgataattgactacaaattaacttacccaagtgggactgcaacagctgtgcttataaatggattccacacacctcatggggatgcaatggcaaagtatgtggttctctaacataactcataatgagttctactattcattataaaatttcagttaactgaacgtgttttttggcacatcaggcagcaagtaaatggattcaccaaatattttgctatgagtttcttttggagcttcttccagtggttttactctggtggagacaattgtgggttctcgcagtttccaacttttggactaaaagcttggcaacaaacgtaacaacaatcacttagctcattattctattaaataaattttgaccaacaatagtgtcacctgatttgttcaaaaaacaagttcatctgattcaaaactttttgggttatcagattcttcttcgatttcagtctcacatatgttggggcagggatgatttgctcccaccttgttaatctgtctctcctactcggcgccattctctcatggggagtaatgtggccactgatcagtgatttgaaaggggattggtattcagcagatatacctgaaagcagcatgaaaagcctgcaagggtacaaggttagtttcgtcattttattttggtagtgtacaagtatagtatgatcttttgattcttaccacctcatatatattctttaggccttcatctgtgtagctctcatcctaggtgatggcctatacaattttgtgaagatagttgcactcactattaagaatctgtttgatagctcaaaactgaagaatgcaaagaagggtaaataatctgacagaactcaatatgacctttctagtttatatatgatctgatataaggtgtattccacttacaggggaagacatgccagtgctcgatgaacttcatcgtaatgaagtttttacaacagacaatattccttcctggctagccttctctggttatcttggattaacttttattgcagtaattgccattcccatgatgttccatgagatgaagtggtattatgttgtcatagcatacttattggcgcctgcccttggtttctgcaatgcctatggagcaggcctaactgacatcaatatggcctacaattatggaaagattgccctcttcattcttgcagcctgggctgggaaagactctggtgtagttgctggcctagtaggctgtggtttggtgaaatcgctggtgtccatatctgctgatctgatgcatgatttcaagacgggacatctaacattaacatcaccgagatcgatgattattgctcaggccattggaactgtcatgggttgtgtaatttcaccactaactttcttcttgttctacagtgcctttgacattggcaacccagaagggtactggaaagcaccatatgctctagtctaccgaaacatggcgattcttggtgttgagggcttctctgctctgccccagcattgcttgcagctctgctatgggttttttggctttgcagtggcagctaaccttacgagggacctttgcccaccgaagtatgggagatgggttcccctaccgatggcaatgggggttcctttcctggttggtgcaagctttgccatcgacatgtgtatcgggagcctgatagtcttcacctggcatataattgacaaaagcaaagcagcactaatggtgccagcagttgcatctggtttgatatgcggggatggtctttggatcttccctgcgtccttgcttgctttggccaagatcagcccaccaatgtgcatggcatttaggtctacaaactagaggagtagcagggattataattacatggcagttccatctactacaggaaagatgcagcaatgcaataatgaagtattatatgggattcctggaggtacctgtgcagtaaatattggaaaggtaccaaacattgttaccatttccatgtcaatgaagtaagacaacagattcaagataattcatctcataacaatggcgtatttttattgcctcatctcttaccaatgtgatttatggttttagcctgtaggcgctaatagaagaaattttgtatagtagagaaatgtttagtgtatacatgtatatatttggtgataagttggacccgaagaccgaatattgtaacaggtctctttcaagatcagctgatccaattcttactttgccagtttccagctgatttcagctaatggtttcatctgaagatatgttatctgatgcgtgtgacagtgagagagttatcaaatggtgcactacatggattgatcaatactgaccaggtattgtgaaagatctgcctatccaagaaaaccactgcaatgattgattatcaaattctcctacaaaagcagctgcggcaaaaaagttttgagtcgttatcgttgtgcggcgtttctttttcatgaaaaagtgacctgcatttggtaccatcaattcagagaaatttgacgagatctttcaaggataagaatctctaattggctctatctcaaaacgagagactggtttggacactccattgctagccatggttgcttggttgactcttaagcgtttcgccataatagggttcttgaatccgaagcaactctccaacttgttcatctgtccacagccaggcttacatcacctagggccataggtgaaatgatcaatgaaaaccataaaacaatccagtgggcatgcttggccaaagtttcctgtgaaccaaaaggaacttgcctttaaaaaatgaatctttgacagcgaactgatcagccacactgctacagtcaccgcctcaccggattatttacttttctgcattacaatccagatgatgatgcctgaaagggacagggcatcttgtggatcgatagggaatttccggccttcacacgaacagctaggtgtggatcgacgtcgttcactgatgtctcctcacttttgagcgctgaagatgcctatacagtctgacgatgcgcagggtggtggtcttcagtttctgtgctgaaaacaacagtatttcatggaaccctcgcgtactgcctgatgtcctgtcagttctgtttgattggtgaaatcgattgcttttccatcccgaggaaagtggctttgcatgcacggattgaaccagaattttctgaagaagcagatcctctgccgctgacatgtgggcctcacacaatccccgtccagattctgaagtcctctgaacgtagccagaattccactagtttttccgaacagacgaacagttataacagatagtagttcatcggaactactactatctacgtgatcgcaacagattcgtagttcgcgtcagaatccagcacgattcaagcccgcgcgcacgtccgatcttgggagccgcgcgtgtgcaggaatccgccgaacacgagcagggcgacgagaggtcgagagccccacccatgtccatgtgccagacagccagacccgccttcgcccgtctgcgtaagtgcgtaggcgctgcctacccgcgatgccccgacccacgctccccttgcgcccgagcgaagccggctgcgtgatcgcgcagcccccttcgtgactccccccgtcccgcatgcggggcacgccggggccacgcgcgcggcgcacctagtcgcgtgtgtttggttgaagggatttgttggattacgttgggttgaatctatttttatatagatgtttggttgtgatttttagataatgaaataaaattctgacctttgctagagtaactacaaattgttacacaaattcacacaaactaaaaacacacacacaaaacaaagacctattgactattgaatcttattggtgaatccacacaaaacaaagacccattgattattgaatcctattggtgaacctctaagtaaagttggcaaaaaactgcatgactgttgtctcaagtagtcgacatgtagattttattagcttgatgtcctcatcacacctttattagtttggttgtgatactaggtgggatgggttggctccaaaaaagaatattccactgatattcaggttcaactcaccgatgaaaatctagcaaatcgattcgacatagctctatcgcgcgagtcacatgagatgcacatgtgtggtcacagtatctctctctcaccgtttcttgtctcttctagatcggcgcccatgcgagaagtggcggcgaccgtgcgtatgcccaagcgacggcgacggcggtagtggcaagaagcagcggcaagtaagcctgccagtgggctgagatccaatttgaatccaccccagcccacctcctcatggaatggcatgccaaaccaactcaccctgcatgcctgcaggtcgactctaaaatccccaaccaacccaccccgcatcagatttcagtccaacccaccccaaaccattacactaaaatgggttcagtccacttcactggaatggattcaatccatggatcccagctacactacagagagcttggagccaggaggcctcgttacttctttagccatggatctcagctacagtatagagagcagcagtgtagacacacgtgcagacaattaattcaaaacagaaatattaaaagaacatcattgcttgctgaaacactgaaaattgggcaaaaacaagaaaatgaaacaaaaaaaaaatactcagaatgatacgcatcgcattgtttgttagctgatccagcactgaaatgaataccagaagactaatgatgtcatataattacaattaagtcaattgctcactactacagcaataataagggccataataaggtttatatcttcaacaaaaactaccaaaacatcatctatgccttgatccatatgcagttgtagataatctggaagagaaagaagccatcagaaatttatatttcagaaataacattgaaagattacaagttgaatattattatttctataagatatgactagcatgagttagtggacacactagtaagaatgaagaatgaatccatccatccccactattcaactaaatatctatactactatatacaaccacaaggactttcaagaaatggaaaaaaaaagagaggaagaaaacaaggttgagagccccaaaattctgcagccagaatcaacatagtaggatacaacatatcatatcaaacaattttgcaagagaaagaaaagatttttctctatttctaacaagtactctactaactcttcctgaaaaaaaagtactctactaactgctgacctaattagctcatggaagctcaaatcatggactagagaacaccctgaagccctgaactaatctgaacccttttgagtacaaaacaaaacatttggcctgagcagcctcatcaagaggagaaattgagcggattgatctgagctgagcacatcaaacagaaagaaaagattcagagacagagagttagagctgaagatgttacctggcagaggatgacagagtcctggttggggccttttttgcccctctgggagaagagagaggccaccttccttgcttatccttcacatacacaatgctctcatctatctcctgaacatgctctagctgctcaaataagaatatatacaagtaaggatacaactaatagatataaaaggcattgcaaggtgttacaaattctgcctaacatttcaccaactgatgaacaaaaaacaacattaagttactgagcacagggaccccaccattgtaaaaaaaaaaacagccatcataccaaaccttcttcacaaaacatcatatggtcagtactcagtacgaacctagatcaaagaaaatttggcacaaatattagtaatactggtgggcactcagacaaattaatctagattttgtgactaatcaaacaatataaaatgaaaacacatctacaattactatttgtatggcacagaccacaaagtctgagacgaaatacaaggcgtgagatattatacctttaatccccttgttttttggctctatgtagccaatcttttgcacaaacaagtgcctcgagcatctctggtgtcaatgagcttcttgtgtctccaagaatccttcctccactgctgaaagcggactctgagggcacggtgctaagtggaattgcaagaaagtctcgagccataattgccaacacaggaaactttttggaatttttcttccaccatgccaaaacatcaaaatcctcactatcatcctcacatacttcttctaaatatgtatcaatctctgacttctgagtacgtgcaaccttccggtttgacttgaagaggatgaattcatgctctagctttctttttcccaaaacaggtgagcctacaacactaactctctcactagactgtgacatgtaggatacaccccttcttcttgcaattccttcatatacatgaaagtatgatttcatctcctctataatagagtccactttactttcaacattagaaccatggggagacaccttctcataaaagaaatccaaatagtctcttttccttcttggatctaacacagtggtaatgacaagtgccaaattgaagttgtttgccaatttttcatcccaatattttgcaaacttggtgtgcataggagcagccaatcattttaaaagatcgctggtttgccaatcaggatcactcaaagcatgacggatccaaagaacatggg

SEQ ID NO: 36412 - DNA, 1380 bp, Oryza sativa
  unsure (1)..(1380): unsure at all n locations
atgacggatacaaagaacatggggcatgaatgtgtgtgcagttggtgtcctatgagctgatacacctctagtagcctcttcaaaagccttaagaaattcacaaattgattcagcatgcaaccattcttcgtcagttggtagaagttcacaattttcagaggcatagctattgaggatagccttgtaaggcaatatttctctaatcatcttgaaggtcgagttccaacgggttggtacatcaagagtgaaaccagattttggaggaagacttttactagaagcaattgaattaaacgcttgaatgcgtgagggtgaatgctcaatgtactttaggatctcacggatcttatctatagctgcacgaatcaccctcatcccatcttgaaccaacaaattgaggatgtgtgcacaacacctcacatgaaaatgtttgccttccaaaaccaactcatccttgagagttttcactaattcttgacaagcagcggtgttgttactagcattgtctaaagttaaggtgaacagtttgctactcaagccccactcagtcaaacacctcatcatggcttcttcaattgcaaagctagtgtgtggatacttcacaggcttcaaacttataattttctttttcattttgaattcagcatcaacatagtgggctgtgacaaccatgtatcctaggttttgatttgaggtccacatgtccgatgttaggcatacacgcgaatcaagattctctaattcagcatgcaattcttgtttcagcctattgtaatagttgtaaatcttgtcgcggattgattgacgacccacaagtttaaaagttggctgcatggatgccatccaatcatccaagtagggatcctcaattttatggaatggtatctcagcatggatgaaatattttatcatcaactctttagtctttttaggatcaaacacaaaattttccacgggttgtttcctaactgttgatataaacctatttctaacttcaccatcaactagtggacaagattcgcaaatatggtttatgagatggctagttcctgattttctagtcgctgacaacattaagccacaatatttgcattgtgcttttggaagaccatctatcatgacaagctcctgctcaaaatgttcccacacttttgctctcttacgtgtttgtgaaggcagctcatgactagaaaattggcagatgaactttcagaattttgcatagacatgtttaataaacctgtgtttgacaagaatagaaaattaatatctacatttgctacttgtgcagaattaatatttacattcactacttgtgctaaaaactagtgaaatgataagcatnnnnnnnnnnnnnnnnnnnnnnnnnnnnnnnnnnnn

SEQ ID NO: 36413 - DNA, 1033 bp, Oryza sativa
  unsure (1)..(1033): unsure at all n locations
nnnnnnnnnnnnnnnnnnnnnnnnnnnnnnnnnnnnnnnnnnnnnnnnnnnnnnnnnnnnnnncctttcaaacatgaattttccaaaaggttgcatccataccctttcaaaagagcctattttagacaaaagtcaaaaatcttatttaaatggcccatatatgtgaaaatcctttcaaatgtatcccaatttgtatttcaaatgtttttcaaggcttttggagtcaaaatttccatttgtcaaacaaaatagcaaaattggtctcaataggatcttttagggtcttgttttggttgaaaatattttatttctctaaatcaaaatctattgagttttttggaaaagctttccatacaaaacttttagagttggtcgtttcaaacatttatctagttcaatgtttttccaaaataccaaccattcaaactctacaaccatttgaatttcagcaaaaatcttgacttgaccattttcggcctaaacttgcttatggcgtgttaagcctttagagccaaatttctttgtgaatcttggcttgaaagtgtatctataatcctcctaaggctttacaaatgtcaaactccatcgatttcaaatttgaatgtgatttgagctctcaactcaaatttactcaccctaaaggcctacaatgctccttttgtcttatcttttgatagaaaaatgatttttaagaaattctttttggaaaagttcctcacaagtataaagatcaaatctgcaaggtttcaactcatttcgatttgatttgcaaagattttgactttttctcgttttgctcagcttgctgaaattttcagaacaaccatgtttttgggctgatttgtgatttttgtatctccaaatgggttgcaaatttgaagaagatcacaatatggcttttgatcctcaatagttgaagtttacttacaaatttactcagaattttagctggtcatttggatgccttttcaacctcatttcagtctccaaaaatctgaaaaagtctgaaattttgagttggctgaaagcttgt

SEQ ID NO: 36414 - DNA, 362 bp, Oryza sativa
  unsure (1)..(362): unsure at all n locations
nnnnnnnnnnnnnnnnnnnnnnnnnnnnnnnnnnnnnnnnnnnnnnnnnnnnnnnnntatgcgaatgttcgtgcggaagctaaccggaaatccgcttgccgtgaagccagaagacattgtgagggagctgagcgagcagccgccccgggagttcacaacggacgagaccgacagtgacgacatgggcgatgactacaccgacgacggcgaggaaggcgaggacgacggcaaaatgcagtacaggatacagttccagaggccgaacccgggcggcgccaacaccgcacctccgccggcgacaaccccggcgtccgcggtgccaacctagactccgacgagcaccttcctcgccatggttcaat

SEQ ID NO: 36415 - DNA, 1189 bp, Oryza sativa
  unsure (1)..(1189): unsure at all n locations
nnnnnnnnnnnnnnnnnnnnnnnnnnnnnnnnnnnnnnnnnnnnnnnnnnnnnnnnnnnntatattcgacatctattctaacattttccaatttggtgctttggatattgtttatagaaaaaataaacaatatccaaaacatcaaattagttatattctaataatatgtttattttgtgttgaaagtactactatgttttctctacaaacttgataaaaaaagtttgaggaaaaaatcaaaagacttataatattaaatactagatgaatactgctttatgcaattgttgaaatgatatcaagatgatactggctggatgtattcttactttttggtgaaggtgaaccctaaccgtctgtcttaattaattaccccccgggtcttgtctctcccaaaagcaaagagaacgattggtgcttgctgtcaagattcggaatcattatttgtggattcggaattattatttgtgaattcggaattattatttgttaacttggaatatttcgatcgtgtcgatgtatcgttttcaaaaggactataactatcactgttttaaaccatgcctgccaaagtgccaatcgtaaataccgcgaatacggagtcctccgtgagtcaagtgttagtcagttctagaagggagcacgagacttcgatagatcaaagtaccaaagcccatttgaattgtaggattaagaaaacgtaagaataagacaaacatagaattttgatagaaatataagtgtaaaataaataattgcaaaacacaaggaaaacataggaatgtccgtttaattgaacagtaggaaaaacacagaaattggatgagagagaaaaactcaaagaaaagttaccaaaagattgaagctcttactaatttcctctaaaatttctataggattgtccatttcataggaatttcaaagaattggataagattcattcctttgaaacaaagcgcttcataggaaatttttctatataattaaaatcctataaaatttctatatttttcctccaaataaaggagccctcaaagtggagtaatccttcggtacaaaattctcctgtggacagcatgtgcacgcattgtgtagaacctttgctaatttgacgccaaggctgtgttcttcttatatgtttgaaacggctaattagtcacacgtaaaacataaaaaacgattagcatat

SEQ ID NO: 36416 - DNA, 860 bp, Oryza sativa
  unsure (1)..(860): unsure at all n locations
agtgactgataacgtaagtcaantngcaaacnacctcggtacccataagaggtctcagtagaaagacaaatgaactccacatcctcaaagtcaaaagcttctagcttaagcatgctaatatatactccctccattccaaattgggctacatatagtttttttgaggttattcctaaatgatctacatatttgtgttcataaaaaaacaagaaaggagaggagaaacccaagtgggaagacatatatgaatcactcaaagctgctaggcgagcaaggggtgaatgcttcaagtgtggggagaaatggggacctgggcacaaatgtccaaagtcagttcaattgcatgtgttagatgagttgcttgaagtattgatgttacaggatggaactgctgacatccagaaagaagaagaagaagataatgaataagagctaacactttcaaagtgtgcagctgctggaacaatgggaaagaaaacaattaggctgcaaggtatgattcagcatcaagaggtactgattctggtagattctgggagctctagtaattttattgtagagagtttggttagcaaattgcagcttcccacagaaagaatgcctgcaaattcagtgacccatagcagatggaggaaagatgacttgtgacaaatgtgtacaggttggaatggtggtgtcaaggtagtacattccaggatacactaaaagtgttgacaatatgaagggtccaacatgatcctaggaatggcattggttcgaggagtttaatccaatgtggatagaatgggagagaaagaaattgacgcttgttccaatggggaacaggatcattttgttaggactaaaacaggaaaataaat

SEQ ID NO: 36417 - DNA, 829 bp, Oryza sativa
  unsure (1)..(829): unsure at all n locations
gtgatctancctgttaggaccaacgcgagctcggtacccggcctcacctcggatggcgcgaagcgaacgctcgatcgccgctccatttctcgccgccggcgaggtcttcgtcgccggaagaacggggaagacgccctgctcgcaacttgcagcaaagagtagaaaagaaaatgaaaaggaaaaagaaaaaaaaattaaaagagaagtaggggaagtggttgagtgggccccaccagataatggccaaagaagggactggttggtgggcccaggaatcatcctgccatgccagacactgacaggtttctcaggacagattggaagcctgtttggaattctggccctctttagggtgtgtttagttaaagtttagttgaaattggaacgatacgatggaaaaattaaagtttatgaccgagtttagttcaattggaagtttgaagaaaaaaattggaactaaactcggcctaagatttcaacttttttcttcaaacttctaaattttccgtcacatcaaactttcttacccacacgaacttctaantttttcgtcacattggttccaatttctttaaacttttcaatttagcgtggaattaaacacagccaaaattgggagtttgatttatattggatctatgccactataaatttgtttgtttagaaaaatacactacaattcaccctatatgaaaagggaaatgctgaacactggtataacgtcccgacgggatggatagacacaaccaatccactcttttctactagctatttttctacaacattttttacacgtgctgttgactaagtaacaccagctccgcggggt

SEQ ID NO: 36418 - DNA, 831 bp, Oryza sativa
  unsure (1)..(831): unsure at all n locations
cggcactgttgacaccttcgtataccnnncaattcnagctcggtacccctccatgcttaaactcggcagtctgataaggcaatgtacacaattcttccggattaatgaatatccattatctaaaaatgtacacaattcttatgatggatccttgttttgctggcagggtctgttgtctgatggcaccattattgctgtcaaacagctatcatcaaggtctaaacaagggaatcgagaatttgtgaatgagataggcatgatatctgcactccagcacccaaaccttgtcaagctttatggctgttgtacagaaggaaaccagctcttgcttgtttatgaatacatggaaaacaactgcctagcgcgtgctcttttcggtaatcttactttctaatttnctggtttcccctcttaacttatttcatgttagaactcatgtgcaatttctgtgattaggtacagtcgaacaatacaggctgagcctggattggccgacgagacgtaagatttgcctgggaatagcaaggggtttaacatatctacatgaggagtctgcaataaggatcgtgcacagagatatcaaggcttgcaatatactgcttgacacaacttgagtgccaagatcttcgtttttggcttgcaaagcttaacgatgatgatcacacacacttagttcaaggaatgctggggctatttaagtttctttttgatttcatcccccctttccccaaattaatttcaccggtcccaattcattgtttccattggaagttttaattacctgccgttgaacttaataaaaataccattcacactttttttgttttttgt

SEQ ID NO: 36419 - DNA, 483 bp, Oryza sativa
ctggctgattcctggacgagggttcacacacatgtaagcgtttagaattttggatagaaattccgggcgtgacagacggcgcccttgctgaggtagctgacgcgcgggtcgaacacagggccagcctgccggtggcacgacaccgagcacaaggagcactgcagctaggtgagcgatgagcccatgtcgacgaccatcacggtagaaggtcgccggcatgccgaggcccaggtgggtgacgtagttgcctacggctaccgacgcacccagcgtcagcggcacggacgacaacgacgcctgtgagccgcgccgctggccttcttcttgtggtggccgtggaggagagacgacgacgccgtgcggcaggaggtatactcattggagcaggagaacaggaactgatgctcagattgacatggccagaattttatccagcaagaaagaaaatctggagaccgcgggatcaaagtgcaagaaggatag

SEQ ID NO: 36420 - DNA, 852 bp, Oryza sativa
  unsure (1)..(852): unsure at all n locations
agcgatggattaacttgcaannacagctcgaaaacnacctcggnacccagttcatccctttccccaatctccaatccaaatccctagcgaaatcctgattcaactaggcgagatgccggaagagtcgtcgaattcttgacagtatttctgaaaatattgatgaggtggcaagttaatcttccaccattcccacggtgtttttcctagggttaattttagagataatccattatatgccactgactttgtcgcacgtctatgatttgccaccgactttgtcacgttctacaatataccatcaacttttgcttaacttctacgattnannattgncgtncnnntnnnncttnttttgtccgttcatatctttcccttctgtctgtctaccactttaattcagacaaactttaaccgggatttttattctcgatcaaagtaatgtattcatcttctactggccaatccacaaacgtgcaatatctaaaaatgtatgaacgtcatcgttgagtccctcctacagcgttagtgcttccaaggaaatatgggtaacccgtataaacgtttttagcttattgcgcaacatcctcatccggcatgagtaccatatacattatacgttcaggaaaacataacctttcaattacacctgttctcatgatgtatcaaaggttaagccctgtacaggcgtataatgagccaatggcattatcttggtctatagggattaaaacgctatacctccctaaactcgcaatatctccaaaactcccgttcaggtcgtaaacgcgtatatatggcttccaaaggctagcaaagtcatttaaagctctatatgattttataaacgtagcg

SEQ ID NO: 36421 - DNA, 855 bp, Oryza sativa
  unsure (1)..(855): unsure at all n locations
cgcgtaggtgaacctacatacanctgcaaaacnaccncggnaccccacaaaatagaatgcatatagtgttttagtccaataataccaagcgaccaacaaggttgaatcaattcaacaacaaaatcaagggatactttctactccaaaactatagcaattggcaagtaggaaacaagtcaatatgaaatgaagtaacatctacaattgttgatgcaaaagaagaccaactaaccataggacaagttatgaacattttaccaaaagattgcatacacatttgcgtattcaacaaatgaaaagacgcactacttttggattggaaaggacctaattaatgaagaacaagagcataagcttttacaggttcaatactttacgaaatcaagcaacaggcaggaaattagtgctacaacaaccccatgatttggaccgttggcaatgctcgagtcaacaaccaaagatgcacacagggtgttcgatgaaatgcccacacaagcaccgaaaaagaaacaggcgacccaccgaggatgacgtgggtacccctctcgcgcagcgccggcggcggcgttttgccaagcccgacgttgtctgtacacgcatacacacacacacaccctacccaacatgagctgagcacatcacaagacggtgagactcgaaagagagagagaagcgacttcatctgcaagcaagcaagcaagaaagagccggaggcgagaagccatcggttaccccagtaatcactcanaccgngcggtngctgcggcaacaaccgcgtattccttcggcttcggcataagtcggaagcaagggacgggggcgcccccgcctgagaagaataagatgatttttaat

SEQ ID NO: 36422 - DNA, 846 bp, Oryza sativa
cgcgtgatgatactacttattcggcgaattcgagctcggtaccccagaagtggagatgactttcggtctggtcttttcaagctctctaatctgtttgatcaaccgcttctcctcatccaagggtatgctctcatgagatatgcggtcgttcaatctcttgatctaataggacaaagcaatggagaaggcacaaacatgtaatcaaatattggactgaagaacagaaaaataaattatcataggttaaccgtactgccataccgatttctcaagctcttcaattgaagaacatatgcctgcaccctgtgcccggatagcattgttttcatcgcggaactttcctaaacggtttctaagaggttctatcgccttcaacttctcacttacggcttcgttgtattgcttgttctcagcagccaatggcttcagctctgagataataccgaagcgctcattctgcagattaagttccaaaatcagacatatcaccaaaatttcgtagtctgctcaaattggcaacatattctaggctctagcatcaatagcagatgacagtcgttttaaacaagttgtaaggaatataacttcttgctgatttaggataaaatttaaacaagcatgaccatatttatatgtactagaacttgtagaactaagaccataccttcttggcttttatagcctcaaaaatttgagaacgagctttgatcttcttctggaagtccttttcttgctgatcaatcttcaatttcagcttagggtccttaagtaagccgatactgacaaagaagaagctatgtgttttctagcttaggccagtcttctttgcttctttggggtgccaat

SEQ ID NO: 36423 - DNA, 849 bp, Oryza sativa
  unsure (1)..(849): unsure at all n locations
cgcgcgggttgaactagctactcatcggcgaattcgagctcggtaccctaacctcatcaggacaagtagggtctgaattaacacctaaaacgggaattgagctattcaaaaaatggctatcccgtagaagagtgccatcaccaccaacagaaatcacaagatccacatcatgtattggattagacatatcatttcgctgcactgaaatccagtcaatggatttacgctgcagtacgcttttgcagagattgattgtttccttgtgaactctgcacctatcatccagataattcaagacctgtaagaatattgcaaaatgatcatgagaggcatgagtaccgcaaaattcatatcataataactagttgtgcaagcaagaaaagcagggtagagaactcctacactcagctagatatgcaatacctcccagccacattgtctactattcagttcacaataaggaaagccacacccttgattatacttaattagaattactaaacaaccagaagtagtccctttactgactaacatctaaatagacaagaccaataagactttctggtttcacctgtatcatatcangaacactgggcagaaacaataaccatagtttagacacacgcatttcaacaaacagatggtgtgcttcatgatagccccacgaaagttcaaaagaagtgcgactaagatgaagatagccactcacagaggaaggaacagaaccagaacctccccatcttaaactatttctgtggttcataaccttaaagaacatgcaacatgttccatttgacccaaaccgttccaaaggagaagagaaaggaaattagccggcccttttgatct

SEQ ID NO: 36424 - DNA, 837 bp, Oryza sativa
  unsure (1)..(837): unsure at all n locations
agtggggtaggactaactacttcnnnnccaaccgagctcggtacccattctctcctaaatgagttgcaggcttgtgttctacatgagcgaggaaatctcctggagctggtagatccagagttaggctccgattactcaacggaggaggcgctcctcatgctgaatgttgccctcctgtgcaccaatgcagcaccaacactgagaccaaagatgaccaaagttttgagcctggttgaggggcacataccacttcaaccatttctgtcagacctcagccttgctgcaaacagcctgagctcaagcggtcagcgcaggaacttctggcaaacactaagtgatcagagccaaagcatgactgcagcacaagcatcatccagcaacaccaatgagtcatcatctttagatattgctggtagcctgagaccttaggtgagtttaaatgtcagaactcaaaagtgtttcatgagctctgtacatgtaagaaccattaggagtaggtcattttgtctcttttagaggtacagtgtaaataccaaactagtgtcagatcctactattaagatggacactctgctttaaatctttaggaatagtgaattttatatatgggcagtgctttccaattattggatggacttagaacgtacaactagcattaaactgcttcatgggtattgtacactagatgcagcattctaaaagtcactgggtagacaatgtggctaaccgagaacccaaaggtggcacctgagtcgccttcggatttaaccaacaggtggtaacgtttcttcaaagacccacaccagttgttttccaacattttacacgaaaaccgga

SEQ ID NO: 36425 - DNA, 599 bp, Oryza sativa
gattctgtggcttttcctttttcttgaacaatatattcgatcctacctcgcatcgtgtcaacggaggtagttggggcataaaagaaatccttgttcctgtaattaatgcatgttttaaatatgaacatttgtaccctgcatctgaacaccatgttatagaaaaatgtgccatgagctcagtacttaccacagccagattttgctttagacacaaaaaggtgtaggcttctatcaagtccaaacatcatgtcaggaagaagaactggatgcattggaatgggcaattggaaaaatgcatctaatgtttcaccaaccattcgaagcatcttcacacaagagggagcaatattctctctgttggcagctgaattccaagtctgcatgaaagacattgacagacttagtggaattttagaacaggaaaatcaagctaagttaattcaaacacaatatgtcaagaacaagttggactcatcattcaagaagaatattcaggacaattacatctcacaagttgactgagccaatctaacatttggtttacacatagcatgcatctggatgtgactcaactagctataattttttttccattctga

SEQ ID NO: 36426 - DNA, 835 bp, Oryza sativa
  unsure (1)..(835): unsure at all n locations
ggatgtgatgactttcngtcacccanaccaccaanacnagttnggtacacagcttctactagtactcgttctgcacacacttcacaccacctctatacttttttctcctccctctgtgcgtgcgcctccagatttggccacctccggcggcgccaaatcggagcgtggcctcggccttgccgttgccaggtgagcctggcgatccgatccttctaccctcatgctctcgttgttttttttcccactcagatttggccgatccgtgtgtgtgcccgatctaccgcgacggggggaatggaggcgcggcgtggtgttgcagtggcgcgatctggagtgtgtgtgtgtgtgtgtgtgtgagtgtgtgtgtgtgtgtacggtgtgcgcatgatagatgtggatttagagagaacgcgtaatttcaacagagatgtgtcggataagcctattgggcttaaacctttaaattatattttttacccctcatatttttttaattttaaaagaaaaagtgtttatttggaccggccttttataatatgccttactcattatattttgttttgtttatttctttaaatcttattggaacaatgcccttactttctataacggctacatcgggataatccctatgatttattcagtagcattgccggttaaacgtgtattattttcaaataattaaagcgcgtctaatctctcatttacgtatttgttgttataaagctaatctcgcttcaatttttaaaactcaattatctgttatatactttataacgtttcattcgtttatatccttacatcgttcatatgagtatacaggatactattggcc

SEQ ID NO: 36427 - DNA, 733 bp, Oryza sativa
  unsure (1)..(733): unsure at all n locations
aggatgatatttcatgccnatncancannccactggaccagtaacaaaagccctttaactgaggttgcacgctatatattcaaactgacaaaaattttgttgctatctttttcgcctttatcgggggcacgcactgacgaagctgaggggccccttctctccacttaccactcccaagcgcatagtaccgtcctacggaggggaccggatccgtcacgcctagccgccttcgctcactaagccaccaccaccgcgncgggaagaaagggagaaagaagatggagctggcatgtaagtccacattttttttctaacacctactatgggactaaattgatagtttgatagctcgggtaagattatggaataaggatcgggtgacttattcaagtactatacggatggttgatggctttcatggctggagacttcgctgtttaatggcttttgcattaaaagctaggactgcttcctttgtcaaactcagggcccgcagtgagatgcacctagcctggcccgacgatcgcgatagatttggccccggccctaggggggggacttcggatcgacggtaattgccatcctagccagactgaggtaaagaagtttggattaagaaattatatgacacactacgaaccactagtcgttgtttgtttagagcgtgacaaaccattctaggttaatcccttttacctaaaagaaaacaatgggcttatctttgttaccttct

SEQ ID NO: 36428 - DNA, 511 bp, Oryza sativa
gctcggtacccttgcaaaaggcatatctggaaaaagtactaaagaaatacagtatacatgcgagtaagcctacacctgctcccatagtcaaggacgatagatttgggaaatttcaatgtcccaggaaccagtttgagatcgatcaaatgaaagttgttccacatgcttcggctatcggaagcttgcagtatgctgaagtatgtacgcgccctgacttagcttttgttactgggatacttggcagatatcaaggaaatccaggaatagatcactggagaatggtaaagaaagctttgcgttatgtgcaaggcacaaaaggcctcatactaacgtacagaagatctgattccctagagatagaagggtattcagatacagattttgcgagagatgtagatgatagaaagtccacatcaggctacatattcactctcgcaaaaggggctatttcgtggaaaagcttcaagcaaaccgtcatagcatatcatcgatgatgtatgccgagtttgta

SEQ ID NO: 36429 - DNA, 849 bp, Oryza sativa
  unsure (1)..(849): unsure at all n locations
gcgcgtctttgacggtagnntcantttgtaccaaccgagctcggtacctgttggttttacagagttttgggttatctccatcaaactttgggaaatctgtcttaggcagtctagggctggcggatctaacactaaagctggacccccctactcccttctctgatgtttctcccaactcaaaattaacaggcgaatggtggaattggggcttactcttgaccagggtttgctccttagccttgaaggcttcggatgcgtcaccctggtgagtcgattcgacgccgtgcctacgggcgcttgtgccgcctgcgatggtgtcgttggcgtcaccgcttctagctgcgtcaccctgaccgcaatctcatccaccgccttgttcagctcccggattcctgaatccacgcatgggatccatttctccagaccttgaagcgatccgaggatgttgttgatacttgttgtgagctccaccaccttctcgcccaacacctatgcttcttcttccgctgcccccatcctctcggttagggttggatttgccttcttcctcgccagtgcgcacgagaaccgaagtgctctaatactagattgtcacgaattccatgactcttccagcgtttcgcctaattgaatcaggatttcgctagagatttggattagagattgtggaaagggatgaattgaggagggaaaggttagttaatggcatttgatttctttaatttttccgatccggttacagaccagggattttccctttaatggtcacaatgccacagaacacacacccacctgacgcggtttgccgacccaacacgggacgttaggttactcacaccaccttggcct

SEQ ID NO: 36430 - DNA, 842 bp, Oryza sativa
  unsure (1)..(842): unsure at all n locations
cgcgcgtcanggatttgacanttccnatgttgaccaactccgctcggtacccatgctataatgcggaatgattttctggatgatggcttgacgtaatctctgccgaagcttaaggtctggaaccttgaaaaacttgtgcttcgcgtaggtttttctggattctatctcaaaattttcaagagacaggtatcttcggaagccgaaagcaggtctgtaggttttctttcgaggagtatcagaagaatttccgatgaagatgcagcacaacagaggcgaccagaagacgtcaatgtaagtgtctatgtacctccgtgtcctgcatctgtctatcaaggcccaagatggcaggtccagggattcgatgccgtgcaacacaagctgccaattgtttagcaagaaaatgcaacgcaacgctgggtccaagatggaattggaaagggaggaggcaatttcctccaatttgtggccaacgcaagagatgatgtcggtgatcaggttcacgaccgagctgaagccctgtgtgtgagagaccaacaccgctgagttgtgatcctgcaggatgaaggtgaggacggttttctttgcgccagaaaagcgcgatgtagttcatcatcagcacggtggtctcatggactcctgatgctgatgccctccggcgagacttgcagcatccattcttggagaagaggatcgaacttttccattatgtccaaaacgcgtgcttagctctttctcttgcgcaagangatgcgtccatgccgtcaaaaacctggcttcttgccatggcgggagaagcccgaagcaagggaacggttcttctttgaccatgcaagcacggcggg

SEQ ID NO: 36431 - DNA, 845 bp, Oryza sativa
  unsure (1)..(845): unsure at all n locations
gtgggcgggtacaacgactaccatagggcgaanncgagctcggtacccggtataggccactggccatgattgtctgtcttgctgacgagagaaacgagcagtacaatgcctagatataaaattgttccatgatcgatcgatgagagattgagagtgctagcttgctttcaattcatccccatgcatgccaggagaggtgaatgagcatcgggttcagaattcagatcatgcttgggcccaactcctccccggttatcgtctttgccggtggggttttctccccgatagccatgcccgtctgcgaaaataaaacccctacgtcaccgaaaatgctntttctagtagtggggattgaactcgagcatgagataacaccgaacatccatgcatccatatatccgatgagtgatcgataggcattttttttgccgggacggcccaaggcaggccgcccaaattgtattaaggagcgagagaaggtttcaaaaacttttacaaatcgacattaaacagtcgaggagaaccaaaaagaaaagnnnnnnnnnnnnnnnnnnnnnnnnnnnnnctttagctgacttctctaaaaatgttggcctctcttcacactacaacttcatctttgatatctctgaagagtntccgcgcctcgataggcattggacaaccgcaacattgatctatctatctccatggacatacaaatgcaaacccgctatggatgcngatataggctacgagcataaatgcatgcatatgcngaaccgggtatagcagtttttttaaatggatcaacaaataatntttaatggaaaggtatgtatctaaaccgggattctnttaagtcg

SEQ ID NO: 36432 - DNA, 819 bp, Oryza sativa
  unsure (1)..(819): unsure at all n locations
agagagtttggatgaaccactactataggcgcaaccgagctcggtaccctgttcaacaaataaaaagggacgataggtaatgagacaaacccccaactcccttttattattaactagcgttaaacaacatagatttgtaggatcgaaacacaagaactaagccaaccagagaggggtgaatggttggtatacccaaaaaccaaaacttttatcggaattaaaagttaccctcaaattcgatggatcgcggtctgaccgaagtagacgtgccggtctgaccgcctagaacacgtctgtctgaccgaggttgtaacaccggtcgaaccgccgaggtcaatcgtcagcacctgtcgccgccgccggtctgaccaccgtgtgcccgccggtctgaccgccggtgtctcgtcggttggaccgccacacccgagaaaacacaaatcgaagaactcttaaagtggatgatgactttattgattctctctgtgtttacaaagtgcaacaacagcactccttacaaaaatcttgacttaactcgaaacccttagtaaactatcaactcaattgctcttaaaagcgataaccggaagcctcaacgctcctctctattatacatgaggtagcagctaaaggcatgaacaaactatactagaagtctaatcccctaggaaacttntcgatagaaacaacttacataccaatcatccaaatttgactctttcaaattcactcgtatccataccacacaaacctccatgtatggcatatgaatcttaacaacacttcattgactctagcttagataaccatgaatttgaccac

SEQ ID NO: 36433 - DNA, 846 bp, Oryza sativa
  unsure (1)..(846): unsure at all n locations
ccgcgtgatgactgacnatccctgccaannnncacctcnagctctgtaccctcataatgaaaccacgcgcagatggaagttcgtatctgctgaggacatcttattcagacccagactaccattctcatgtcaccacaggtcatctagtggtgattcaacactctgaacaacttcaccatcatcaagtatatgtaatgctcggaccatctcgaccagacatcattggagcgctatccctgagcaagcccaactgcaaacttttggtcataaccgctggccctcaccaccacatgctggccttatgtgacctggagctgctcgacaaggatgccaccccattctggtcaccaaggataagaagagcgctacagcgtacaaaggcaaaattaccgagcaatgtgtgggtctagagtctagaccaaatgattgaaaaaaagactggaaagggcaaaaatagaatagatcctctcttcacaagggcattagaatgattatatatagttgagtggccttttgggcatgtcagcctctgcaatggtaaatgtcaaagttttacctacaataaaaagggttagaacaccctgtagggttgtacactgtgggactcacttaaattcttctgcgagcttccggcagaaaatttcattcagacttgttctttttatgtgtaacacacttcttcattctttgcaatttgaccaggaagtatttagggtaccttggaagatgcaaactagcataagacaaaattgctagcttgtttaaccctgataattccgcatgcagagggaaaagactgtgtactatcctagtggttacttaggtgcaaggggtgggatcatttgt

SEQ ID NO: 36434 - DNA, 447 bp, Oryza sativa
  unsure (1)..(447): unsure at all n locations
ctatagggcgaattcgagctcggtacccgacagtggttttgctggcgtggcatcccagtcatcaaaaaaattaaaaaaatatgtgagggcccacatgtaagtggcatttctattcttcctctcctccaccactctcctctctcctccctcttctctctccccgaacagagcacggccggggacggcggagccggaggcgtgggaggtgtggggaccgccggaggatgcaggagcatgccacaagggagaggatcgccggccgcggcgcccacgcggggagggttcacctgtcacggcgtcgatctgctcggccggcaacacatcctcctgttgtctatccgcgccgccaacctccagcaaaatacataagctcatcaagctacctttcgannnnnnnnnnnnnnnnnnnnnnnnnnnnnnnnnnnnnnnnnnnnnnnnnnnnnnnnn

SEQ ID NO: 36435 - DNA, 657 bp, Oryza sativa
gcataataatttaataagctgaaaaaggcactattactttgctgcagtcctggagctttctgagaaatatcaaaagaaatttggccctcttcgatattttgtggctggaatactcaaattttttgcctgccaagctatttctatgagttagagtatcttccttcttcaaaggagatgactggccatggaaaaggtataggacaagaaaactttgtgtctgatgtatataccaatgtaatgcgcagccgatcaaaaagagaaggaattccacgagcttccagtttgtcaagtattgactctattatgactccaagtcggatgtcacttggggacgttgatacatcaggtagcacagcagcaagcactgaaccttcagagtatgttcgtggtcttgatccaaaagcaaaacgcctttctttgggcagaagcaacattgtttcagaaccagaggaagttttacaccctcaaccacatcattcatcattctggccaagaaccaggtccaaaacaagaactgagagaaattcagttggtgtcactactaacgatacacgattatcttgggcagccccatcaattcatgacaaggaggacatttcctcaacaatttcagatccaggacctatttgggactctgaaccaaagtgggacaatggg

SEQ ID NO: 36436 - DNA, 715 bp, Oryza sativa
  unsure (1)..(715): unsure at all n locations
ttctcatccaccacatcatttttttgctcattattttttgctttcttggaatctttattgtcaaaaacccaagtgtttctgcctcgaagattttgatttgccttttttctctggaaaatacagttggtgaagattgttgcccggctgacttttgagaacgccgactaccagaccgccgactggacttctgggatgagcttctggaagtaggattttctagatcagctacttccatctctttcttttaaagaggacttcagagcatcagtatagatcaggaatttggcatgacctcataggtgtatgatcatggcatcaatgccatgtcaaagttgctaacaactaaaaatagcctgcaccgaaaggaaaacagaacacctataagatccatctggctggtacatgtgcatcatttgttgaccaaaagcagccgttcagaaaaaatgagtacatccgagcttcatctccacagataactaagaaggtagtcacaaaaggctagcacctaaacagcttgggtctaaagaaaaaggtcctcaaaagtttgtcgtactgaaagtttgaagcatttctttagcaaataaaattctgataatatttaaatatttatatggtgatttcctatcatatgagcctgatgttcaaatatgtgcgaggaaannnnnnnnnnnnnnnnnnnnnnnnnnnnnnnnnnnnnnnnnnnnnnnnnnnnnnn

SEQ ID NO: 36437 - DNA, 745 bp, Oryza sativa
atcaatatattccagcactgcctaatactagcgtcttctccgacgacgaaaaaaggtggtagcaccaccagatagagggttggccggcgctacggtgggctggtggtggccatgatggggtggagatggcgccaccttggccatgagataaaaggggacggacggtgtgggactgtgggtggcaagagaagcttgttgttggctgaaattcaacccaaaactactgaaattgcaccttagtaccttacatttaccttacttaaaaggtggtttcttgacgaaacgtaaattacaggtagcgcatttttcttatataatgcaggcagtacatttttgctgctttatactagcaactgcaaatcttgttcttattcactaagcgatataagtctatatttattctcatcagtagtctcttgggctaaatgcactcactttgaactccacaaaagcgatcaccaattccttcccaccaaattttcacttctttagaccgaggaaggttaagacgaatccgacgtaattgtaacggtagagctgtcgcatcatggagatcttgctgtcatcccacggcgggtacctggccgtcagctcgataaggtatcctctcgtcagaaccgccttcttgtggctgaacatctcgaaggagtacttgccgtggtactgcccgaatccgctctcgccgacgccgccgaacggcagcgaatcgatcccgtactgcagagaattgccacaagaaaagatg

SEQ ID NO: 36438 - DNA, 6917 bp, Oryza sativa
  unsure (1)..(6917): unsure at all n locations
aaccttttaaaacatctctctctctctctctctctctctctctctctctctctctctctctntntntctcatttgacaagtacacagttcatcactaattttgctgcttgcatatcacatatacagaaggagttgtgcatgttaagaacagaaggaaatancaaaatcccctgtacaggacagaacagaacagaggggaaaaatcctagcaaacctgtaaatctgctaaaaggatgtccaatttactccgaaaaatgcaaatcaaacacaaaaaaaatccctatctaccagccacaaatccgagctcagtgacaaggcaaaaaaaaaaaaatccagccatcgtttccaccgatgcctagttcgttggttacgatttagtctaatcccaaatcacacaaagcagaaaattgatatgctgataatctcatccatgtactctatctgggcaatccctctcaatctttcatctcatgaacacagaaggaaaaggtactgtgaaagttcacctgcaaaaaaaacagaaataacctagaaaatttcaaatagtgtgtcgctttacctataaataaacagatagagcactgctcannnnnnnnnnnnnnnnnnnnnnnnnnnnnnnnnnnnnnatgcttttaatgtggcatcttcttcctacttttccaagcatagacacataaaaaagctgtacagagaagcaaatcaatgattacacaaatttataactgaagttgcacagatttgaaaatgcaactacaacaaccagggagtgcaatacgtcgccgaatgtatatgcagtttacacaaaacaaatgcaagcccagtccagtcctgaaaaatatggtgtgctagtacgaagcatcatttgctatccgtcggtactcaggcatgtgctgggtgaaagtgaaccaagaaacacagagaaacatttcagaaagcagagttgtctctcttcgcctcccatgcaaaattttgaacaagcaaataatctatagaaatatagcagtgtcactgtcttcagtcagggagttcatttcgtgatctctgagccaaataagatcgctgaaacctttcaaaacatctctctctctctctctctctctctctctctctctctctctctctctctctctctcatttgacaagtacacagttcatcactaaatctgctgcttgcatatcacatatacagaaggagttgtgcatgttaagaacagaaggaaataacaaaatcccctgtacaggacagaacagaacagaggggaaaaatcctagcaaacctgtaaatctgctaaaaggatgtccaatttactccgaaaaatgcaaatcaaacacaaaaaaaatccctatctaccagccacaaatccgagctcagtgacaaggcaaaaaaaaaaaaatccagccatcgtttccaccgatgcctagttcgttggttacgatttagtctaatcccaaatcacacaaagcagaaaattgatatgctgataatctcatccatgtactctatctgggcaatccctctcaatctttcatctcatgaacacagaaggaaaaggtactgtgaaagttcacctgcaaaaaaaacagaaataacctagaaaatttcaaatagtgtgtcgctttacctataaataaacagatcagagcactgctcacctagaacttaacaaaataaaaaagcaacagctaggcagttccctaataattatttgaacatataaatctcatcggcatgacatagaaatcaacagatcagggcactaatcacctagaacatataaatctgatcaacaatacatagaaatcacggatccactgaaactaaaacgaaaacgaaatcgactcaggaccaagcttcgaaaccttgaccgattcaaatcgagaaaactaaccaaaaaaccgttgaaaaaatttcaccagtgggaactacaaacgaagattggactcaccggttgaatccagggggagaaaatcgatccaaacgatggatctctctccctctcgctggagagaatgagagagagaacaagaaagcgagagtgaacgaaagagagagcgcgcgcggagacaacgaggagaaagcgataagtaagaaaaaaaaaacggctacggacatggcgtggaaatcgaaatttaacagcgccacgagaccgaggagaccaggttttgactcccacgcgtcctgatccaaaccaaaccgtgcacgcatcttaaagtatatcggactaccaaaaaaaacgacaaatatcgggagaagaaatttaatgacaaatatctagcaaaatcgtttttttttctttccctattctatcaatatattccagcactgtctaatactagcgtcttctccgacgacgaaaaaaggtggtagcaccaccagatagagggttggccggcgctacggtgggctggtggtggccatgatggggtggagatggcgccaccttggccatgagataaaaggggacggacggtgtgggactgtgggtggcaagagaagcttgttgttggctgaaattcaacccaaaactactgaaattgcaccttagtaccttacatttaccttacttaaaaggtggtttcttgacgaaacgtaaattacaggtagcgcatttttcttatataatgcaggcagtacatttttgctgctttatactagcaactgcaaatcttgttcttattcactaagcgatataagtctatatttattctcatcagtagtctcttgggctaaatgcactcactttgaactccacaaaagcgatcaccaattccttcccaccaaattttcacttctttagaccgaggaaggttaagacgaatccgacgtaattgtaacggtagagctgtcgcatcatggagatcttgctgtcatcccacggcgggtacctggccgtcagctcgataaggtatcctctcgtcagaaccgccttcttgtggctgaacatctcgaaggagtacttgccgtggtactgcccgaatccgctctcgccgacgccgccgaacggcagcgaatcgatcccgtactgcagaggattgccacaagaaaagatgacatcaaataactctgtagtacgtactggatctgcaattcctatgttcttgtttggatgggctcagtttggcccatataaactgatgggccgagattgaagcccatcaagcaaggcctgggtggggtaaggcgtgtgtgcatacttgtacaactgcgtcgttgaacgtaacgctccccgacgacgtctcctcgacgattcggcgcctcagtgcggcgtttttggtgaacgcgtagacggcgagcggcctcggccgcgctctcacgaaggcgatgctgtcctctatcttcttcacctgtgagaaaggtagccgtttcatttgatctgtctagtggtactccgctctgcatagaggaggatgttaagaactttttaatttaccgtgatgatgggcaggagagggccgaaaatctcctctgtcatgatcgcggagtcgagtgggggattcagcagaatcgtgggctcgatgcacctgaaattttttcgtgagttggtcaactttgggttgtcttaccgacagattgatcaacgacacgcagttttgttcagaatttacaggttcttggcgtccaatgtgcccccgtggaggacggacgccgcgaccgatttgtccttgagaaggtcactcagccgctggaagtgcctcgcgttgacgatccgcgccatgtggtccgagtcggcgaagaacttcttcagcgtcgacttgagcgccttgatcttcggacgagaccgacacgtgcacgccgcgagacagacacacaaacgtcaggcacaaatgcgactcgggtagcaaagcagaggaggcgtgacgtgaggtgaaaacgcaccaggacgggcacgaagcgctcctcgacgaggacgtagtcgatggccaggcaggcctggccggcgcaagacgaccacttgcccccgacgacgcggttcaccgcggtctgcaggtcccgcgcgctgccgccgatcgtgtcgaagatgcaggggcacttcccgccgagctcaagcgccacgggcgtcaggtgcttcgcggccgcggccatcacgacgcgcgcgatgcgcgggctccctgcaatgccgcgcgcgacagaaacccaacacatatcaacggcgtttcagccgggggacccaaaagctaccagtgtgtcctccatggaccatggttatattaccggtgaaaaggaccttgtcccatctgtgttccatgagctgctcgccaacctccggcccgccctggatgaccttcacggccgtggcgtccatgtatttgccgacgttgtcgccgaggaacttagcggtggccggcgccagctccgatggcttcagcgcgaccgcattgccggccgccaatgctccaacgagaggctccagagagaggcctgcatgcatagagcacacaaagtcgttgcctgattagttgatacagtacccaaaagtagccagtcagtgtactacccttgtccctcatggcctcgtgggcacccacccttgcgtctctactctctggattattacatgcatgcatgtgcaaaggctgtggattgtggtagccagagtgacatccacaggcgcagaccgcgcgcagatgaacggtcagtcatttacgtttttcacaatttcactgcctgtgaaaattctgactgctgtatcacatgctagctagtactatcaccgtcccaaaataagtgcagctatagatattcgtgcccaacgtttaaccatctgtcttatttgaaaaatttgtgaaaaatttaaaaatatttagtcacacataaagtattattcatgttttatcatctaatagcaataaaaatactaatcataaaaaaaatttaaataagacgaacggtcaaacgttaaacgtgaataataaaaaactgcacttattttaagacggagggagtacgtcgcttggtttatgctgaggcgagcatagcaggggtacacatgctaatacgctgtttttgcaaaaaagaaaaaaaaagtagaaagtccaaattacccttttgagcacacagtgaaataagtatgttgctatagtaaaaaaaacagtgatttgcagtttttactgtagaaagtcacggtactgttaacctctgactttaacacctaaagtcaggatctcaatccgtacgaattacctctctcaattaaaaaaacaaacatattttttcaccctcaacttgttacactgaacgaaggccaactccaaagcagtttcagtcctacgtggcacacacatggaagtccaatcagcataaaaaatatataaacaaatatggggcccacttgtcagttatgcttctcttggtcagtacatgtggtccctatctttttaatgtatttttatgatgactggactgccacatgtgtcatgtaggacctaaaccactttggagtctattcgagggataattcgtctggtattaaaaattgaggacgatgaagaatgtctagttttttaattgagggaggtaattcgtagtactacaattttttttttggggggagggaggggtattcggattttttcagaaagaaacatgctgaacattgggtttgacgactgaagcaatattctgagacaacgccccaagtataaactgattgccacccaaaagaaaagtactttagttccaactatcaagcgtcaaactagctaccaaaagaaacagtggtagctctgtgtatgttgagtttttctgggacggagagatatattcgtctgaagtactactacgaataatcaaagtttgcatgttagcaactggccctactagcaacaggataccatagcacagctattcgctgttacttaaactcaaaagctgtattgaatccgacaattcaaggactatcgtaagctaatcatgtgcactgagctatggtactagtacaccctttgagctgaaggagtgttggccagccagacaatcggtaggacgtaaatgagtgttgctatacgtccgatttcctcgtccgacccccatccaatccaaccttatctaccaatcgtttcgctccacgcagaccaacttctctctatgtgggcctctatgtgggccagagcagttacggagtagcagctaagtgctggtcggacataccagtcatatgtatagcgattttcgacgttaaataccctcacacaaacacaataaatcgaatagagccttctaatactccgtatatacgtttgctatatatatattgctattcttctatactcttgtactgctagcagcatgcatcgccgcatggcaggcagccatagctatatttgtcccgacaaagtataggtgaaaatttaatggaccgattcatcaatgcgagagtagcaccgttttcctgacaatgcttcacatgggcagccgcactctctgctaatgctcttgcttgaagaagggtaaacgaaggaaaaaaaatcgctgtgacctgtgagagattgatgatggtttgcttacccaacgggacattccagcaagagaagacgaggatgaccccgagcggctgcggctccagctgcgcccttgccgggaacgcgattagcggcacccagacctgcaaccagcgaggcgtcagaactcagaaccaggagaagcaaaccattcatgtaaaataatcgaacagtgcacactaaagcgtggtcagatcaggcttgccttctccggcgccatccatttcccgacctcacgcagcgcggcgttcgccgacttgacaagcacgccgatctaaaatcacacaaccattcgcatatatacaagttaaacggaatcatatcagcagatcgatcagttggcagtttggcacacgggaaatgccaaatgcatattcatcgccaactaatcaattaacctcgtctctgtaggcctcggg

SEQ ID NO: 36439 - DNA, 4235 bp, Oryza sativa
gtaagcctcggcttggtgcttgccgaggtcctcgcggagcgcccggaacgcggcggcctcctcctccgcaagagccggaggagcccccggagctgcgactgcctccactccaggctccgcgtcctgccgctctcgtacgccgccctcagctcggccaccgtcccgctcacggtctcgccgggcccaagcgcgggcggcggctgctcgcccccgacctcctcgacgctaggcgccacccttcccatcctcctttcctcactctgcttcaccaacctcactgactcactccagtgtattgaaactttgcaagcagaaagttgaagaaagcctcgggccggcgaggccaatttatggcaactgacgtgcgcttgagcctatggcctacgctacgcatgaatgcatgatacgaattaaatgctggcaccagggcggttcagtagaattgacgtccattattgttgtaaactggtgcaaaggtgcatcattggtactactgccggttgctaggaccgaaaaagtgagcacatgccatgcgcccatgccacggagaaaacttgaggattttgccagggccagggcgatccatcgccgtccgggtgagtacgagggcgtgtgctcgtagcatggttgtgaattatattctaataatctaacctataattcaccaactacctcttacatccttcatactttattcatcaaatctaacggatgaaaatcatcgaatccaaccgctcctgttgccccacgtctcccccgcctccccttctcacaccccatcactcctgaaatcacggcgcatccaccctcctctctttctctctagctcttctctcctctctctctctcgcactcacccgacgtcgccccacccgcgcgtcaccgattccccatccacgatttctctcctctcccgcgccgcccctccgtcgtcgtcgcgtgaagtcctcgccgatcccccgcctccgtcgtgccgatccaagtcgcggcatcgtcaaacccctgttcccaggtcgccgtcactgatcccgcatctcctctgccccgttcttgccgatcccccgcctccgtcgcgccgtcacgtcgccgattccctctcctcgtcgggagcgccgccgggttcagtcgacgctgatccccaatttgttgtcgccgcctccttctcccctgattgaagtgttgtcaagtttctccgaggtgtttgtttttctgatggttaaagtgtagtacaaactgtgcaaataaaatcaatgttttcatcccgttcatttggtatccatgactaaaattttcatcccgttcatttggtatccatgactaaaaattattaggacttgatctagcctgagatagcaacgatcgattcattttttttcttttcaagttgtgctaatgtatgtatgttcagaattacatgccatttgggttcacatgtcattagagtagctggactttcattcatttatagttacaataattcctgttatcaattctccagtggtatatttgctgaaaatatatgaaacttatgaaacttgacacaaatctcacatcttaatagatcaaaatatatgtaatactactcaaataaacttttcctgaaggttttctattgtgctatatgtattatattttcagatattcacaacctattttatactgttgattactgataatatgggaagcattggtaagatgtacaggaatgatgattatagatatatggtacagcaaatttgtctatcaccaataccatgcaatttaatgattttgtgcagtccttgattaatgacatcttgaagtatatatacagttaggacaatgtcagattaaaatctaaatccatgcttacagttacttcacatctgaagtaagataaattatcctaggaattaaatccaagattttattggtattttggttcttaggattaggatttttgcatgaaaagagtactactagattgcagctaggtcaaggctctccctgaaacagccttttacatggacactgcatagtaaggtccagtgagttttatcatttcagacgtgtgcaactctctgttctttactccttgcccaaataaattgctctatataagatatccagttataagctctagaattttgaatttgatttttttttgctcatttttgcctactgcacgtggaatggatatcctgcttaatgaatactatcatgctgcaggatatcctgcttaatgaatactatcatgctgcacttttcctttttgttttggtgaatttagtactatgcagttggccttgatcaattcgtgctacttttgtttgcagttagtgaaactgagtttggttctttctattctattcagatacattgtttcatgcatgatcaatgactcaaatctcaatgaagataggcatattgctattccaggttggttatctgaatgtgcgcaggtttgcaatttgcatatcattggatgtatatggttgataacttgatatgggagtaattgggaaatctgtgataaggtatgaaccttcccttttgaagcatttctacagcaccattgaagtaccacatagtttttttggccatatttatttataaccatgcaaggaataataactcttcctgattagggctaatttttttttacaaaatctatgattaacagaattgttctaatttgaaacagagccctctggtttagagcttgatcagtgagttaaaaaaatggtagaatatgtgagtaccgaacatgttataatttgaagcgcactcctctgattgaaaacttttgaccagttaggtttgaactttgaattatgtctcatctttatgcatatactttctttcatttcaggtgagggtcattttatttagagattgatttgaaaaaattgtagtaataactctttctaattagggctaaattttgtataaaatatttgagtagaagaattgttctgacctaaaacggagtcctaacatgatatcagtgagagttacaaaatggttgtaatatctgtgagtacgaggatcgttctaatttggaactcaactcctctgatgacaactttaatcaggcagtgtgaattatgcatttcttgttctcatgaacaatatttgtttgaaaagtgaaagatcagaggtatgttttaccacggtggatgaacagaaagcccggtgaggatgacaaacatggagtgaagagggtatgatgtatgctgtggccagaagaagttgctcctatgatggaaattgtgagcaagacaggccctcgaatcctttttttttccctgatgaatctgtaatttggatatgctgctggaatcggttgaaatctatttgtaactccactttctcatttcccatcatatatgtatgcaatgctgaaagtgatgtgaagaggggaatagatagcgtgtagcctggcagactatggatcattggattgcatctatgttttcgttggtcttgcgggtttgagactttaagcttgagaatgtatttctatttttggatttgtctttctgtcatctcgatggatggatattgtgggtttttagttaacttttacctaactcattttatttatgaataaaaatgtaagtttaataacttattatttattcaaatgttatgggataaaatccttatttgtctctgaaggttgacatttaccgaatggtaccgtagcgtcagcgcacgggtaagttactagtgtgaacaattcgatgggaatacgggattgaccatgtgtcatcatctgcattactgcagggagaatcaacatacgtgtccgatctgcgttcgtcgtcttcaaggtgatgggtcgaatgcgcatgcttcagccgttcaccgccagggaatatgccgcgcgcgttctgatacgattcattttcttgtggacagatgagttctcaacgtataaaccttcgcccccctcaggccttccagtaggacgtaactacacagcgctaccacttcatctataaatctataagagcacaccatctacctatatttcaaatacaattttcttttaaactactcatccaatctacgatccgattgcaccgttgtattcgtaacaattaaatctttacaacaagatctcacatgattatattttgataaaaatcacaaattacttttatgatatgtctaaattacttttaaatatcactaagttacttcttagatatataaaagtaaattcagtaaaacctaaaagtaatttacat

SEQ ID NO: 36440 - DNA, 2937 bp, Oryza sativa
  unsure (1)..(2937): unsure at all n locations
nnnnnnnnnnnnnnnnnnnnnnnnnnnnnnnnnnnnnnnnnnnnnnnnnnnnnnntgtctctgaaggttgacatttaccgaatggtaccgtagcgtcagcgcacgggtaagttactagtgtgaacaattcgatgggaatacgggattgaccatgtgtcatcatctgcattactgcagggagaatcaacatacgtgtccgatctgcgttcgtcgtcttcaaggtgatgggtcgaatgcgcatgcttcagccgttcaccgccagggaatatgccgcgcgcgttctgatacgattcattttcttgtggacagatgagttctcaacgtataaaccttcgcccccctcaggccttccagtaggacgtaactacacagcgctaccacttcatctataaatctataagagcacaccatctacctatatttcaaatacaattttcttttaaactactcatccaatctacgatccgattgcaccgttgtattcgtaacaattaaatctttacaacaagatctcacatgattatattttgataaaaatcacaaattacttttatgatatgtctaaattacttttaaatatcactaagttacttcttagatatataaaagtaaattcagtaaaacctaaaagtaatttacatatatattatagaagtaacttagaacaaaacgaaaataactttggtatgtcatttgaagtaaatccgttgtaaagataaaaacatgactatatctagaaattaaattaatcagcacaaattatatatacgcataatccgttgatccgaggtttaaatctgcatcttggactcttgataccgtgcattcatttgttcattcagccattcagaccctagtcagagcctgctattctggttggcgcggcaggcggagcatgtggcgcgtgtcctttcctttcagcccctctcacgcagcgactagtcaaacaacagtgggtccaaactccaaaaaggctgcatgccttcatgggccccaggccggtatgtgggaataagtttattttatgttcctccgtttgttgtccccgagtctgaaaattatccctggacagcaaaacaacataaagtatccccaacttacaaaagcaggccaacaagatccctcggcagcattgtccttagttttaactgacgtggcacctgcgttggtccttttactaggttttcgtcccatgtggcattgatatggcgtttacgtggtaattcgatccagaaaaataataaaaccatcgaccctatcaattacacataaaataattaaaaatggtggggccatatggtccctctccctcatgtcatccttactcctcctctcttctctctatcctctctctctctctctctctctcccatgctaggagcgaagcggagcaggcggggcggtgccgggcgaagcgggcaggcctctaaggaggttgagcgcagaggatgtccccgtcgtcgtcaactgctgtcgcacctgccatagctgcacactcgtcggtggccgctcgagctcctccatcattgctaccccctcctccgctcgctgcccaccccgcacaagggagaggagcaccacgcggggcaacaacgggggagaggaacgctgcaccacggccagtgggagagaggagtggttgctctcctttccctaccagatccccgtccccttagctctagctccaccaagctccaccagaagccgcccgacaaaggggcagagaggaaggaggctcaacggcctctccgctcccctcaacctccccgtctcctcctgtccctagctattgcctcaccgacctccccgcctctccctctctgccattagatgaagacatgaggagataaggtagagagtgtgagttggaggaagtgggttccactgacatgtgggtcctacttttttttactgacatacgggtcctgtttgttttgtttaatttttttgggcctgtttagattgtagccaaaataaaccttaccaaattttggtaatgccaaaatttaggcaagataccaatatgccaaattttaatgtatttaccaaatttggcaacaaactaaacgcatacattttttggcaactttgtccagaaatggtatggttgaaaatggcatcaatctgaacagccccttggttttcaatttttcttttttttttatcaaactaccacgtaaccgtcatgttaataccatgtgggacgaagttctaatcaaataagccacgtagacgtcacgtcaaccaaactcggggacaatactatcgagttgcccggattttgtaagctggaggacgggttgtatttttttttgtttgaggacgaaaatcagatagaacaacaaatttgagggacctaaagtgaactcatttggtgtgtggacatgtggcttgttttgccgtggtgggctgatgcgatcatgcgaaggaataaggttaatctgaacaatactagatatcttcaccacttaactattaaaaccggtgtaatgtgacttcctcaatggtttttaaatggtggttttgctgacgtggtgtctatgtggtggtgttgaccggacgcggcttgcctgctcccctacagtgctcccatccgtgctcccgatgcatcggacggctttgtttctccagcggtgggtcctgcagcttcttttgtagccttccaaatcagcgatgatgtttttccaaaagaaaaaaaatcttcaacgaaaagagaaggctatgaggtattggggtatggcggacgacaagattagtgtatgctataactattccttaatgatccatttcattcttttcctaccaaagaaaccaaaggtaatgacctcagatatgaggggaaggcatctctacgacctgttctatctaatactattggaatctggagtcatattgaacatgcatgacgtacaaaatatcctaataatctgttgcaca

SEQ ID NO: 36441 - DNA, 606 bp, Oryza sativa
gctcattattttttgctttcttggaatctttattgtcaaaaaccaattgtttctgcctcgaagattttgatttgccttttttctctggaaatacagttggtgaagattgttgcccggctgacttttgagaacgccgactaccagaccgccgactggacttctgggatgagcttctggaagtaggattttctagatcagctacttccatctctttcttttaaagaggacttcagagcatcagtatagatcaggaatttggcatgacctcataggtgtatgatcatggcatcaatgccatgtcaaagttgctaacaactaaaaatagcctgcaccgaaaggaaaacagaacacctataagatccatctggctggtacatgtgcatcatttggtgaccaaaagcagccgttcagaaaaaatgagtacattcgagcttcatcttcacagataactaagaaagtagtcacaaaaggctagcacctaaacagcttgggtctaaagaaaaaagtcctcaaaagtttgtcgtactgaaagtttgaagcaattttttagcaaataaaattctgataatatttaaataattatatgggggatttcctatcatatga

SEQ ID NO: 36442 - DNA, 684 bp, Oryza sativa
tctagtatttcttattataattacataatttttatatgaagatgaatgatcaaatatacactcaaataatgtgaatagcataaaaaaagtaatggttgtaaggcaaaaaaaaaagggttaaatgggggagtgaaagaagcaggtgtatgtacaaacgggatgaagcaggtgtatgtacacgtggctaaggcctatctattaattccaacaatccacttcaaaggtgcttttttacattatattgggtgactaatagcaaacaaattaacaaccaataatcccaaaaacaaacaactaacaatttattttatgtcggtttattataatttataatctagattacaataatcttaagctgaaacaaattttaatctaatataatggtctaaaataatagacccgccaatttacattaaaaacaaatttattcggtaaataatgaagtaagcacgtaaagaggatgatattttttggcttttttttcaggtgaatagtactatatattcgtacgtacttaggatattctttttggtttggtatgatatataccatgcaatcgggatgagggagccttacgtacgcgcaggtgagatgaggggaaggactaattttttttttagtctaatcaaatctaatggcctaaaataatggacccaccttttaagtgaaaatcgagggctagat

SEQ ID NO: 36443 - DNA, 1473 bp, Oryza sativa
cccattagggcttgttcggttgggccattcctggctgggatcggggcccaatccccatggaaaatcccggcgtggaaaggataccggcccacgcaagtataggcgttcggttaagccgaggcgagattttatcccggcccaccccggtgttttcccctcgtcatcggccgggaaatattcagcttctttggtggcgaggaaaaaatcctcttgacgcggcgacacaccgagagggggcgctgcggcggggacggctgcacggcgcggtgcgactccgacgcgacggcgacggcacgctctctcctccggcagttgactcctccggtggccaccttcttcccggtgagttccttcccttcccattagcctcctcttccagtgttagggtttcttgcgctcgtggcctcgtgctactgcggcggtgcacgacggtggcaggcatggcgggggacgccgcagcatcacaccccctcaccatggcgccgttgaagctctaagcgctacagtaaggagaagcaggaggacatggatctgttctttgttcctcacaaggtttcttgatttattcttctttctcccttgatttgttctgagtaatattcctaacttagtctgaagctctgatcatgtccttcctggatctgatcctctgtttgtagtgccgtagtgagaatatgttgattctcctggtagttgagtagttgaaagaccacgttttctgattctcaatgtgagttgttttaaatttgtacataaaggttatgaaaatggtttattcttaaaattagttggcaggtaatagtaatgccacaaaaacatgcagtgcgtaataatattgaggcatcagaagtgaatgctgttcatttttcagaaatagtactagacaaatgttgttcatcagaagtgattccaacaagttgtctgcccataatacaagtagatcaacgagccattccacatgccatattttctgaacaaagtacaaagttcaaattgaagtagtaagaaaaatgagtcatgtgcagctttagttcaggcctgtaaaaagctcttggcagtcggcagaatacaacttacttaaatctgaactattttggtacatggttcaaatggtctaaaaataatttcctaggttggtccatttttagtagatcttttgtagaaccatctaatgaagaaattctggatgtaaatcatgatttttgcagctattgcttgcttaatctgcagactactgatttttgcttctactatagctactattgaattcagttttttgcttgctcaatcttatgtgtcctaatttcattttgatatctgaagcactgctagtattagtctcatatgcatgtccatgtttctagcactgctagctattaggcaaagcacacaatacagcttacaaacaatcacttgtcaaactgaaaacttggtaaaaatgttgccaaggatcaatagttggctggttccagg

SEQ ID NO: 36444 - DNA, 602 bp, Oryza sativa
tacggtcctacctcacaaaccagagcctggccaacaccagcgatcagaacaatattctttcatcagctctttcagagtttcagttcgttatattattatatagcgaacgctggtcaattgacaatttgttgtttagccacacattggctccttgctgttgctgttctcggacggacctgcattctcttttactttcaaccacaacagagtactctgcctacgaactcatgaacattctacagatcagcctgtactgttacgactgtacacaggacttccgcctgccgccattgatagcggtaacaccgtatcaatgcaagtagttaatggagagaatatcagcccatgttaaccactagtaagtatatattccagggtaaaacaggtaaaacctgtgatacaaagcagtcacataactgaaaaagcgcacgatagtttgtgctactacaacagtaaaccaggacagaacacatccaacacgatgacgacgaggtcatgggggtttcgacgatagcaatactggcagtacgaattcgaggtgccgcacaacggcgcaccacattcacttcagcagggttttaacgatggatttgacattgagc

SEQ ID NO: 36445 - DNA, 3699 bp, Oryza sativa
  unsure (1)..(3699): unsure at all n locations
gttgggctttccccaaacggcattaaagacctcttttagcagtgtagattggggagagctagctatactactattctacagatccaggtttcggtttatccttgtaaactatatcatgtttttatagtcatctggattgaatctcttatgtatggttttggtgttgattttctaacgatacatacattaccatcgaggaataattttttagcatatatgaattgaatccaaatatttgagagcgcaaacaccaaaagaaaaaagacatgcacactcgagcaataatgtgtaacacatcaagaaacatgcattatctttaaatttgacgtcgttgtctctcgtggcccatttttgtagtaagagggggataactagtactttaatagaatatggcgtcaacgaagcagataccaaccaaaacaagttcaaaatgttgtgcaatcaaggattgcagcgccaaccatggtgatacatatccttgcaacacgaacacgtgaactttgcaaaaatgaagttggatacgatttgactgttttgaaaagggcattaattaagcatgaggtagatcaagattgaagtggaaagaacttgggtatcgcggtcactttgtggttagaaatcgacataatatactttgactaaatgaactgaaatccacctctttaatcacgtatgttgcaacgcctttatgttgttggaagtgaaaaaggatggtgggtaatatatgagaacaatattagtgaggagctcgactatccttatgtggtagaaaggaatgacaccgacctaacaaacacaaccgaatgatatggataagaggatgtgacgaaggcaccatgctttaggctgataaaattaatggggcatagcagtgaaggtggtggggggtggaggaggctaagtaggggttgcataagaggccatatgtgctggtgatgctgagggaggtgttgcacggatggatcggtagggcaaagttgggttgcttgcacaaaaactatcataatttggaccatccgtccattgacacttctaccggttataatcttttggaaaaagtacgaattacccccccctcccgaactatcgaggtcagccgaattacacccccgaactcaaaaaccagacattctataccctcaactattgaaaccggacaaataacccccctgactcaatccagagtgattttgagtccacgtggcagcccagtcagcattttttagaaaaaatattagtgggccccacctgtcagttctccacccctctctatctctctctactctatcccaatctctccccctctcttgtaaaatcaaaggtgtttttgattattattctgtgatgaacaattggcattggagattattggttttgatatttggaatttattcacgaagtggttttggagatgactggatttacaggtgaatcacaggtactgttatttcatgtgaccgatcagaccgggcaggtgttgccggtcagaccggcggtgatcgagtggtcggaccagccagcccgcggtctgaccggccgacactgtgtcggtttcggtttcgggttgtttgtttggatatccgtgtttatttcatgattatggcttctagatagatactatatgtatgtaatactgttgtttgctactaatgagtcaagttggagatagcttggtctcggaatatggtttctttgtttatttcatgcgtaggcgactcgatgtctcgggagagtatttgcagtgatggaccgggagtcggcttggggataagacgacatctgtagtggtcagagatcatgcgggatacttaggctagagttgatgcacgtggttgatggagattccatatggcatacgatggaggtatgtgtgcgtatgggatgcggagtcgaatttggaaggagtccaaatttggtacgattggttatgtaaagtttctttcttgtactagagggtttcctaaggtgtttaggacccttagtatgagtttggttcgtggctttaggctgcctacctcatgtataaatagagggggagcgtgaggctttccagtatcgcttttgaaagcaattgagttgagttttgagttaaggttgcgagcttagtcgaaattttgtaaggagtgctgttggtgcactttgtaaacaaagagagaagtaataaagtcgtcatccactttaagagttcttcgatttgtgtttcaccgggttttggcagtctaaccggcggtgcaccggcggtcagaccggtggcatcgcggcggtccgacggcgggcacacggcggtctgaccggcggcgacaggagtcgacggcaggcgttctcggcggttcgaccgatcaatctacatcggtcagaccgacgttcattaggcggtcagaccgacagatcaatctcggtcagaccgagatccgttgatttcgagggtaacttttatttccgctaaaagttttcggttcttgggtataccaaccattcacccccccctctggttggcttagttattgtgattcgatcctacatctctctctttcttctcaccagcacgcggtggccgcacgagggcgggagcaggcggcgctgccggcggcggagggcggcgggcggttgagacggaggcggagcgggcggccgacagaaggaggcggagctcgcttcccaatttctctttcccaatctctttcttcgaggatgacggcggaggcagtggcgaggcgaggcgagcatgctagcgaagaaggcgagcgcggtgacggaggaggcaagagcggcggcgcaagggcgggcgggggacggcggcgcgagggggcggtcggagggcggcgacgcgagacgaggaggcggaggaggtcctgcatgaacgccttgatgccgacgtggccgagcttgatctcgagggagggatcgaccatgggtgacctcacggcgccgctcgtcgacctcggcgggttctctccttcccccgacaccgctgcgttcgtaggggacctgtaccggaggctgtggccgaagacaatgaggcgaccttgaagcacgatgccagacgaaacgcacgacggcagcgtagcctggacgaggagaaggaggaggacggcgatgccaacggcgccatctacttccagctccgcgctcgccaccgcttggcccgcctgcgcccggcccgccgttgctgcgtcgccacaccacctcgtcccccgtcgtcggccgccctcctcggcgccgcccgccagtccgccacctgccgcgtgctcctagcgacgccacagcccaccaccgtcctcgccgcccgcaacgccagagagatgagatgagagagagagagagagatgccgtagccgaggagctcgagagggcagcggactcgtcgcgtagcccgctgccacgctgttgacgaaaaattcaaacacaccggctgggagatctgcttagctcttgtgcaggtccaaatattgacgagatgcgagcatgccagtcagtttgatcctgcaactgacaagatatgcaaatagtagatcaaaacaaccgatcggctgacaagctgatggagtagttccagccgatgtcgataccagccgatagcgatagggtttaagcaatcagttatatgtccaatgtagataatgatataaaggcaatcggnnnnnnnnnnnnnnnnnnnnnnnnnnnnnnnnnnnnnnnnnnnnnnnnnnnnnnnnnnnn

SEQ ID NO: 36446 - DNA, 5978 bp, Oryza sativa
gagcatgccagtcagtttgatcctgcaactgacaagatatgcaaatagtagatcaaaacaaccgatcggctgacaagctgatggagtagttccagccgatgtcgataccagccgatagcgatagggtttaagcaatcagttatatgtccaatgtagataatgatataaaggcaatcggctgacgacgatgtaataaaataacaatataatccagtataaaccaatcggcaaataatgatatgataaataagcatcgatccgaaggtcaaatcacacatcggctggaggtccgatgtcatgaaatccataagattagattaaacagtgaaatctttgttgtcatcggctaaatcctacttatatgtatatgcaatccttatgagccgatgcaacatccagataactcatcggctgaaaccccgatgaaacccttattggcaatcaagaagcaggctagagattatggttctaagcacgacttagtagatcaaacttaactgatgcaacactaagtatgaaaagaaacataatatctagacaatcaagccgttgactgagtttttagggtggtagatgtctaagctaatctaatctagcaacgcgatttagcagataccggcagaaaccctaaaacgagaagcagccgatagaactaaatatgctaaaactagattaacagagacatatgataaataggtaggcaaatatatcatccaaaccagagcaatccaagaggtcgaatgtactgatgcagccttgaacgacgccgacgtagacaatacaattgcctggaccggctgaacattggacttatccctttgccggagatcgaagacgatgcagccccgcgtcgggtgccaagttccgtcgaaacgtaaaaacaaaagtataagtaaaaagggtggcgatgcgccgaattgtattgatcgtagcgattgattacatagaccccgggtgtacatatttatacccatgggttgatacaagtccttgtcggataagaaagaaactaacctaaagataaaaggaaactaacaaactattcctaattaatagataaattgccatgccgcatcctctttaaactcggtcacttagggataagcttcctttattagattgatttccttaaccaaatatagcaggaacccgactattggcgacttgataactcctatcggctgattccgagatgttgcggccgataatgattctaagccgatgacgtatttgccgattaccaaattttactgttaacacacgccctccccgcgatgccgccgcacgacgactccatattcctcctcggcgcggcccaccagccgccgcgccctcccgtcgtctccaatgccctcaccaagctcgaaatggtgatggcgccgagacgacgcaagaagcagcgtcactgcccgccgccccagcccggcggcctcccctcaagccgccgccgtactgcccaacgccctactgcccgccgccgtgacgctagtcacccatcgctgccgtttctggctttccgtgagagagagagagagggagcaagagagatatggaagggaaaggaggtgggagaacatatagaggagctgaccggtggagcccactttttttaattaacttttcactgagtagacaccgccacgtgtatgccacgtaagatcgaaaccgctctggattgcgctaggggggttattcgtctggtttgaaaagttctaggtataaaatgtctagttttgtactccctccatactcgtaaaggaagtcgtttaggacagcgacacggtctccaaaacacaactttaacttcttatttctataaaaatatttattgaaaagtgatatatgtatatttttatgaaagtatttttcaagacaaatctatacatataatttttacattttaaaactcaacaacttgagagttattcattatttatattcccaatgtttgacttaaatattgtcctaaacgacttcctttatgagtatggagtagtagttcgggggtgtaactcggccgacctcgatagtttggggggggtattttgtactttttcctaatcatcttttcgtccatattatacgttactctgggtttatcgtaaataactttttctatgtttgattaaatttataaaaaaatagtaatgtttgataatactaatatggtattgtaaatgtttctacgtttttatataaacttatttatactttaaaaagtttatttattacaaacccaaaataacttgtaacgtggaacctgtaggtacgaacaaggtagtagaggagcagagatcgatcggctaaactcccacgtgaaccagacgctgcaccaaaaacaattgcaaattgcatcttcccttccatgccggatttccccgatcccgctgaagtcgatcgtcctctttttgctggctttctgttgactgttattttatttatctctcgcctaaataagtacaggccggcccagccgatagatcggaccggccgatcgagcgattggctggctcacacgcgcgcgcgccgtgcgagcaggtgacagccttgcccgccgacgtctcgatcgatcgattgattttggctccactcgcgtacgcataaaaaccccctctctctccacacacaccatcaccgcgcgcgcagcactcgcaggagaggatcgagttaaccaagtacgaagcgagtagttagcgggcgagtacgtggtgtttgtcatggaggacgaggcgacgtcggtggcggcgccgctgctgcggccgcgcggcggcgttgacgcggaggcggtgaagcagcagctgtggccggccggcgcgagggtggcgggggagtggtgggtggagtcgaagaagctgtggcgcgtcgtcgggccggccatcttccagcggatcgcgctgtacgggatcaacgtcgtctcgcaggcgttcatcggccacatgggcgacctcgagcttgccgccttctccatcgcctccaccgtcgtcgccggcttcaacttcggtttcctggtatgtgctgcatgctgctttatttacgctactaccaatctcacataactttgtgcttaaactttgtctcgtatgcacttgatttggatcgagacaaaagtagttcattgcaatattcatcccggctagaattaaaatgaccagctattcggacagcttctctctgttctatcatttgattgacacaaatagaaaccgcaacgacttcatgcccaatccagctagtcatgcatgcccgctacataaatttcaagttttcatatggaaatcctgatgaaagtgtccgacagctaagcaattaacaccttgcaagaaatggctcatcagttatttgtggcaaattagctcacttcacactgttacaccgtaaattaagtagaattaatgtcagcattactgccaaaacagcagtgtctagtactagtgttttaaggactagctagacttcgtcgtctccaatttgtatgcgcgtgatcgaattatgcacgcggttgttggattgaattgaaatttattattaacctgctataattagacctccaggcacatactgtatttatttaggtaacatctggcacgggttcacagcttatcatcgaaagctctgagcccttaattcgggccatttttttttggctggaagcaataatttggtccattcaataggctctgcatcatccacacttccacagtaactttcaggtagagtagactttatgcatgaattttttaaaaaaaatatgtaaaacagtaggaggccggtcggcttcatgcatgtatctcatgcatgcacgcttgagtggatcttagagagctagcaatttatttacacggacagtagctatctgaagccgacttaggctgtatttaattcagcgtaaagtttgaattttagttaaaattggagatgatgtgactgaaaagttatgtgtttatgataggttgatgtgatgaaaaaggactgaagtttggatccaaactttggatctaaacacagccttatgaaatgccccgagagttcttttatgcgctgaggttcaggaacaatccaagaacagatggaaatagttgggtagttaatcgaggataagtgatccaatcaccctaatcatctttccttttgtaatttttgcaattaattatttgcccggcgtaaaagttctgtaatgactaatgaattaagccggaagtatcgtgtcgtagctgagcacatggattgggcgaatcaatgctctctgatcgctgtcgccttctgctgctgcagttattgttctttatgtttgtccctgtctgtgtcccgacactgacgccgccacgcacggcggccgcgaccaatctatgaccaactgcgtaggtacgaaacgacatgatctgcaattagttgagccccctctgaatgcgtcatggctcacgccatggtgatatataagctagagtaagtgctagacactgtggtttgagatagcagtaaactgttagtaagtggtgtaagtattagaacgtgtggattttaatcggatcgttgatcattacgctcctcgccaaaacggatcgaaccacctgattctaaaaacaagaccatctagggccgtgtttagtttcaatatttttcttcaaactttcaactttttcataaactttgctacacacaaactttcattttttccgtcacatcgtttcaattttaactaaactttcaattttaacgtgaattaaacacatcctagattttacagtctcgtcataagaacttacgaacacctggccgagagggaccccatcataacagctgtgtctaggattgctctaaggtcagtagaccacctagagcgtctttaattaccatatagagacgaagtaaattaaacgacaactagaatttagaacgataaaagacaagggataagagaaaaaggtaattaaacttgatagattgaatcggccatgacatgataaaataataatttggatacctgaatccgctgtgacaatttcatatttatagagtgagaaggtattacctctcgtacaagtcgaacgtaacgaatctgagaaaaatgcaaactctccgaaaccaggtcactcggcttagcaaaccatagtatccggctttctcgggatgaaaccattttggtagctcttaacagtacggtgaattatatatggtcatggtaataatcaagcaatggcgtggtggatttttggtgtttgtggttaattagctgggcatggcgagcgcgctggagacgctgtgcgggcaggcgttcggcgccaagaagtaccacatgctgggcgtgtacctgcagcggtcgtggctggtgctcctcatgttcgccgtcgcgctgacgccgacgtacgtgctcatggaggacctgctgctgctgatcgggcagccggccgacctcgccagcctcgccggcaagatgagcgtctggctgctgccgcagcacttcgccatggcgatgctgctcccgctcacgcggttcctgcagtcccagctcaagaactgggtcaccgcggtcaccgccggcgtcgcgctcgcgctccacctcgtgatcacctacctgctcgtcaacaccctccacctgggcctcctcggcgccgtcgccgccgccaacgtggcgtggtggatcgtcgtgctggggcagttggtctacgtcgtcggcggctggtgcccgctgtcgtggaagggattctccatggaagcgttcgccgacttctgggagttcatcaagctctcctcggcctccggggtgatgctttggtgagcacacattctcacacaactcgagcacaacaaaatatacatgaactcatcatctcggctaaattgtaatttgctcatgtatatacagcttggagaactggtactacagggtgttggtgttgcttacagggtacctgaataacgctgaaatcgctgtggatgcactctccatatggtaactagcactagcagatgattgaaca

SEQ ID NO: 36447 - DNA, 11861 bp, Oryza sativa
  unsure (1)..(11861): unsure at all n locations
nnnnnnnnnnnnnnnnnnnnnnnnnnnnnnnnnnnnnnnnnnnnnnnnnnnnnnnnnnnnntgatctacgtcgtcggcggctggtgcccgctgtcgtggaagggattctccatggaagcgttcgccgacttctgggagttcatcaagctctcctcggcctccggggtgatgctttggtgagcacacacattctcacacaactcgagcacaacaaaatatacatgaactcatcatctcggctaaattgtaatttgctcatgtatatacagcttggagaactggtactacagggtgttggtgttgcttacagggtacctgaataacgctgaaatcgctgtggatgcactctccatatggtaactagcactagcagatgattgaacatttttctccttcaaatccaaactagtcttcctcacaaattgcattgcattgtactggttcttgacttcgtagcttgacgatcaacggatgggagatgatgattccttttggcttcttggctgcaactgggtacgtgcattcctacactggtttgatcagtccatggcctgaacttgatcagcgcaccatgagtcaatgacatgagcttgaaatggcgcagcgtgcgggtggcaaacgagctcggcgccggcagcggcaagggcgcgcggttcgccatcgtggtgtccgtcaccacctccgtggcgatcggcctcgtcttctggtgcctcatcattgcctacaacgacaagatcgctctcctcttctcgtcgagcaaggtggtgctcgacgccgtcagcgacctgtccgtgctgctcgccttcaccgtcctcctcaacagcgtgcagcccgtcctctcaggcaagtccaaagcctcgttgccacaagtttcgcattgcattcatggatggaagtttggcgagccatgggtgattgattctaagctagctccctgatgcattggcattgcaggtgtggccattggctcagggtggcaagcactcgtagcctacgtcaacgtcggtagctactacttggtcggagttcccatcggtgccatattgggctggccattgcatttcggagttggggtaatgatccgaacacaccccagtacatttttattagtatgttttgggggagaagcagtaattttgttcgaatgcatggcaatgtttggattgattctgactgttcatacccaaattgcagggaatttggtccgggttgattggtggcacagctgttcagacactgatattagcctatctcactatcagctgtgattgggatgaagaggtgaactcctttatttccttcaaatttatcttgtcacaaaaatggaccagcacatttgtttgaacatatctggtgtgtttgcatgcaggcaaagaaagcaagtacaaggatggaagtatgggcagctcaaaatgaagcaaccaagtaccaacagtgtgttggtgaggtttcttggacacacaaagggggcacttcagtgggcagcagaagaaccgcaacttctgctcagtacaaagaggcaaaccatcagaatagatcaagaagacgagaacattttggaaggcatagctggtgtttcacatatagacatattcacgttaccttaggctgcagacagccagtttctgaagacgctcgtttgccaagagaacattggagaagagtgcagaggcttgcgtagggtgatagtatgtgtgagttgggattatatttattagccttgtaacctgaaatttgcactcggttgcaagttgcgacatgtaagcactgagtatactatttaatggatattgcaactgcaagcctgtgtgttgttcgcggattgtaagacgtccggacactacaaaatgggccagacggtagcccattaccatcgtgtatgatatatatgcaccgaaacgaatccactcctacggtcctacctcacaaaccagagcctggccaacaccagcgatcagaacaatattctttcatcagctctttcagagtttcagttcgttatattattatatagcgaacgctggtcaattgacaatttgttgtttagccacacattggctccttgctgttgctgttctcggacggacctgcattctcttttactttcaaccacaacagagtactctgcctacgaactcatgaacattctacagatcagcctgtactgttacgactgtacacaggacttccgcctgccgccattgatagcggtaacaccgtatcaatgcaagtagttaatggagagaatatcagcccatgttaaccactagtaagtatatattccagggtaaaacaggtaaaacctgtgatacaaagcagtcacataactgaaaaagcgcacgatagtttgtgctactacaacagtaaaccaggacagaacacatccaacacgatgacgacgaggtcatgggggtttcgacgatagcaatactggcagtacgaattcgaggtgccgcacaacggcgcaccacattcacttcagcagggttttaacgatggatttgacattgagcttcttgaggtcagtgtaagactgaccacagccaacgaacatgactggagctccagatatataaaccattgaaagtgcagctccaacctatatatatattgagtagtcataaaaataaaaatactgtaaaagaaggcaattgcagtaaatcaaaattctgtgacagttcagaccttgtcgtcgatggtgtcaaacttggtgagcaggatgccatctatcaatctggtagtagggacagcggaaaggtctgctaatttctgttcaacaaacaaaaccgttcagtgcattccagtgaaagcacatgttgaccaagtttgtagggaaatgtagtatctcttataataccaaattagtttcattaaatgtaacattaaatatattttgacaaaaaaatttataaacttggtcaaaattcaaaaattaaactaagaaaaagttcaaagcgttttataatatgaaacggagggagtagcattcaccagtccttgaaagactatcagtacctggttaaatttagtgagttgatcaacagcatcattaccaaccaatgcttccccaacaaataaaactagatctgggctattgagattgatgagcttggagagtgctctcatgagtggctcattatcctggcagagaagatatgttagatatgtgttgaccagaaaagatgcattcgaaggacataaatagaacgacataagactctggttaagccactcaaccaacctgcatacgtccagcagtgtcgacaagaacaacatctgacttattacgagtagcttcctgaatagcctcctttgcgacaaccgctggatctttttcatatcccttctcaaatataggtatctgcacaaattctagaatgtaaatatccaggaaggtatggcacatgtatataactcaacaaaatttagcagtgagcattcataagtgaatgccgagtagttccactgggactattgtcgttttttatcgcataacaccaggaggcaccccacaagaccattatatcaatacagttcaacgcatttttgcgaagaaaaaattattcatacaccatcccagactaaagaaaaagtgaaaccaaactaaaaccaactgatggagactagatattccccccctaaaactacaatggtcagagtaatgggatggatattcaagtgtttagacagctacctgaagcctgcgagcatgagtacgcagttgctcaacagcaccagatctaaaggtgtcacatgctgccaggcttacactgaggttatgctgaagaagccaataagcaacctgtaatattacaatacatgggatgagcataattccatgcaagtatggcactattcttttcatcaatggtgtataaaagataactctacctttgcaagattggtagatttgccaactccattcactccaacaaaaacaataacatatggcttcccacgctctttggcagcatgtacatcccttaatatgtcaatagatcgccttggggttaagatgcgaagaagagcctcctccatagctgtctgcaatagttacccaaaaaaaaaaggagtattaggatttaggaagctaaagagaatatgtgccctaagaaaaaatttgcagaaatttggactagggtgtgctacaaacctgaacagtagaggatatccttgtgaaggatcccagctttttgccctcaaggctagctgccactgattcacaaagtttctctgcaatttcttcagcctgcattaagatgaaaagttttatttaccttggataaataaataacaaagaaggcaaaaaaccactccagtaagcttatcaactatcatgcaagtgttctagacaaaattcataccacattcttagtcatcagcctatctttaagcgctttgagtgcaggttggatgtcagacttctcaagcacattgttacctgcaatgctgagcacaggaaaaatagaaacaatgccatttaagttcacaggttaacagattataagagggagctgaaaatctggcaaccacaaatacttgaatgcaggatcaagggaaatggaaaacagcaatttcatctgtgtgtgtgtgttgatctaggagagggtaaacaatgagagacagaacaggctgcaggctgcaaaagtcatctaacaccaatacatagcacaaatctgccattctactctacgcataacttatttaagaagatgactgaagtagcacaccaaattagggagcattctagaaagcagaaaagcatatcagggttgctctctgcggttgaaacaatgagctggctaagaataaaaaacatgctgaagcttaaaccacccaagtgtatatagcgcatttgaaattgttaagcaaacaaaactgactacacattatgccatgtcaaaagatgcgaaacatgcgtattacctcttgaacatcgaggagaaccatcctttcttcttttgggaagctccagaattttcctctccatcttcctcttcttcatcactatcactgctcacgacatcatccttatccatcatgctttccccctgcttgacaaccacctggtctatcacctcatcccctctctcatcagctgggtctgtgaaatccagcttcttcttgtcatcaggtgtgtcatcccaaaccctatttttcttcaaattcttctttgtgttagccttagaggtgttcttggccacattactagcaacctcattcttcttgttacccttgtttctcatcttctgtaacttatttacatcaaaggccccatcgttggggtctccgttctcctttcctttaacaacaacactgcgggcatgagaattgtccttgaggctattctcttgcatcttggaattaccatttggcaaagtgtgctccttcccggagtcaccatcagagtcgtccttccccgagtcacctttcttcctaccaccaccagagccctgagtgtcgccacgattggtcttagtggtaaccttggtgggccgggaaccagtgacctgtttattcttcttcatctcctcactgcgagcctcagcctcgaggtggagctggcgaaaaacctcattgaaggcgtcatcataggaggtgcgcttgggatcataaatctgtgagaactccttacggacggcggcgaggaggtcgtcgacgtaaaggaggtggagcatgcgttggtaacgggcgacgaacacgaggccgaggtcattgttaaaggccacttaagcgcataggtgtcttgggagaagctggcgtcggcagagcgctcctcgaggaggcaggagcggatgagggcgtcgatgggcgagccttgagggcggcgccgccgagcgcccggcatgacgaccagaggatgaggccgccgcgcgtgaagatgagcagctcctccaacatctcgacggacgaacctgtgatagatcaaacaacaaaatcgttgtgtttagattcgatccagctaaacagatcgagacgataaattgtgatgcagagacagcgcgcgagtcggatggatccgaggcagggattggcaacgatttgccgtttcgggagagaagtcgagttcgatttgaacataaagtttggctagaacacggggacgatccaagcgagcgcaagtctgctgggtgggacactggaacacggcggttgcggatcgaggccgaccgggcggtggcggcgcggatcgtggccctcgtcgatcccggcggcaaaccctaggccggcgttggcgtggatcggggccggtggcagttgccggcggatgatggcgcagaagagttcgctcggtgtcccgatcgacgccaattcgacttcaagctcgcgacctgaacccaaaaatccaccaaaatcccccagcccagaaccccaaaatcccccaaaatccaccggcaccagaactaacaaagagggggaagcagcgaggcagagaattgaaccagattcgacagaggattcgagagcgtagtcgatcccagatccgagacgagaggggaagcaaaggattcttaccttgttcttcttcttcgtctgcttgtggtgtgggtgggggaaaaaactgaaaaaaaaaaataaattctctgttactccaatccggtgtcctgctatttattcctcgcgtggtggaagagaggaggaaagggaaacgagatcgggctaggcgaaaacgcgtgcggcgtgcgggtggtggccgacctcgtttgaccgaccgcgtccgcgtcagaccgcaccaccaccagaattttttttatttatatattttttattaaaatatttacaaaaaatatattttttttgaaaatttacaaatctaatcgtcttgagatttttaaaaatcgtccttctagagggcggcaagggatctaaatgcaattttccagcacaacttgttagctctataattttacaatttaaaattatattatataaagttagatgaaataaaactttatatcgaaattatagatctcaaggagatctacaactttgtatttaacaactttttcatttaagatgttttagatatccaaatattcgttacaaaatataaaacacatttaaaaaaatctcatatctatatttcaaacgacattggatggagataaattttatataaaagttgtagatcttgatgagatctataactttgtagtttatcactttttcatttaaaatcatttagagtatcgaataagcattattagtttttaagcaattaaaaccggtggaaagggtttgaacataaataaaaattttgcatttagatcccttgccgctctctggaagggcagacagcaggcgattagatttataaattttcgaaacaaaaaattattttttaaatattttaataaaaaaatgtataaataaaaaaattcccaccaccacaacaagttggaggcccaaacaaacgccacgtccgcgtcggagcccggcccacatgcccaccaccccccaacgtccgaagtgagcggcccagctccgtgccagccgggcatgccgcgtgctactgaatgggccattgcccacgcactgctcgtacatgctgacacctggcccactccggatggagtaggaggtgaatgaagcaccgctgacctcgttacactgataacgatcaattgatgataatttgttggctaaccatatatttgatgatgatgatgatcacacgtgttttctaaagtacaatcagttgttgatgatagttagttaaatatactgatggccaaagagttgactggctaactgtagattttgtcgaaatgtaaccagtgttgatgctgacagccaaagaattggccaaagagaggagggaattgcaagcaaaccacgcctttgggggcaatttgcttcatgggttattcaagatgcataagataggttgaaccatacatggggtgtgtttagttcacgccaaaattgaaagtttggttaaattagaaaagttagaagtttatatgtgtaggaaagttttgatgtaatagaaaagtgggaagtttaaagaaaaagtttggaattaaactcggacttggcatttattttccatatgatgatgatgaacattccacatatcacagttcgagctttacaacgaatcagcgcctgcaaactacacaggccctgcaggatcagcttctgctgaactgttcacgtactggcatgttagcaaccttcttcactagaatcttgcttgggccaaggattgggctactcactgtgttgggtcgtagtgcagccggcccaattcctaacatggcactgcctccttggcatgtcaacatgtcacccggcctgatgcatcacgcgaacgatgtcaagcgccgtcttctcgttgatgctgttgctctgctgcatctccatgtagtccctgtacctgatcccccggaactccaggccccggccgtccgccgccatctccggcagcggctcgacgacggtgtccatgcacggcccgatcaggctcacgaacgacatcctcgactgctcgccgccgaccaccgcgcggtggagcacgcccttgtaccttccgttggtcacaatctgcacgcatgttcacaccaacacaagtgcatactgagctgaatctcgcacactattctaaattctcgataagatatcccctctgtttacatgctatccaaatggttataatttttttaaaaaaaattaataacatagattaatatcaatacaccactccgtaaacatacaaggttaaatttaacatgttataatgaacaaacaaatttgaaagcgaatataagtttaatttttttgactcgtagaagttgaattttagtttgtatgtttgtggagtaatatattatatcatatattaattcatctttttatatatattttttataactatttagatgatatgtaaataacataaagatcattatctaaaaaaataacataaagatatcccttcaagagtttaaaatccatttcacagtttcataaacttctcaagaacacgcatagtgattgttgatccaatacctccaactgatcgccggcgatgacgaagaaggagcccgggaggggcttcgcgaggagccattcgccatcgtgcttgacctggaggccatcgacgccgttctggaagagcagggtgaggaggccatggtcggagtgagccgataatcccatcgcctgctcgtccggtctagagcacgcagggtaatggttccccaccaagatctggaagcaggactcgaggttgagcgcttcagagaggcggccgccggcgaggcccaggctctcggagatcgccttggtgagctccagcaacagggctctcgtgcaggtcgcgtactccgttgcaatctccctgacattgttgacacatcacaaatctttctttagaggaaggaaaccacaagaaaatcttcacattacaccggtcgatgatgtcaatggcgaagaatttttacgattggtaataatgatcatggatgtacctcagctttgcgggcttttcggggcagtggaattcaggatgagagaacatcttcaggtagtccctcctgcatggtacggcgtcgacgacagagtagaaacctgtaccgatccgtataggatccatcggcttggcacgcatgtacttttcttctcctccaaaggtaatctgaacagctccttgcaggcgtccatgattgcttctcggagagcctcgggcaccccatggttagtcaccttaattcattcatgaaagattcagatgagacgatctagcaatcaatcatgtcactgacgaattggagttgttactgataaatgcgatcattatcacacaatatactttaattaacaaacaatcaaacagctcgtagaaattttcgtatttgaaatagttcgtttccgaagtaaacggagaaaactttcttttttctttcacattctagacgagacataacaaaattaaggatatgttcgttttgagagataccccaacttaccatgaagaagccccaatcctcgcatgccctgcctaggtcgcggatcgcccgcgaccgctcgtcggccgcgccgttgatgaggacgccgagatcgacgacggggattccttgggacggtgtggccgagccgtcggctgcggcggcggcggattgctcctcatgggatgggagccgagacggcgcaaccatggctgtgcactgtggagggagaaaaacaaactggcaaatgagaaagtgagctttcggagggagatatgtaagccggatcgttcggtgcaggaagctgccgtcgtttgctgttgctggtgagaaaaactggcaaatgagaaagtttgccggtttttttttccttttttttcttcctccgtgcacgacaaagacatgaccacatggtacaggactacagcgtacaggtggtgtgatttgcagttgttttcctgagatatttttggcggcgtgggggtggggcgcgtgatatcgagatcggtcggttttccttccgcgatttcgttgtggatacttggatgggccggaatacatgcctgaccacatctgtggatggggaggaataagttcactttgactcccttaaaagtgatccgaatctaatccataccactgaactataaaccagatatcttgacccctatactgttaaaaccggtgcaacttgactccctcggcagttttgaagagtggttttgctggcgtggcgtccatgtggtaatgttgaccttgtctgccgttgaaatggcgtttgggtggcattaaaaattaaaaacatacatatgggacccatttgttattcagaagaaaattttgtgggtccactgacatacgggacccactgatatctgggacccgtacgtcatcccttcttcatcctccctctctctcttccttctctctctctcccccatgcggccacgccggcgtcatgagttcctgtcgccggcgcctccacctcgccactgccggcacctccacctcgccactgctggcgtcgtcctccccgacctctccatcggggttcatctcctcgccggctccgcatccatcgcctcgagtcagcgtgggcggtgacgttggacgagctcctccgggacgaggccgctgccaccgccggggggtggaggtggacgccccgtgtgcgtcctcctctacgacgcgttcctcctcttggcgcgcgccgtggcgcgccgcagcggcggtggcgttcacgttcttcacgcagtcgtgcgccgtcaacgtggtgtacggccacgcgtggtgcggccgtgtacacatccccgtggaggccggcgccatcgcgctgatcggcttgccggcgctggagctggagggcttgccgtggttcattaaggtcggccccggcccgtacccggcgtacttcgacttggtgatgaagcagttcgacaggctggagctcgccgacgacgtgctcgtcaattcattctacgagctcgaacccgagctgagctagtaaccccatcaaagctacagtagcatctatctgctggtgataatgaaattgcagacttgcctgcttgcttgccggcgtcactgtcggcttgcagctggcccgctgctctctgccgcctcccgtgcacgccagcgcagtcgagccattcgtcgccgcccgccagctgctcgctctcgtcacccagcgcagcttcggccctcaccgcccgccgccggccgaaggggaagaaccgatgagaaagggagagaaagagaaagaaggaagagagggaggaggaatagggatttatgtgggccccacatgtcagtgggcccacaatttctttttgtgaatgacaaatgggcccgcatatatatttttaattctaatgccacttaagcgccacgtcaacgccacataggacgaag

SEQ ID NO: 36448 - DNA, 14341 bp, Oryza sativa
ggcctttaatctgtactaaagggctgatgatgttttacataataatagaaattaaggtaagattttccttttttttccctaaaggttgaaacttagaagaaatctatacgtgaaaaaaactttctattttttttcttaaaaaagccatacctaaattttaagaatatcaacttacaacttgaaactctaaactgaaattttgaaaatttcaactcaaaatttaaactttgaaattaaattttaaaaactttcaactctaactttgaaaactctcactcgaaatttgaattcttttaagttaaagtttgaaaactttcaactttttatctcaaatttgaaaaacttttaactcaaatttgaaactttcaactcaggtttgaaaactttcaagtcaaaatttgaaaactttcaactctagatttgaaactttcttcagattggaaaactttcatatcgagattcgaaaacacgtgtgttaacgattttttaatcgggaaaaaacgcaggaaaaaaggaaaatacgcgcgaggggaggggcgccaaaatagggaaaaagattgcaaaaaaaaaaagaaatgaaaatgtgtgcgtggggggcgccagatggcgcgcacaccagctctattgttggcacgtgagcgccaaatagcaaccccaacgttttggtcttttcaatcctataggctcagaaaaggtgtgtgtgcgcttagagaaagatggttgctggcaatatactgggagtaacaactttattttatatacatgtcgttgatattatcggaatagaagctattcatcaatttctttgattgctatcaataagaagttggtgacaatatatcttatggagtggttttaataatgttttcattgagtaggccaaccaagcaactcattaactgagtaaggttgttcttatttctaaaagttcatgtatttggttcatgaattcccaagtgatttacccattgtggccctccctcctcctcctcccccctcccctactgttcttctcctccctctccttttgaccgcacaaaccagaaattggttcatcactcctcattctcctcctcactggctcctactcatccacctactctctgctccctctgctgcttcatgcctcccgtcgagtcgagaagcaggccaccaacaccagatcgagaggcctaggcccactttattgttggattggccccgagcgcatgctgatgacgagggtgatggactgtgtcttttccgtggcctcctcctttttgtactcgtggcgtggcaacaatcgctaaatcttactcacacgaaggatgtcggggaagactcccaccagagcgagctcctcctccctattgttggtgatgatagagggggattccaacgaatgtgctagatatggagccacgattgaccgtcgatgtggtggtgcaatggtcatgttgctcaccaacccatcgtgctgctcggaggtgttgtgcacaggtacgtcgtgtgatgcgtcatctgatacctttgggtataaacctataagaatggtacctgagggtatcagatttgacatctcggataccaactgatatccactgatactgtatgaaggcacgagcagataatacgagtcgtagctacttggctagctgatgaggcgtctgtcactattgaagtagcacctcctctcctcttctccctttcattcctctccttgactgcaagctaattttattccctatcgttgctacgagtgtttgtccttctgctactgcgaccaccgttccgacatgtaccgtcacctcctgacgtcctagctgccgccgcctcctgttaacgtctcgtcgacctcttctgctaattaattcgtgcttctgctcaaggtgcagggtgcgggcgtgcaacgtggagcgaacggaggcgcggactcgcgagaaggaagcagtggtgagtaatcctctgcttttcggctgattaagcaggatcggccaatcaggcgttggcggtgagaaatccattattttaaatagcaggttaaaatgtttagcggttagcttcttaaatagctatagcggtagttatagcgggctaaatggagctatagcgactaaactgtacgtgagagcaaatagctataattcttctcaaaccgctgtagccggagatttaaaaccgtggaaaaaacacgtcccgattctttggttcgtggcattgacgtacaaataaacgtccgattaagcggctaacttagacctgacttttaccgcactgattcccatttcccactgcggccttgcacaatcacacataacccttttttttccctctcccacagcttcacgactcatcgatcacacatggccttgctagttcctaactttattttttcttcgaacttctaacttttccatcacattaaacttttctacgcacacaaccttttaacttttacgtcacatcgttccaatttttttaaactctcaattttaacgtggaactaaagacagccatattcacccactaaggggactccaatgcagctgtgatcattacatcttacgagccccggcgcccatggtcagaaagcggcacttcgcagcctgctactagccagaccatgtgcaactgcaaacaatgacatgccgaaaccatggatttccttgtagtactccgaaaactacttgttggctgtggccgtctgtttgtgtttgttatactttgagaattcaggtatacaaagtcttccctttttcctgtccttttgtattcgtttttaagcaatctactctgaccaatacctaaaacaaaattacaaagtttgttggtgccacgcaattataaaagttattctttacaattttttacagtagccactagccaatttggaagttaaaaggatgttcgagtagattctgtacagatcaatgcacagcaggtgcaatttactcatagggtgcccatattgtaagagcatatatatatatatatatatatatatatatatatatatatatatatatatatatatatccacaaagagaaaccgctccatgtacatcaacgttgcacgtacgcaacaatttctatgtagcacatctagctctcttctgaaaaagcagtgagctagctagcctagctagctactcgtcgtaatcatcgtaatcgtcgtcatcatcatccatatcgaccacaagctcaagctctgggccgacgtacggtgcccctgcaacgctgaaatcctccggcaagtccgtctcttccagaaaagcaaaacctgaatcaagcaaaatgacacgtacactaccagattaatcatcagatagtactaaagttgtgaacgagaaaataaattctcacataatagatcgaatcaagcattcttcgcgtgtgtttgtgggggtgacgagacgtgtacctggcagagatgggatggggatgtcgttgaagtaggtggacggccggccgagctcctccgagtacggcggcgtgagcacgtcgaggatggcgcacggcgtgacggcggtgaacgcgtgcatgttgccgccgctccgcgggaacagcaccgacgtcttgcacggcgcgtgccggacctcgtcggctgccaccaccctcgccaaaccacctgcgcccgcgcgcaacaagttactcccactgttagctcttggtggtcaggtcggcacgaaccaatcgatttgcttctgaggctaatgcgtaacacgggtgctaccaacgaatcagattcgggcactgaacgcacgcttactctttctggagcacggcggcggcggggtgacccaatcgtacgacttgactcgaaccgagccgtacaggagcttgctcaaaaccaccatctccgggtggtcgtgcagcggcagcgtggcgcccgccggaaaacagaacacgcccatctgccaaagccaaaccattgaccaattaacctcgtcgcgtacgcgtacacagcacaagactgctattgtgctactgctctttgcattagttgatcgatgcgtacgtacgtaccgagaaatcggcgcactggtgtatgtgcatgtaggtgatccgcgtgaacgcccgcgccggcaggagccggccgtccttcgagctcacctcgtcgtccgacgacgaacacgaagacgacgacgacgacggcggtgactcgccgtcatcgatcccgacgtccgccgcctccatgccatctacacaagagatccaccatcacaccacataagccatcacatattatggattcgctcttcactccatgcgccgggaagaactcacgaacgtacgtaccaaggaggtgttgaagccacctgatctccccgatggtcggcgccgcggacgccggcgaagagaagatcatgtcgcacgcgtcgtacagccgctgcatcttgctcagcaccatgatgtgaggcgggaacgccacggccatctatctatctcaagttctcaactctatataagctgggccagcacgcgacacgccccctcgcacgcaagcaaaagctgcaccaccaccaccaccacgatccagtcgtcgtgcagtacagagaagagggtgaaaccccgtgcgcgctagctagctcgctccactactgtattttttctcctccccttatcaaccgatcgatcgaggcgttggacttcgcgggtggatatatataacaaatcgcgcgttgcgttgcgtttttgcgtggtgcggcgcgcccggaggctggagattattcaccgtgccgcgggcggaggcggggaaccgtgggcttagccaggcgatcacccaggtgcgcgcgtggtcgcgtactactactcctactccgatccactggccggggggagcctgctgttttccggtggtgttgatgcggcgcgcacgcagcacgctacatgtgtggcggtgacgccgtctcgctctcgtctcgttcacgttgcttaattcggtctactgtttctgacgaaaaaaaaaacaaaacaacttgctgttgtgatctgtgtggtggtgtgtgggttgtttggtcgcaggaatctcagacagagtctaatttgggaatgggcatggcttgccgtctcttaccggttaatagaatactccaatccactgcagagttgaccacagtttaagctcactgatcgatcgatccatctagctcttggtactatccaagatacagtgctgtgcttttgcttgttccacgccgtgacgccctaaaagttcaaccatgcgaatggatatgagacgggtggcgtgagtgacactagtacacaactatacattgatttgttctaaaaaatcaactatacattgattaatttcttctgttagtccccgcaccattggcacgccccctaaactttgcgggtttttttccgttccagtggtaagctgccacgaaacaagcatcaaatcaaagcaaacgacgatgggatagccgcatggatagggaaggaacaaaagcgatgtggatggatgacggcactcacgaacggaaaaggaccttcggctccttttcttggaaacttgggacggtgcccgactaaaataaatttagcccggtgcaaaagcacaagccctttgtgtttctagctttgtcatcttgcttggattcgagagacgttcacactgtcttgactgtccggttcaggggtcgttctaggatcacgtctctccctagtttcattaccggtgttttgttgctttttttttttgctgcaacgtttgtgaggcgtgtaaaagtaatctataaacaatataatatttcattcaatcatctattatcattgtataaactagtccacatgaaaaaaaacaaaagttactcatatgtatatagacgactatgtgggataaataatattatctactctctccatcccaaaataagcgcagctatgagtttccgtgaccaactttaatcgttcgttttatttaatttttttgaaaaaataaaaaacataagtcacacataaagtactattcatgtattataatctaataactataaaaatactaatcataatttttttcaaataaaacatacgattaaagttggacacggaaactcatagttgcgcttattttgggatggaggaagtatctctactcctctctcttatacattgcacagattgttactccctccgggctgataatacttatcgttttggataagggggaggtcaaactttagaatatttgattatgaaccatttttaaaataattgtctttcaaatttggtgactacatgtatagattagtcttaaaaagtgctttattaagatcatatatttgttaacatttttatacatattataatagaaaataatggtcaaagttgttttctggagaccgtgcccttgtccaaaatgataagtattatcaacccggagggagtataggaaaaatctatttatatgagccacatctatatggatcactttaatatatacattggtgatgccctcacatagagcattacaatcattaataataaaatgcttaacgagacaatttccaaatagccccaatctctaatgccatagttaggcctagacacttaaggcggacatagcaagggttgaaagaatgagttgtgatcgagcttgtgactatccttataaacctgacaataaaacattaaatgctaatgttcactataagctcgtggtttggtcacaacagaaaataaaataaaataatattgctgcccacaggagggagttagttcatcgatcccttgaataaaaaactcccaagaagcaatattttctaaactaagtgggacctaacaggacccaccttaatttctctcacaggttttaaccattattatggagtttgctatagctttttttttaataatggatttttcattattagataataagactctatatctataaaagatatacacgggcaaaacatatataggtaattagattccaaccctcactaggagaaatacacaggaacacacacacataaaagaaaaactagctgtaaccctcattgacgacttattatttctattgcaacatgagagggcggaagtggagaatcgaaacagtttgtgctacctgtcgccacaccatctctgcctggaatcacaatgccatctgctactaactaatgtgtctactgtcctacgccatcatccaaatccccttacgccgcggcattaattccgaacgcccctagtgcaccggaagctgctctaccatgccaccgccgtctttcacagactgtcgaactcgccatcactcctagagtgtcgtgaagccgtcaagcatgacatgcacctgtctttactgccatgagctcaccagaggtattctactgtcgttcacaccaatcccaagctagacttgggcgtcgacacttgcttggtagttgccgcctctagaacgccaccaccgagagcctctgctggcatggtcctcatatgcgtcaggcaagccaacgacaattgcatcatcagctagcccaatcattgacaaccactgaccccccgtcctcgcctggccgtggtcagatctaggcgctgaagctcacctagccgccaccgcccctaggacactgccaccgagagccaccaataccactacccaccatgtccaccgacactgccagtcctctctgccggtgacagatgcgggtggatgttcggtcagatcgaaaaatctggtctcaatcttcgttcttttagaaatttcggtcatctaaaactggagaccgattggtcttgaaaaataatgaagaccaagaaatttggtctcaggtaattcagtattggcctcgttcatgatcgaaatttcaaaaggtccaagataatcaagccaagtctctaataagttctagataaaaaaattatacacaaaaaatatcacaaatcaactcacttcactatcatgggtcagatatcaaagcatgttggagcctaaaattgggaaaattttggtttaattgggttgttggaccttaatgtacctaatggaccaaaaatcgatttgttcggtctatttagttaactgaatgtactaaccgaattgatcgaacaaaattcgatctttcaacacctgaggtcgaactagtgatcgaatttctcggtctcgctcttttcggttcactctttttctgcccaccccctagtgacagaggaagggacaggggactaacctagtctctgcctaacgtcgccgccgcccaccaagttcattggtgacatagaaagggacggaagactagccccccgtcttcagccaatgtcgccgcatctcaccacatctgctagtccgtgctgccataacatccacgaccaccaccggtgccatcactgaagtcgtgccatcttgctatagctagtgcttcctgcattggacctcaccgttattgttcattgttgtatatacatttaggatgcccttaaggattgttttggttgggaaacaagatggtcaattgcccgctttattctaaatagcttagttgtttcgacaaacaaaatatgtttgtccataatcacaattgatggggggtacccgtagactgtattctgagggtattaagatacattggtacgaggatctacacgatacgacattaagcatacaaaagataaggattatactggttcaggcccctcgtaagttaatagccttaatctagtttatatgggattatgaagaaaaccatagaatacaaaagagaacaattgaactccaagatttagcgacgagatccttgtcgagagggtctcgacgatatctatcggcaaataggcttcaagtcctccaaattgcttctgtggtgccgggtgtcctatacccctcagggggtatgtatttataccaaagatcatcttggtctccaagtagaactcggagatatcggatcccacacgatacaatacaatccttcccttctccgagtaggatattgacacggtcctactagtgaaggatatttcccataggaattcgccaattcccttattttacatgtatcctttccgtatatcgtaagatatgccgtattcgtatatctcatgactaataggatagagggtatgacttatccgtaaccctgacaatcaccttagcacttaaaagtaaaagctaataaagagatgaaaatggagtcattcaacaaatttgaggaatgcctccacaattgatcactcatattaggcttagtccatgcatgcctgcaggacgactcttctcgttccccgtgagcatgttttttaaattgctaagtgtacatattttacaaatactttctatataaaagttctcttaatcgatagaaggacgatgtggtgacataacacatattgagcgatatgagtaacgaatgaaaaaaaacacacaaacaccaaaattactcccaaccatagatttagtagttactaatacaccataacaaatcgatggttatatcattttatgttagtagaatactattattagagagctctatagaggaattattatgtgttaggttttaagctttcaaatgcctttgtacatgtccttgagcgcatatgatatggggtacccctaatgggcgatcgatcgccgtggggatggggtagcgatcagattcgttccccacctcccccctccctccctccacctggtttccttttttggcaccgcattactttcctatttgagtaaatttatacatctaaagtttatacacctaaagtttacacatctaaagtttagagaccaaaagtttataagtcaaaagtttatatatctgattcaaatttgaatttgaattcaaatatttttttatatatagtatttctatacatctaaagtttatacacctaaagtttatagacctaaagtttataagtcaaagtttatatacccgtttcaaatttgaatttgaattcaaatatccgattcaaatttgaatttgaattaaaatatttttcatatatagtatttctatagatctaaagtttatacacctaaagtttatatacccaattcaaatttgaatttgaattatatctgattcaaatttgaattttaatttaaatattttctatatatagtatttctatacatctaaagtttatacacctaaagtttatagacccaaagtttataagtcaaaagtttacatacctgattcaaatttgaatttgaattcaaattttttatatatagtatttctatacataagtttttctaacttttgtttttcaaaaaattttgtgtggtctactgcagtagaaagagaagaaggagaggaggaagggggagaagagggaggagtacatctagtagtataggggagagggtgggcaggtgatcgctgggcgggtggggaagcgatcacccgcccattagccttttcgtatgatatgagtgtctttgtaaaagagaattagatagtaaaaacaaggaaatgataatattacgctgaaatcacacttcatgcatgttctaggctcccatcggttacccattttgcctaataagccaaaatggcttattagaaaataaaaattaatttataagtaaaacttttatagatttgttcgtagcgacttaaaagccaacattaacaaaaattacgttaaaagcatctcaaaactaacttcaaaatcaagttcaaaaatttaaattttagcttattttttggctgtttaggccaaacgacatggtttctagttgcccatcgtaaatgtgtggaaagagagcgagcgacgaggtagccagccagccaaacggccttgcttgcgttttcctcttcctgcaagggaaagagatatccacggccttgctacttgtggtataaatgagagagatggcgataagcccacaattagcaacttatcgctgaagaaacagcgaaactacgttggctttaaggaaaaccgagatagtagtagtttgcatcgagtgaatcaagcagaggaacatgccacagtccgtttcaccctgcttcatgcgggcagcttgcagttgcagggcttgcagcatctcaaactcccaatctcccaatctccttgacctgacacaattttttttaaaaaaaaaaacacgaaagagagaaagcgaagaatctcttcgaccagataccacatgcgttgttcacaaaagaaaccgtggccccagccaaaaaaaaaaagtaaatttcacttcgggccacctttatttacctatgttttactttagaccacctttaagcaatattttcactttagactgggtaaacttatctttgtttcactttggaccacccaactctcttctcaagcatatgaacgatctcgattacgccgtttcctactcgtcaatgaactaccacagctatatgtaagactattttttcgacatattacaagttggatgtagatggataaaagagtgagggtggtctaatgtgatacaaaggtaaaaatacccggtccaaagtgaaaacattagttctaaggtggtctaaagcgaaatatcggtactagaaggtggcccaaactaaaattaactcaaaaaaaaaactctcccgaaaaacagcagcagcggtaggacaaagcgcgccgcgaccgggtccggctcggccacgcccattcccctgtgtggcctggccgcctggccgcctgggcgtggaagccgtgcgcccgcttgcccgccctccgcacgggcccctccatgtgcgcgcggttctccaagctcgctcacacgcacgcagctcgtccggtccgaatgctgcatccgctcgaaaccggcgccaggaggcgtaggcagccaacgcttgtcgcgatctctagttataaaaagagaaaattccctggttcccttaaaagttcgcacaatctattccatacccctgagggctgagatttactcattttcttctatacccctaaatttcattttggtttctttctatgcctctttcgttagttaaccactagttgatcattaaattcctatcataaagtctattttgccttttaaaataaaaaaaatataaatttatgaaaaatatattgatggagtgtataaatttattgtacgcgactattatatttatgagtttattttgtgatatataatttaataaaaaataatattttagttttgcctccacggcaaaaaattttttatctatgataaaaatttatttttagatatgacataaaactaaaatttattttagttattaaaaaaatatttatttagcacataaataaatttatcttatagaaaacgttgtactactataaaaaatatgctatatatgtatatacagtttttaatcgtgaaaaatattattttttgatatatataacaataaattttgccatagataaaaaatattttttgatttgccttcgcggaggagaaacaaaaatattattttttattagattatatctctcaaaataaactcatataaatataatagtcgcatacaataaatttatatacttcatcaatatatttcataaattaatattttcttggttctaaagggcaaatgaactttatgataggaatttaacggtcaattagcggtcaactaacggaaggggtatagagggatccaacctgaaatctaggacatggaggatcaacgagggcgtcaagttaagatggaggcccaaaccaagtcgacttcgagtatgttttagagtcctggaccagtctgcacttaaacgagcgcccaggtcgcatacgtactcggattggggcgttctttatatggatggaaagctaagaagataacatttccaattgttctggtcccacattcaaattctttccgagtcaacgggaatcgaccgaacaagttaatgtccagaatcagtcccggtgttgcgtcaccgtatttaggcttttgtgccgtgtatcgtgttggaacccattagagttgcatcaagggttgtttgcacgaacttaaactctatatatcagtacacgccgtcacctttggggttttgcttagattattctgtcaagaacagtttcgccgccagatcggtttgtaagaccccaatttgtgagcttaatcatttatatgcaattttggttgtattcttccttgttcttgtttgtgttcttcgattcgcaaatagggattagccttctcggcgaggtcatccgcatttcaacacgtgtgataatcaaaggagacatggtgctgcgattgcggggttcaagagcatgttcgtttagaagcccgatcgatttgtgtcgcgactctacctaaatcgactttttctcataacctttcggaaaatcgggaaccctagttcacatcacctggtccatccatactccatcacgtccacccttgccgtggtatattgattaggttaagctacactttagatttagcctggagcacatgctagcctgtgggaagtacatgtatatcttaaggctatgttcggttccttggaattaaacccccaaggggaacctatccagggaggaattaagtggatccttcccatgtcacttaatctctgtgggatgaattcccttgattttcctaatccctgtcttcaaaacgtttgttcggttttgacttggtgcgcctgcttaaatcccgcgtcaaggcagcaatagacaacggcaacaatagaaggattggtgctttcctgcttcaacgttgcacgctgtccattgagtttagaatagcaaaattgttttcaggtaggtagtttagaatagcaaaaaaatattgcaaaccgatatttttgtataagtgaaaagtgcaacatgaatgaaattacacttcagtaaaaaaatattgcagtaacctcatcaattacgcgaaaaccacattgattaatcattaaaacaaaaatattgcagtatcatcaaggcctgtatccggtttaaggcaaggaggcatcacccaacaaagcttgaggtcacttgacaatacagagacaactaaatacagtcatagtagtgaaatttgacaataaaaaaagaaaaagatgaaactatgtcatgattcacttgagctataaaaataaatgtgagctgccacaccaggactccttgaccaaatggttacatcagcaatatacaatggttcagagatcaacatttgttgctcctgcaaaaagccatcatcttgtacatgtctgctcattcactctgtatctgaaccaccatcctctcagacttcctcccaaagcctgtagagaagaaagaagtttccttcagttttcagttgtaaaatgcaataatctaggcaatgcttttgtgcagtgagcaattgtctcaaatttcctggaaccagccaactattgatccttggcaacatttttaccaagttttcagtttgacaagtgattgtttgtaagctgattgtgtgct

SEQ ID NO: 36449 - DNA, 3255 bp, Oryza sativa
  unsure (1)..(3255): unsure at all n locations
nnnnnnnnnnnnnnnnnnnnnnnnnnnnnnnnnnnnnnnnnnnnnnnnnnnnnnnnnnnnnnnnnnnttcctcgccaccaaagaagctgaatatttcccggccgatgacgaggggaaaacaccggggtgggccgggataaaatctcgcctcggcttaaccgaacgcctatacttgcgtgggccggtatcctttccacgccgggattttccatggggattgggccccgatcccagccaggaatggcccaaccgaacaagccctaatggagttcctgagaatcggtacttaattgtcatgggtacaaatctgctgtttttgcataattctgttcgtgaggaggatggttgcctgagccggcattagctctggcctcgcggcaaccgtacagccgcctccttcttcttctcttccttgcggctgctttctgaagaaagattggttcttgatttgctgtcttgtggccattcttgcctttggttttgtagcagtaatggactaattttcttgaaattttgcaccattttttgttcttaagccacgtagacgggtgctagagagaacaattcaaacaataatatctttttgaaggtagttttgttagatttctgtgcgcggcgtggcgccgcgcaaccacttctagtagagataaattacacagccatacgagagcaaactgcttcgtttaggtggaaactagaatgcctaaaaaggtagaaaaccagaaaggcatcccaagtttcccaacaactaataatacaataaagttggggaaaaaagatcaaatcagttctttattaaattaaatgtgattttacacaaaatacactgaacaagtcattgtcactactgctttaaagtccacgcctattcagaagtgataatcctgataccatagtagacggtcaatgagtttcttgtagactttactagtcatttctgactagttaggaattggccatttagtcaatttaatataaaaaggagcatatatggtcacatctaaaagccaaaccaaataacttaggcttaaaaagacaaatcatttagagtactacacagcggcgctgttccgtaatatcaacaggcaatccttttgcagtgaatctaggtgcttgctaattactagtatataagcatagcatgtagaacggccaaaagacgttgcttaaattcaacaaatttaactggttatctttttatggaggcagcaaaacaatctatgggaaacccaccaacttgtccatcgtgcaagaattctaacattagacccaactaaacgttatgctttgcatatcaattgatgtacaatttttcatcagcaaaggtctttgactgaaaattgcaattaaccatgaattgacaccaaaccttagtattgtaagcaactacgcacctccagcaattagaaggaaacatctttcactcagagaaaggtagaatttacctcattcatccggtggtgttcgcacaacagatgagtagtaatgtgcctccaactctttgaggcttcctgctgcttcctgcccaatcctctccagcattctctctgttccttcaacttgttgactaaagatttcaatccgcctatccacattttcagttaaagaagcaagcccagaaaagatagctgttctcttaagctctgacactagtttcaacagagaatcagctgaatgtacctgaaaagcatgatagcatatcgcatctgaaattacacattcaatgggtttgccaaatgatactgattactagaactagcctccaattatattacaaaagcatactttgtacaatggatgattgcaatatgttaatataaaggtagatcggaaaatacataggcaacaaaatgtgattcaaactcattattcattaccatcaccatactgtctatgataaccaaagtaaggccattgcgtgtctgaggtaggttcttctcaatccactattatatactgttggttattcatgatcttgtatgtaatattcctanacaggtaggcgtaattgaaaaaaaacatgtataaaacaagagnacacgctgggctgggagatatgctccagaaacagaatggaagangctctttcttctttctgttgtaatccctaatcaaccttgcttgaatgctattaatttttacatagtataagagcgatccaaagatcaaagagcagccacaatcaggaatctgtcctaatctattcttggtgtgtttgtgtgggctggaggagcagctgggaccatcggatgtgtgatctactgtggcttgttttgttggtgttggatgcattattctgttgcatatctatcttgagttttgatttctgaaggtctatgttgttattacaatagtatatttgctcctcttctgaagttagtccagtgccattgtagtgcacaaaaggtgtttgtttaaatgcctgtaaggatacccgtgtgatcgctggctcatagaatctagtctgcttgtttggttcaagcacctcgttgcttgtctgcatgtccctccaagtggttccagcatgtcttatgtctttgactgcttgcatccatgacactgggcttcattgcttgccatcaagggatagccggattggctctccatggtgggcaaggatttgttcatcaagggatagccggattggctctccatggtgggcaaggatttgttgacggttattggctactttgcttagcaaagcaagattaatttgcctctaccaaacagctgaggtttcactcttgcctaggattgccttctagttataagttccaactggatcagggtgcacctgaaatcaagaaatcaatactataactcctaaatcctaacaaacagctatcaaggatatggcaccaaggattcactgccatggcttaatttgactcctaatacaatggtaataccaaattgagcaagtaattactcagttttcttcttacacaccaattgtctccactactgaggtaggaggaacatctccagttctccatccagccggcacagcaaatgtgatatcaacgcttaaaattaggagtatcgtagctctaagtttgctcatttagacaaatgctatagggcaagatttaaacaccgccgcgaagaaacaaatcatggagcaagtgtgtaccatgcgggagccgcgcatgtccatctggaaggcctcctgcgtgttgcgcaccggcgggtcgttgacctgagacgagcggagcaggaggaggaggagttagggtttggtagtacgacaccaag

SEQ ID NO: 36450 - DNA, 457 bp, Oryza sativa
  unsure (1)..(457): unsure at all n locations
nnnnnnnnnnnnnnnnnnnnnnnnnnnnnnnnnnnnnnnnnnnnnnnnnnnnnnnnnnnctgaaggacaatagtgatagtggttgctggagcgagctcctaatagcgatggcaatacaacttggagaggttaaggggagctcgatgacagtgagtagaggcgattgtggttgctaggacgtcagtgcatcccgttctgcctcgtcgtcctcttgccattgtcggatcccttgcctcctccaacaactcctggatctcctcctgtcacacctcttccacctgtcgctgtcaaatctcgtctttatcatgtctactctggtcgccattgttggatcccttcccgtccatctgtcgctggccaccttaagaggaaaaaagtacatgctttgacagctattgcacgtttcttattttaaaatagtggaatgacacaaatatacttttaattttggtaggga

SEQ ID NO: 36451 - DNA, 831 bp, Oryza sativa
tcttcttaagtgtcggtaaatgcccatctgttggtaaaactatctgtcggtaaatatgtagcaacactatcagtctatctgtcagcacatatttatctgtcgggaaagacttttgccggcagcacttggcctgacagaccctatctgtcgggaaaagttttgctgacaaataatttgacagcatataggtcctgtcctgacagatatgtagtaagcaaactaggggcatggtgtagtgtacatcatcatcagccgattgactttatatcattatccacattggacatataaccgattgcttaaaccctatcactatcggctggtatcggtatcggctattatcggctatcggctggaactactccatcggcttgtcagccgatcggctgtttagatatactatttgcatatcttgtgagttgtaggatcaaactgactggcacgcccgcatctcatcaatatttggacctgcacaggagctaagcagatctcccaggtcagtgtgttcgattttttcatcaacaagcgggctatagatttgtagccagctgcaatatgggcttcaagacattatgtgtgtatgagaggtggaaccaggtattaatggtgtagtatacttttatagttaactattatatgaatggactattatattagttatagataatttggagctagaattcggctatactattaaacttgctcaaacaacggagggtagatcgtgagtagtggaagaagagtgtactcggtactaccgcatcaagactagagctataggaacagcttcatggggtggactctggaggagtagagctggaaaactggtgg

SEQ ID NO: 36452 - DNA, 578 bp, Oryza sativa
aactagcaaggccatgtgtgatcgatgagtcgtgaagctgtgggagagggaaaaaaaagggttatgtgtgattgtgcaaggccgcagtgggaaatgggaatcagtgcggtaaaagtcaggtctaagttagccgcttaatcggacgtttatttgtacgtcaatgccacgaaccaaagaatcgggacgtgttttttccacggttttaaatctccggctacagcggtttgagaagaattatagctatttgctctcacgtacagtttagtcgctatagctccatttagcccgctataactaccgctatagctatttaagaagctaaccgctaaacattttaacctgctatttaaaataatggatttctcaccgccaacgcctgattgggcgatcctgcttaatcagccgaaaagcagaggattactcaccacttgcttccttctcgcgagtccgcgccttcgttcgctcaacgttgacgcccgcaccctgcaccttgagcagaagcacgaattaattagcagaggaggtcgacgagacgttaacaggaagcgggggcagctaggacgtcaggaggtgaccgt

SEQ ID NO: 36453 - DNA, 889 bp, Oryza sativa
  unsure (1)..(889): unsure at all n locations
nnnnnnnnnnnnnnnnnnnnnnnnnnnnnnnnnnnnnnnnnnnnnnnnnnnnnnnnnnnntctcaaaacgaacatatccttaattttgttatgtctcgtctagaatgtgaaagaaaaaagaaagttttctccgtttacttcggaaacgaactatttcaaatacgaaatttctacgagctgtttgattgtttgttaattaaagtatattgtgtgataatgatcgcatttatcagtaacaactccaattcgtcagtgacatgattgattgctagatcgtctcatctgaatctttcatgaatgaattaaggtgactaaccatggggtgcccgaggctctccgagaagcaatcatggacgcctgcaaggagctgttcagattacctttggaggagaagaaagagtacatgcgtgccaagccgatggatcctatacggatcggtacaggtttctactctgtcgtcgacgccgtaccatgcaggagggactacctgaagatgttctctcatcctgaattccactgccccgaaaagcccgcaaagctgaggtacatccatgatcattattaccaatcgtaaaaattcttcgccattgacatcatcgaccggtgtaatgtgaagattttcttgtggtttccttcctctaaagaaagatttgtgatgtgtcaacaatgtcagggagattgcaacggagtacgcgacctgcacgagagccctgttgctggagctcaccaaggcgatctccgagagcctgggcctcgccggcggccgcctctctgaagcgctcaacctcgagtcctgcttccagatcttggtggggaaccattaccctgcgtgctctagaccggacgagcaggcgatgggattatcggctcactccgaccatggcctcct

SEQ ID NO: 36454 - DNA, 31383 bp, Oryza sativa
  unsure (1)..(31383): unsure at all n locations
tcggatacaaattcgaatacagtagcgatggtatccgtcggaaattggattcggtcggaaactatccgacctttttttgccagatatccgaatcaaaataaacaacaaaatccaaattaacaaacatcgaaaaacgctcgtcgccgtccgccgcacaccgtcgcacgtcgcacgccggatccgctcgtcaccgttcgccgcacgtcgtcccctcgcgccgccgagccccatccgtcgccgtcgcctcacgacgtcgaatcccgcactgctgggctgtcgaccccggatccggccgccccgagtccggcgtcgccgtccgccacacgccgtcgcctcgtgctgtcgagttcccgccgtcgccacgacccggccgccccgaggccggcgcggctggttccgcttgtcgccgttcgctgcacgtcgtcgcctcgcgccgccgagcccctgccgtccgccgcacgaggccctgcccccgacgtcgccgtcgccgtccgccgcacgcggccccgcccccgtcgtcgccgtcgccgtccgccgcacgcgggccccgcccccgtggtggtcgcgggagccgggaggaaagggtggcggctgggaggagattgggaggtgtgggagaaactagggttaggtttatatatccctccatctaaatgggccaacgggcctaagaattagctattaagtctatatgtcctccctcaacttcgaattaaattttatgatactaaatgaattcatgtgaaaaagttatcaaaaacaaagttgtagaatttattgagatctaccaattttattttggtcatttcttcatccgagtttgattgaactatataaattttgaattttaaaatataagaaattcaaataatttttcgggtagtaaatgatttcaaatggaaaaagttgtcaacaacaaagttgtataactcatcgagatcaacaacttttgtttgggttatttttctatatgactttgtttaaatagtttgaatttggatttcaaaatatgacaccttcaaacaacattttcaaatactaaatgatttcaactgaaaaagtcaccaacaacaaagttgtataacttatcaagatctacaacttttattttagtcattttttcatccgacaaagttatagtaacattgtttacaaaatttacatatcttgtatatggtttcataagatataagagagatatgcaaattttataaacaatattactatcacttggtcggatgaagaaatgactaaaataaaagttgtagctcttgacgagttctacaacttttatattcataactttttcagttgaaattatttactgcttcaaaatattatttgaagttgctattttttgaaattcaaattttttacttgataaaacaaagtcacaagaaaatatggccaaaataatagcagtaagaacacaataactcgatagaacataattttagaacacaataatagcatcgtaatgtcttactcttgattgaatcgtctccctcaaccaaaaaatcgaatacaacaaaattattaacactaaaatttgaaaatgttgatatgttctattagaaaaaataacgagttatatttattcgttgatttgtgaaggtcggtttgaggggcttttatgttccgattaatattcgttaccgtattcgttttgattcgtattcgcttcgtatctgtattcgataatattcgattccgttttcatatccgggtttctgattccgagaaaaaaatatgaaaacgaatataataaagctagttttcgaccgtatccgatccgttttcatcctagtggtgagtggtgactgggtgagtggctggggtgagctgtgcggttcagcggctggatgggaacgatgtattcgcggcgaggacaaacagtgaagatccagccctattttgctccacggaaaatatccagtccttttttactccaccgaaaatcgtcctctactattgccggtctgccagttgaaattcgacctccctacgggaaatacgtactctatggtgggcatatcgtgcgtgtaggaattgatgaaatgcgtactctatggtgggcatatcgtgcgtgtaggaattgatgccattttgaacaactattcagattgatggcattttgaaccatattatttttagtaaaattaataaatatgttaataaatttagtttgttatcaaatattggtactgcctaaagaattttggtaacaaaacatttaatctatcctatcaaaatttggtaatattaaaatctggtaatattgttaacttgtccaaattttggtattgtcaaattttgaaaaggttcatttcggtagcaatctgaacaggtcctagaatccaattcaggtaattttttttatcttttttttaatcttcaagctttaacttttgaaccactataagtgaaaatatatactttctccgtttcatattacaagactttctagcgtcatccatattcatatataactagattcattaacatctatataaatgtgggcaatgctaaaaagtcttataacctgaaacggagagagtattttttatcctaaaattactttctccttctataacgtctctttagttctctggcttacaagtgggcctgatcagctatggtagccactacagtacattgcatgctgctgcacggtcgattggttgatcagaggacccacgaaaagaaaaacaataagaggattttttttctctagaaattggttaatttttccgtaaccgaaaagactttgacttagaaaaggagggctaaaggcaacgtgtatccatgattgactatttcacgatggtgaatgctggagcctggagtacatctgccagagtgccaggcacacactgcgtttgagaatactgatctcaggcagtcaggctcaacacccctcaaggaaaagtattagttaaactcaggacattaacgacctttcaggccatttctgttgcttgaagccgtagttattttcgctaatgaaacctctcttgcttcaagccatcggagtaacacgctgattacgtgatgacttgcctgagaccctctttacataggactaaaaacttttaagtccctatcacatcggatgtttggacactaattataaatgttaaatgtaaactattaataaaacctattcataatctgggactaattcgcgagacgaatctattaaacctaattaatctatgattagcctatatgatgctacagtaaacattctctaattatggattaattaggcttaaaaatttaaattaacttttatttatataattagttttgtaaatagtctatatttaatactctaaattagtgtctaaatatagagactaaatttaaatcatgtatccaaacaccacccaaagcggaacgagcaagcaattttctatacgaagggtacgtctgcctgccgcctgtggccggcttggcttgccgccacggtttccttgtcgaacgcgttgccatgtccaagtctaatttattaatagtagtatcgatcaaagctgttcctttgcaccaaataattcacccctctcagcgtgtccatacgacgatttgtcaaccaaatgaccgtttcgcaccgagacacaactctatcgctcttcgtctgaaaagagaggcgtcctggctacacagccttttacatttctagtcgtttttttttctcatgagctgcgtttgtgggaggtgagtttgtttgttttgttttcacgtgcacgctttccgaactactaaacgtgtttttctaaaaaaatttctataaaaaatttactttaaaaatcatattaatatatttttaaagtttaaaataattaatatttaattaatcatacactaatggctcttctcgttttgggtatcttctcaatcttctcttttcctcctctcaaacttgatgtttaactatttgcttttcctatgccaataacttgtgaatcgtttatgtatgtatgacatatgaatccaatggtatatgctccctccgccaaaaaaaaaatgaatctaggactgtatgagatatattctagtacaataaatctgggcatatgcatgtctagattcatattactaggatatatcaaatccagtaatgtgttggttttttatggaacagaggaagtagttaattatcatgtctaaaagtagcaaatagttaaggcttgttaactttgttatccaaattaaccatactggattttgatagattttggcattattaaattttggtagcattggctttatttgatttgatacatttatcaaaatttggtaggcttttaaaagagaaaactactaaaactaccaaattttgctaaggttataatgattgaagtatgtttagtttgttgctctattaaaatttgataatactaaaattttataaggttaaaattggcattgtggcaacatgaccttaagggccattttggtttgatttaaaaaacatatcttaccaatttattagcaaatttaatagtatgtgtgttactttggattgagatcaaatatttgggagtactatatttagtcatattctaaaagtttcttcactatactatcagaatttggctttatattggcagcaattcaaatattaactaaataattttaccctaccaacatttttttaatagtatgccaaatttacatagtctttaaattatctccctgcgggaccgttgatggagacgctcgcgacgtgtacgttaaccctcccagatacggagcaccgagagcatcttgtcacggtgtgtctcattgcacgtattaatagccggttcgtgcacagccacagcccgcaacacaccagttgtcgagttgccccgacgaaggaagctaggggttatttggatggtgaccatactttgccacaactttggcaagctactttgagcacatatttatcataccacactttttaattttgtgaacacacttatcataggtatatatctttgccaacatttgtctaacttgtgaccaagaatttcttagccacataaattgtggcatgccacatcttagttagagaagtttggtaaactgaaacaaaaatccaaacagcccctaaatccaccaccgcaccaccacccgtctccgcgcgcgggacggcgacgtcggcatcgcgcgtcgccgcgtccgcttgtgcgtggactccaccgcacgcatccgcaccggtgagaaaaactgggaacgcaacgcgtggcgcagacgcgtgcgcgggtcgatcgtgcgcccggtgggttttccggggaaattggggcgcgagctactctcaggttgcagctggtgcgggctggatcggagtaaagcctctgtccagtgatggagtgagtggtgactgctgttactcgatcggccagcgaacgaaccagccggccgcctagcctaagatggcacgatcagcaataactgctgtcctaacctggggggtgacttgtgggagtgtgaggccaaatctgtgctttattttccactaataaataaataatacgggtcgagttgggtgcgttttgtggtggtttctttgcgttgctttttggactagttcagtgtggtttaccctggtccggtcctgggctacaggccagcaagtccagcagagcttaggggtgtcaagcaccacaaaaaagttgaatttagccgttaaagaaaccgagctccacggctagtggagatgaacacgtccaagaatggtggtttggcttctctgctttaccttttccttttaacttttatttccatgctaggctgattctctacgggccgatagtggctttttaaaaacaattacgagccaattcggtgggtgttgctacagcattgctgcggctgtgcttcagctaagggagggcacaaaccactgttatcgactcgcagttgcagcctacacggttgtgataaagggcagccgaatagctcctatgtatagcatggttcttttctctaaaaacattctacaaaaccattgtttaaatcacttgttctatactaagttttggttttattcccacaaataaccaccaataatctatatcaatcatccatacaaaaacagagcataatgaccgcctggttaatgtggactgtggagtgtggacgcacgattgagctattctactctttaaacggtgttgaatattgatctggtccggtcttccagatgttctactccaggaaaagccaacacgccgtgaaagcatactagcagcagtagtacagtagtacaaatgcttcttgtttcaaacttcaaagtaaacagtagtagttgtaaagagagcgaaattgcttcaagctaaccgtattgtttacttcttgaccaggcccagatgtcaactagaggtggcaggcagtgacgcacaaactgcacaagtgctactccatcagtggcaacgttgaaaagtaaacaccgctgatgctccaaagctttcttccgttgaggaagtcaacttgagagggcacccttttgaccagtaaccacaccaccaactggaactggaaacatgctctaatgtgctagtgctacgtgccgtatttctatgttgagtcctgctatacgtatgacgtttcagttatacaactcatattcaactagataaatataattataaataattaaagaagaacatgtttatatgcactgcaaccatttacaaccattgatcaactttagttgtatgtaagttagacaggtcgtacgcataacaattttcttctatgttccatacgctttgagatcagtgcatggttcctcgaagacccgtctgggaagcgggacatttattttaaagcattactagaaaggcacatactacaagtatattatattcatataccccatgaaaacgtttttctaatatgttaaatacatattagcgacaaatcaatagcatcactaaaatttgaaagcgcatccgcatatgcgtaacatttacgaacactaggattcaaacacatggtggatggagttatgcatggcctccttttagaacgagctcgggagtcctaggataaattcacaatcttaccaatttttttgtttaaagttaaccgtgtgatataaaaatcgttggtattaaaatttaactcctgatagatgctataggacagaaatgtttccccttcatttgacatttttgatgcacccattcatttgacctttttgatgacataggacagaaaactacacccaagctaccttgaatacagatgtttggactttggaagggggcagataagcgactttctgtgggatacacatcaccatgccagcatgccccatgactaaatgctcataggccatgacagtagtttatgaaaacagataattttgatgctatgcgtgtattgataggcaaagctggaactggaagcagtcatgcttggcttttcgttcatgtatgggtacgtagcaatccatcagtccatggctccatgcctctagatgagccaaagggacacgactaacacgagtattagtgatgtttcagctcagttccccgaacctgtgggaagttaaatcattaatcatactagttcaatgaacattgtgcgttatttactcgtcaattctgatcgcaatcagcgaccaaacgcgctctcatcattgcgcagttggcatgttgcctatgtgccgaattcattgcatccatttttatttttgggtgtcattccttctgaacatgtcacgcacatgcgatgagccatgtctctgttatcttttgttccactgtccccttaggcccttatcaaatttagatgaacaagaagtagtacatagccatgacaaacagagatactgaactttgtggaagcacttacaagttacaaatcgctacatggctgacacttgtgagatttgttcaaattcatagtaccaggtaactatattttaatacggaagtagtacatagccatgacaaacagagatgctaaactttgtggaagcacttactttacaaatcggtatgtggttgacacttgtgagatttgtttaaattcgtagtattaggtaactatattttgagacggaagtagtaccatgcaagctaaatatagttgcattaatccgatcctgctatcacaaatggagtagagctaggaaaaatattatacaagagagtagacctatagtttgtaggaatacacatcagcaagtagcatcattttcccttatagttcaaaaagatcactcaagttcaccaaaaaggtgaaaagaaaacgatgatgaaattaagaattcatatcatcatccacgttgcattctccaaggtagaccttgatgcttcttggtgacccgcagttgccttctgcaataagagctctatcgtttgcagccatgtgttggattattttgtatatcatttcgatctaaggttgcatcaaggaaaggagttagtgcgtcaatccattgatgtttttaccagtgatacgagaaaagagcatggattacgggttacctcttcaggacagtggcagcgatctgcaatttgatccagtgtcaatggctcagcagggtccttgcagctggaagatagtaaactcgactataagcagaaagatctcctagtacaaaattaacacaacaaactggagactagaaatgttatcgtaaatcatatctttggttctcaccaatcttatagcatatccgcatctgtttctcatgaaaccatgtggagaggaattgaaacggttatatgttcatgacaaagagatgcctatatgtttcatgttttctttgtggagtactttgttcttatttaaattataaaaaaaaatattactgcaaaaaaaaggtcccacagtcacctcttccaactatttgagtcaactgatcagctattgtaatctatatacatatcattttttaaatggttgccgctaaccaaggtactcaaacatctccagaacatttttaacaggctattttattccaaaaggacgtgggtgtagttcaagaatttaggtcaacacatctatatgattttgtttcaagttctttggactatagccatacctagaaaaacaatgcgtggttattactgcaatgaaatcaaacagtagaagaaaagggaatgaatgcagttcaagaacattgatgttgcccccatgaagaaaaaaaaaaaagaagattgatgttccatacctggcttcgttaagaacaagtaggatccttttctgaagtgccaacacctctccagcagcctttttccctgcttcgacacctgtacaaagcataataatttgcatagatcatagcaacaaattttcttaacaattcttgagaaaatttaaaaaattacgagagagtcaaaccaggttgatgataggcattgatgttgattaaataagcataaagaccgacagcacgctcatagagtgcaacaagtgctccaacagctctagggtttacttcttggacagtgactgtaatagattcgcggtcatttgcataaagagctgaacgagttccctacaaaaattaactttgtttcatcatcagttttatgtaattggtatcatgtcaaatctcacttcatatttctatatcagatctggaaaattacatgtagcattccaaacaagtagtccccacatgtaacacttggttcaagctcccactcatgaccaggaggcctatcgcgcaaaacttcaataaaagtaacaaagaagttgtgcacaccttctctcagctgctgaatgtagctgaaatcagagataaatcattggtcatgcatttttctaatctatatataggaaagtaactgacacagaagatgagaagattgtaaagatgtaaacttacgcatgctggtctgtgcttcctttgttaccataaacagttagtccctgattaacctgcattacactatcatatgttaaaggcctgtttaggacatagtataactttttacagaaatctgtacattttccacatgaatagggaaaaggcccccctttgaataaagacctcgacatgactgataatataagctatgagaagaaaaaggaataatgcatacccgatttccatcaaggtcaaattcttttccaagagattccatgacaagttgttgcaagtatctactcaaaagaagcaggctatccttgtatggcaatacagccatatccaagaacagcaattagtatcgtaaagactaaggataagccaaaacacacaagcagtcacaatgcatacagatgcatggacatggaaggaaacttggaaggaacagcgaataagccataataactgatcaagttgaaaactactaaccttactgcctattccatccgatgcccaataccaacacaatgcaagcaaggctgctggattttccttaatctggacacgtaaaacatcataatcatatatatatttagttacaggagtggcattgactatttaacttgtattttatatgttcaaacaaatcatacttccagtattccctttaaaaaaaaaattcatacctcagtattcctagtttcctcatccatttgtgcagcaccaactagcatttccttgatgtcaatacccttgtaagttgtaataagtctcttatcagttgcaacattggaagtccatggaaatatttttctcctcaacagacaacagaacatgcaaatgtgaggcactgacctgtaatgctgctggcagtaaaccaacagctgacatttctgatgttctaccaccaacccagtcaaacatgggaaatctagctaaccacccctctattctggcagtgttatctaataaagaattctcttgagtaattgcaacaccctgcaaaatagctggtcctacattatatcaaatttaatcatggatcaaacacgtgcatccacgattagaagaaaataataaaattcacagggacctatgattcttattttgtttggtagaatcacaggaacctatgataatatacagtaagcaattatctgatcaatgtttggtcaccatccttgtaaaagaatgtcaggtcaccattggaaaaggtttctaattagcataatggatacataaaaaaataaattaaaatctggctatctatgttatggctcaagtactatgattgggagaagaacactaagacaacatttagtaaagcataatattacagtgatcaaatcatcaaaagaagggatattgcaggagactacttttttcgtttagaaacaaagtactacgtgacagacggtaaactgagaatgaaactttcacacccacagtctcgtacagagcaacatacagtatttgataccgaagagaaagaaagcatagaaggacaaaaaagaaccttaggtcacaacctgtttcgagaattctagtccagcatctcggaaggccttttgtacttctaatagaccatttcgtgtttcaggtgtgcctccactctagaagtacgaaaaaaataagatatatcagattagccatgaagtagaaaaaaaaacagataattagggtgtgcatgatgtacctttgatattacaatcacaagagttgatgcaagttctggtcctagctgtgcaatctgatggtcaattccagctggatcggtgttgtcgataaatcttatctgacacagccatcagaaagataaggtagatcacacttcacacacacagtactttgagctgcagaagacattttaacaatacattacattgcaaacgagctcactttacttatgggtaaataaagtccataagcaagtaagctactcagcctactctacagcttaaagtccctattgaaggatttgaatttcaacttggatcagacacaaatgatagattatttcaaggcaaaagtaatgttacacaaaacaaaagttcctagctcaaatgggcctttgtagtagatagatatgatggtgtagaaagcaaagactgttcatattttctttgtggtattcataaaactgaattctctattgaatttggaatctcttcgatgggccctgaatactcttggacctattacttcagcaaggaatggatcctagtaactatatagacaaagtaaatgagaagaaaatgtatggcagatggtacagtttacaggaataggaaataccatcagaggagggttatctggagcaagtgcctccgcaacaaattgtggccccaaagatgaaccaccaattcctatagaaagtatttgagtaaatcggccagcaggggaggatggaggtcttatctgcattaagtaaaccatcacaaaagtagcatgataagttgacacaggacataaaacgtacctacaaaagatgcaatgtgctaatgatacaatattgtattgttacgacaagtaatacaccactaagttgtttggatgctctgttatcccacatagaaccagaacttaacaccactaaggccctgctcttttcagccacttcactggattattgtcacggaaattgtttcttctactgcattgtttagttctcttgttgtaaggtaaattcatcaagtttatttattagaatacttaatttatatccataatcgtgtatataatccactacaataatccgcccaataatctgcttgactacaatgctaacaggtcaaattattaaattaattaatattaaccccgagaagcagcctatccctatgacctattccatgccttatcacaattcacaatacacacaaatcgatcattgctatccgtaaaattgaaaacggactatccctcaagcgagtggaagctcaccttggcggagatgacgtcgctggcgaacgcgaggatgcgttcgagcgtggtctcgattttgtcgcggaggaaggagttgggggcgagggccgggttgcgcagccagtagtggccgaccatccggccctcgtcggggttggcgatggcgcccttctcgagctcccgcatcgccgcgaacgcccgccccatgggcgcctccatccgccgcaggaactcctcggtgaacccgatccggctcacgtcgacgaacagccccagctgcttgtgctggtacagccactccacgtagcggttccacagcctgatggggtccttgtccaccgcgccatgggcgaggacgtcggcgtggcccgactgcttggagctgagcgagcggggaggagaggatgacgacgacgagcaggagcgggagacgtcggtgatggagctgggacgggcgaggcggaagtgggaggagcgcgggaggtggtctcgccggaggcggaggccgcacgacgccccggaggaggagggcgccgccgccgccgcgccggagatggaagccatcgccggagttggagcgtgtggctttgggagttgggagttggaaggggactgggagtttacgacagaattgatgatgagattaaggtgataatttgatttttaatcctaatatttagtttggtagagaagatggacattgctagggagtttagttggagattaggtctttaataaaaacggatggctgagatttgcttagacaaaataaaataaaggaggcattcactcccaattatctgcccctaccttggtattaaaaaggtccttcatcaattcttcatctctatcccaccaaaattaacatgtcttctaaccaaacaaaacacttaatagtctcgtccctttgaactctcactctcactccctcctacaaactccctccgaccaaactggccggagaggtaagcctcgcgagatggaagctgctaatggggcccacttgtccgtgacggagcttacaggccgtccgtacggcccaaaagcccagctcacgtgtccaagattgaagattccgagtgacggaatctttatgggcttttttacccttcgtgggactagctatccatcacacgacagatttttgggtgcaaatcacacagattttagattagttggattaggctcatttgatcacttgattagaagagtctatacatgtatcaacatatattaattatatatattgcatatattttatttgttagatctttatattgaaaaaaatatatcaccaacccatctactaaaagttaccgtgtaattacactatagttacattgtaactacactatagttattgtaactatagtgtagttacagtgtaactgtacacttacatgtcatatcaactaaacttacaaatataattttagttatataggattgtaattttatattttaaaggaaataacaagtatatatttacttatacaacatttttatcaaaattatagtgcacttacatgtcatatcaactgaatttacgaatgtaattttagttatatagatctgtaactttatattttatttcttcaatctcttcacctagccgcaacgacgtgcaatgtatgtactcatcaattatgtgccaagttagatgttgctggcctcatgcgtgcgtgggaaggaaacacatcatagccgctaattaaatcatgcacagactaatccacaaggatagtaaatccgagtgatttcgagccaaaaatttgtcgccagatttttagcaaaatcgttataggattcgtttctcatagtgccttttttttaaaataatggaataaatccgttttttttttgctaacaagagttacaatcacttattacacaaactcgttcaatagggatcacatatcatgtgacgtaggtaaaatcgaaggcttaaggctgagttcgtttaggagggttcccaaccattttccctcgttttccgcgcgcacgctttttaaactactaaacggtgtattttttttaaaaagtttctatacgaaagttgtttaaaaaaatcatattgatctatttttgaaaaaaaaagctaatacttaattaatcatgcgctaatggactgctctgttttccgtgcgggagggtaaggttcccaaccatgatccacgaacacagccttagggtttgaggatttattgtatcaatgttctgggctacgaggatcaaaatatatgcatatcccggtttgcagagttggactcaaccttaaaatcttaatattattggatgtagaggttggatttttaattttatttttttttaaaaaaatggaagatataaactcattatgtggagagattttgcttcatgcacccacttgtttggttcattgccctttctcaccatgccaaaaaaattggccatgctaatggactaacatgttcatttgctttctagaaaaaccagcatgttcaagatgctagctagagtgataaacaagaggctatacatataccaaaaattttgctgcatcccaaacaatcattttttaccaaaaatttgacgataccaattctttcgacaacccaaaacaatagttcttttgaataattaatgctagatcttaccattacaaagatctaaacacaggcccgttgtgtttagatgcaacatgtttcagacaatctcttctgattgtacatgcaactgtccttgtgactctctccaagtactgtactggttccatccagctctttagccgggaggaagtttaggactagtagtagtgtagtacttataaaccgtgagctaagttaagctaatctcctactagtcctagatgtattgatccaatgtgtaacctgccggcctatcggatggtagtacggcacagtccctgaagcagtactctgacaaagaaaactgcacggttgctacgtacaccggtacacgcttaactgatgccggaagagtacaaggacagcttctcattctcattatgatcgtttgctgtagttttcttttctgacataactggtgaattggaagcaaaagattaattaggaaacacacaagacaaagtggagagtaagggtgagtttgagaggagggaaaaagagaagattgggaagatacgtaaaacgaggtgagctattagtatatgattaattgagtataaactattttaaacttcaaaaatagattaatatgattttttaaagcaactttcatatagaaaatttttacaaaaaacacaccgttagtagttcgggaagcgtgcgcacggaaaatgaaacaaactaactgacaaactcctcctgccgaacgctccctaagcttggctagttgcctgctggaaggcgctctagtgcatatggagatggattatattcgttctgctcaattaagtggggattaaggagccaaatccaatgatagccagatccgtctgcaccatttgcctgacaatactaatactgagttgtaaactttgagcttgctgggtttgaagtcaattcttaccataccaatatgagttttgggactaccaaatttaccgcgggtaaaaaattgatagaaaactaaacatgcatgagacactattgaaattgtcaagaatttgttagaacaaatattggcatcaatccaatcaagcccttttaactccaaactataaattagttgttttccatcagcgcttcccgaacagctaattaatacgttttcgttttgtgcagaaatttactatatatatacaagttttttaaaaaataaattcatttttcaaatatatagttgttaatatttaattaattagactacttctaagtgaccagtatgctacttctattcgatatataaggtttcaaacgggccctaatactacgatcaatcaaaggaggcccagggtggtgatagcctgatacggtcagcctctcatattcttagcatcattgggagattgattggtcctggccaagttggcaaccaacatgaatgaattaaattgatcctggacaaatgaatcaagaaacaacgcgactaacaaggcctgatcatccatatactccaacaatatcgttactgcaagtggccatgcaatgcaacaaatcagtttgctaataagctaggcgacatctcgatggatggatgagagcttgcatagggagtctcagcgcggagggcggcgacacgcaagctaagctagatatggcggatgttgtgggtgtgtgtgcgcgcgtatagagagagagagcagctctctataaaatatagtctttcggatattactatacaactataataatacaaagattgtgctataagaaacattttttaaaaaaaactactattatattataaaagtatttttttgattaatatctaaaaaataatttttatgcacccactttagatatttcagaaggtattgacctttaaagtgtatagaattcaactgaaatatgtcgaaacatgcacatgcaattatatttcccacaaaaatcacatattcaacaactgttttgaggtatgcaaagcacaattggtgttgaacccaatagtttaaattatagtgcccacgaatattctacaatgtaattgctcttttaattaaaaaaaatagtaaggctaggaatttacgtttctgttgacacaaaattcatcacacacacgaaggcatgggagatttgcatctgtgttgatctatgattaaagttggacatgtaaactaaagctgcgtttaaaataggatgggggagtactacgaaatggcagattcaatgttagattgattttttttttacgaagggagtataatcaagcgatctcgtcacgaaaataatgacttctttcccatctctcatttctatctcatcaatatgtacattaatttggagttatcattattttggagctgtaaatgcctaacaatgattccattaatttcgatgttgggccatgcaacaagcatactcttaacctcggttcgtgtgcattaatcagctagtagatcacgcacatcaattgtggagttaagggtcaaataagaaaaagtgacagtactgagggagtacacctacgtacgtagatggccgaacaatcgtcgctctctttgttttacgtgcttgtacttaccttctcttttgactcaccagttaaaactagatctaagatccctctaatgcaaatgtctagctagatctcacaggccttcctgagaatcgatgcactgtaacatgtgaccagttgccagttgggttatcttaattaaattcttaaattagactattgctgctgcagctctagctatatatactcctactatatatatatatatatatatgtatatatgtacatatatatgtatacatgtacatatatatatatgtacatatatgtacatatgtatatacatgtacatatatatatatatgtatatatctatatatgtgtgtatatatatatatatatatatatatatatatatatatatatatatgtatatatatatgtgtatatatatatgtgtatatatatgtgtctatacatatatgtgtatatatatatgtgtatatatatacatatatatatatacatatatatatatatatatatacatatatatatatacatatatatatatatatatatgtataggacactcatatggggcaccatggtgcctgggcaccatggtatcaaatacacaaaatcactcaaattttttaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatatatatatatatatgtgtatgtatgtatgtatgtatgtatgtatgtatgtatgtaaagagaggattaagcagagttataataatctctctaggtcaaaaagaagaagaccaattagcgttacatcagtcgtctatgattaatctagaggggagagatatatatagatatgggcaatgggacaagagccttaatgaccgggtcgaccggatcgcatatgcacacaaacagaaattacgtaccggaccaagctttaattgcgtgcattatgaatgagctgattgtgacacttcgtcgatcgcttgaacatgcacactgacacgatgcaatgctagggccctaaacccctaagacagcaggggtattattcgagcctaataaattcctttactcaaaccagtagtgctttatatgaaaatttctttgatttaccactcgcaaaagcttattgtacaaaataccgttaacgaaaatgtgtaacataggccatttcgtagaattcgttatggttttcctcctttctaccattatctctctattattacgtttataatactcaaaatatccgtaggcccgttattatttacccaatggccactctaccaaggatttggttgagatcaagggtgaaatataatgtgtatttagatgcgatagttgtcatccatattattttgaagtagatttgaagtgagtaatgtgggcggattgcttcggatatcgaagatggattagagtcgatgcaagcttagtttaaaaatggattaaaattattggaggttccacgtatatataatcagttattaataatgagtcaacaatgcaacaggcaacaatataataactatagagcatatgatttctgaacatgatttatactctcgaggacaataatcagtcagctatcaagagacgagagtcggagaggcatcgcttgctgctgtctaccatcgtgttgtaggccatcaccagccgtggtggaaatcacattatcatgaggctatatgctgagtcggagaggagattaggatggccggaaggggcgtctcttgccgctcgttacatccctgcattgcgttggtgagtggtggcggctacataggtgtgaggtgttacagtgtgagcttgcgatagaggagtctaggttatctgatgaattgatgcatgggccaacttatattctatggaacaaatggagtgattacatgggttaaaaacaaatggagtggttacatgggttaaaattttttggataatccaataaaaattccgtagcataattagtatccaccagatattaggaacaccatatctatatctgaatgcacgtattatatctactagatttctataaatacagtcataccatattctcatttcggatggatttgaagtagatctgatcttatctattttaacccttaggccctagtagtgtaccatgtaacgttgctagtgcatgtggttcttgatcaaagaagtcgtgtgtgggatacttttcattcaaaaagtacaaaaaaggtaaaaggggaagaaattttttcgtgtgatggcattcatcaaattcatttcgtagcggcatttagtagaacgaagcattttgtaatgacgaattgtacccttataaaggctactcagagtgagtatgacattttatcgattttacatcaaggtgtctaagtccgtcctcgtagggtctttcgtgtcctcctccctcacgggcgacacgggaggcggcaaccccgccgtcgcccgttccccccttcctcctccgcctcgccgtcgccggcaaagccgcgcggccacaaggacgatggcagcggggcttcgtttttctctcgtctcgccggtagtggggggccgtgcggatggcgaaagaccacccagatccgagccatcgcgatctggcggggaggcagccgacggcgaggcagcgtggtgaggcggcggcggttggcggtggtggcggcagggtctggaggtggtggcgatggagaaggagaagagatggggactgacgacggcgggaatggaaggcggtagcgaagatggtgacggcaggcaggatccagtcacgccggaggtggatcccccctcccccgaggacggatctggtgtggggcgagctcgcggcggtggcggcgctacggagcccgcagctggccgacaacagtagcggctgccggctgctgtggcaaccagatgcactcaagacggcgacagcggcgcggagctcgtggcgacggtggtggcagcggccggacaacggcgaggtggctggccattggcagcagcggctactgtggctgcggagggaggaggcacgatggtggtgaccgtgactacggtgggaggaggcatggcggtctcggacagctagctggaggcgtggcagacgaccgcacctagctagcacgacaatgattggaggaggagtcggaggccgacttgccgcagagaggcacaggcgatggcagtggaggctggcacggcgcgagaggcacgaccggcggtggtggaggccggcttggcgcgagaggcacggcgatagcgggaggccggactggcgcgagagacgcgtccgggggtggaggaggctgacgcggcgcgatgaggcccggccggcggtaaaggagacgaccacggtgcaaggagaagctaccggtgggtgtggcgcggtcttcgatgcacaaaggccgcccggtgggggcgccagtgcagtggtcccacatgtcggcagaggttgagcggtgatggagcatcgatgcgtcagccgtggactcgcaggtgatgagctgcgggtgaaaacccagcccggacttggccggaccgacaacgatggttcattccccctcctgagggcgttgtcgtgccgtcttatccctcaagggtggttgccaagcgaaagcccaatcttggctcttttgagtccctgccgaacggcggtgacggttttctgtcgcttatttcgttggagacgtcgtttaggcatcctcttgccgaaaccactcgaatgattggtgcgagcaagctctaggatagagttgggctttgtgttggttgtaaggactttttttgggcgatctcgtctgtgttcctttgttggcctagcggtggtcggtcacacttagcggcgaccggtccagtgctagccttctcccggacctgtgtgttggcaatgtcggtgtgtgggtggtggtatatttttttccttttttctagctacgaccttccaatattgtaatcttgtaattttttttctgctctgtaaatagaacttcgtaccatctcgtgcgagtcgttaaaaaaacattttatcgatttctcccaaactggtaaaattttctcataattactgcattctatttttcttagacaattgcttatttgaccccgttttgagccctaactactaatttgaccctactttttaaagtttgcttatttgaccctccttttcaaaaagaagctcgcgtatgaccctgttctgttaagggcatctaacggtgttaactaaagcacaaaatgtctcttttgcccttactgatttgaccctattacgtgtgggacccacccgcagttccctcttctcctctcctctcctctcttctcttctcctctcctctcctctcttctcttctcttctcctctcctccacggggcggcgactgatgggccggtggcggcggcgctctgagggggctgagggagagggggcatgtaacatcccggcctagggcttaataggattaatagaatactcatatcaacaagttgcaacttcttttctggaagccaatctccaaagaactccagggttaagcgtgcttggcctggagcaatttgggatgggtgactgaccgggaaattcttcccagaagcgtgcttggcctggagcaatttgggatgggtgaccgatcgggaaattcttcccgggtgcacacgagtgaggacaaagtgtgcagaaaagacatgtgttggtctgtgagggcagtctatgacctatgaaaggtgttagatgtaagtgggcctggcctgggagaggcgggtcgttacagggcgagggtgtggcggcgctggctccggctctttgtcgtcgtcctcctcctcgtcagcagggcaccggcttcggctcttcatcgtcgacgagccgccgccaccactcctcgtcgtcgttgtcgtcaccagggctggtgccggctcgtcgtcgtcactggggccggtgcctgctcatcgtcgtcatcaccagggcggcgccgatctgagggggtggcggcgctgactcgccacaagtcgccgccgttgccgcaaggagagaaatgtggatagggttgggtggatgcatatggttttctaagggtattttgagtattatgaatattagttgtatttttttaattttaaatcaaaacttaatggactaatggaaacagggtcagacggaagctttgtttttgataaggatggtcaaataagcaaactctaaaaagtagggtcaaattgatagttaggattcaaaacggggtcaaataatagtcccattttttttataagtagagggcaaacgctcccattgcagttattttttactacgtgtatgttttaactctttaaccgcccgagacaaaattaagctacgtgatcacgaatctggagacaggagagagatctaccggacggactctgccctcgatcctctgctccctccgattccgatcgattgcagaggctcacaaatacacatatacatccaaaagagagagacacatactgtatagtactcgccctacatacgtacgcgcgcatttcgcactacgtacccggcacccacagccaatatgtatgtatactaattaacaaagcgtacgtacgtgcgtcagagatcacgtacgggacactgtgttgtacaagtgacaatctacgtatacgattacgtacgtacgtactagctagctaagctaactcgtgtgtagctagcaagctacgtggaccacgggatttattgacgttgtgcgttgcgtttgcgtatagcacgtggaccacggagacgtgtaccgtgcacatctacagtttcgtttttttttttgggctccgttaccgcgcgcgcccccggcaaaattagtgcacgtacaatgtacgggagctcggtttggtggaaaccgcacgaagtgtacatgtgaggtaagccacacgggcacacggaggagtttggttaggtgcagcgagatgatcatcttgtgctgaggccatcctgtgctgcgcgcctagggcgtaatggcgatatcaggcaccgtcaataattccatcgtgaatctggcggagccagagtttactcatcaagagtaggatgaaactactataatctaccctaatgccttttatcctttttttttaagttgtgcttcatttcatacaattatttttttccagatgtttcattacataagacgtgcatacatacatacaattaactaattaacacatcatcttcactaaattgttattaattaatttctttaccctcaagatctctaattatattatatgcatatattatatttactagtgtctagtgtgccaattctaccgtaagccttatgggaaaaatactacctataagacatcattgagaaattccccaatgtaatgttatgattttctaatcatttgattaattaaaatcaaatgcatcacacatcaccctcgctatctgtgttcatctgtctccaacacatcgtcccctaatcccggcccatcgattaggatttgagcgacgcactcgcatcgactttcctgctatcatcacatacacacctttcttcctgcctcacgcgctgtcatccctttgtctctccgacttcacctctgatgttagcgagaagccgagaacaacactacagatcttctccctccacttcatttttctctctcccccatcatgtttctcattgtcggtgctcctgagctatcttcctccacttcttgtggtttctgccgttggatcggccatcaatatccgtcatctttaatacgtaccgtcttgactcccctactatctccaaccaaatctttcacctcccatcgccctccttcactctcacggctttagtggcgcccccaccgtctcatcatcctcctattgctcaccgtccactggtcttctagactcgctctaaacccaaccctcctttgaatcaatcctccgaccccaaaaacctaacccggtgagattatcgccacatcctcgttgtcggagcgagagaagaaagaggacggacacacgagtcttgagatcaatctaatggtttaaaactatgagaattgtttctcaaatgtctgtccaaactctaaaggtagttagcaaatttgcaaagaaaaaataaaacaaataatgtaagcactaccaggacagagtggggatcagattgcacgccgatacgagaggccagctgagccatatataccacgcactgataagatgcacgtacgcgggcacacctgcaggatacgatacgatctcgtgaccctccctccgatcctacgggccagagttttgcaccttatcctcgacagggcaatgattccgatctactatagctactctctcataaatcataatactactgcagttaataattaaacatacatgcatgctactgcacatatactgctatctctcttgcaaattttaatgtactacacgcaagtgaattaatgtaagctcctagttggtttttctactttcccttgtacgtacctgcaaattaaagcaattggggtcccaatggcaccttgagagaatagttacacaggccgtgcgttgtttaagccacggcgagagacagccggagttaagggttttgccgattcgtatcgacgtccttgtcaacaaaatctgtgcatgtctggtaccatcctttacgcccccgtccggccggccggcggcgattattgtcacaacaaaactgcactgttgttggagtactgttattttctcgtaccctacgcttattataatgaatctggatataccattatagtattagatagtatcccgtttacttctcgattagttttattctcggttggtttgttatggaacggagggagtacgcttagtggctcctttggatcatacgatctcagtcctaaaaatatactccattcgttttaaaataagtttatctttgtattctcttatttatctcaaaataagtgtatttttaagcagtttagagtttataaaagtaggagataaatgtattagaagtagataaatcagaggataagtgcattgggatttgataaagtgaaagttattccagtcattttacttttgtattagtatgtgttgagatgggtgaacaatatatttattttgggatgtaggaggtaaggaattttggttgcatagctaaatctcttatatttcgaaacgcaggtggtaggatttttaaaacatggggaaaaaatagaagtatgttgtcacatgctatacaatacttcgagattttagggtttgttctctttattgccactttgatacgtatcaaattttggtaagatagcaaactaaacaataccttatgaatgccatcctaccaaaatttggtagttccgaactttcgtcttataaaaacgctaccaaatttttgaaagacgtcaaactaaatatatccaacactaccaaagtttaacaacgtcaaaattatcaaaatttaaacattgtcaggtcgaaattggtaacaaaatgaacatgcccttcaaatcgaaaaacaatagatataaataatgtactctttggatggttcacattagttgaaacaatgggattttaaagaaaatcttatatgggagagagatagagagtttgtattggacttagcaaaataaaataatacaaagatttgatgtcgttattaaatttcttatagaatagggtagggaagcaacccatagaaatcttgtaacgctgtttttatttttttcaaagggtatcacagattttttttccaagtactttaatggtgcaaaaaattctatgaacttcattcaatctaaaggaaccatgcattactggctttactggatactgctgccatgttagaggaaggttaatagtatcggcgactgctggcggcaaccgagtgccacatccttcaatagagagctaatctataatgcatacaacaacatgcaacacttctttattttttttaatcgagctagtgtctactccaaaggaaccagccagattcatatgagaaaacataagtaaacgagcttccgcctgagcttccaaggataaaggtagatgaacagccatttgatccccatcaaagtctgcattgaaacctttacacactaatgggtgtaaacaaatagtacgcccctctactaaagtgggttggaaagcctgtatgcctaatctatgcagggtaggtgctctattcaacagtacaggatgtcccctcataacttcttgaagtatttcccatacaatgggttccttttcccaaattttccttttagcaatcctaacattagaagtagcacgtttcgtgattaaatcgcgaattacaaatagctgaaaaagctttattgctatctctagaggtaacccacattgatgtaatgaaagtgaaggacccacaacaatgacagaacgccccgagtaatcgacccgtttcccaagcagagtttcgcgaaacctcccctctttaccttcaattacatctgaaagtgatttgtatactttattgtgaccatccctcgttggttgcccgcgggacccactatcaagaagtgtatttcacgtccccattcattttttcattggttgtcgtgagagtaggtgggcctatggtaggtgaaatgcataggctcgcgcgaagagccagcgactaaatagtcgctcgtttttctctctccaagttttctttctcggccatgtataaaaaatcctatgtaagcatgctattaacccattgttgtacctgctcatgatactaatggtgcagtttaatctaggcatttttttagggaagataaactgcatatttttctgtgtgctctttcgggaaagccaatatatatctgagcactccctccgacggtggctgttaaattaaatcttgaaaaatccatcggtgaattcgaacttattttatctggaatagaaaatcacaatcagctactcactcagtctctctgttcaactccttcagagagggaggtagtagaacgttactgtcgtgatatgcgagagctgagctaggtagatagcgtttctagtacagtaataagcaagcaagcgatccgaaattctatgcaagtaaagcacaaaagaaccgccatgttgttagcttgaagctcttatctcccaaacaagnnnnnnnnnnnnnnnnnnnnnnnnnnnnnnnnnnnnnnnnnnttgtacacgttgttgttttcttcttcttttttactttcaaccagtaatattgtaatcataatccgtattcagattgaatctaagtactgtacttaattaaccaagacgatccgtaatgcttctaggacggaaatgcatgcgtgatgtgatcgagtacatgtcctgctcctggccatgtttgtactaacactaatcacagtgtttgtatagtttttacactatatctgtactgggaaggaacaataatatcagacacatttgtgaatgattgtgttgtgttatatcatcaacaggccaattgcatttgttgcagtagattgtaattgtagttgagcaaaattaaatactaactagcagatcgagctcctctcacagtttcacaactgcacggggccaggcatttcatacatgtctatattttacacaagtctttaccaaaacaggaatactcctggattttgctgtacatgtctttaccaaaacagagtactctcctagattatattgtacaagtctttaccaaaacagagtactcctagattatattgtacaaaagtcttgtccttgttgcttgaagtacatgtacatttttttcagcataatttttatcctgatgtattgatcaaaattaggcttgaaattaaatttgtgatgtgattggtgacaccacatatactatagttacttgctatattttagaatagatgtagtagcataattttacaatcttgtagaattgtttgtgacttgtgaggtcctcataggaatatctaaaacctctcattttgcatttaagagcgtcaccaacagatatccaacactcctccctttgagaatctctaaagagaatttgagcattaacttcctaaataaaaaggtggctacttgaaaaacatagtttctcacccctcctacgtggttgtgcgcccttccttacacgatatcccgagcaaagactctgggagcgagagcgctcccacatatgtcgatagtaagaactcttggtgaattcaatttttgattaaattgcctctatagactataaatgcatgtcggattcaactttatatatatatatatatatatatatgacactcatatggggcaccatggtttcaaatgcacaaaatcacttaaatttttcaaaattttcaaattgtgagtatatacctagttataagaattcgattcatacctatacctatcaaccaaacaactcaaatttaactttatttcacaatccatgattacatacctaactaattatatgtatggatgctatatacctagaatcaaaatctaacaaaaacaagttcaaattcagttcaaatttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatatatatatatatatatatatatatatatatatatatatatatatacccaatttgaatgagtatgaaatttttttaaatgtttagatatgaacattaacttttttactaacaagtttgaactgagtttgaacttttctttgttagattttggttctaggtatataacatccaaacatataattcgttaggtatgtaataatgaattgtgaaataaagttgagtttgagttgttttgttgttaggtatttgtatgaatcaaattcatacctaggtatatactcacaatttgaaaatttttaaaaatttgagagaatttgtgtgttttataccttagagcccgagcaccatggagtcccatatatatatataatttctggaaattccataacttcagtagtactcccttcgtctcaaaatataagggattttagatgcatatgacactttctaatacaatgaatttaaacatagagccagtccaaattcatagtactaggaaatgtctcatacatttaaaatcttttatattttagtacggagggagtacttgtagtgtagacccaaacatggaaagccatcgttttcagtttgcatgcattgctactctgtttgatttcttggttacgctgaactatagtgtacagagtgtactcctgtcatttacttaccacacagtaatctcagcagcacgaatttcggatctgatctctactcgagttcgttagtactatgagtcttcagacagtacgtgttgtacacacaactagatacaaacagagagtagctgctcgtcagccaaaacgccctaattagcagagtacagtagtatctttttttttcttttcattttggcgctagagatgatcaaacaacgttctgtacagtacatgttcagcagtgaatgattttaggtggagttttgtgcttgtctttgatgtacatctacacttcaaatgactatttatgggtcattcgtgtggttaattggattgctagtagcgaatgcgtactgcatgtgtactgacaatagaatttgttacttgttagccccttttattggatcatcagctatcatgtacattttgccgattccgtttatctgtgtgtcataactaaccttggttgctctgtgatctagttcagctatatgtgctcgtaagataatcaccgggttatttaattggacaatcatcatcgctcaattagacaatatcacctgtttttttattataagacattttgtttcattaggataagattttagctatcattcgctttattaataattagttatgtgacatggaagcataattagtaagcatttttttaataagaatcttttctattaaaatagcgtaatagagaaattgtttgttaaagtattatcctcgtaaaataaaatatgtatatgaattccatttagaaaaacgtcaaggccttattaaaaagaacaccacacactaattatatacttgagctacatagtcatctcctatgttataaaatatacttaagctacatagccctctaacttactattgtctaactttgagggactgatatgtggacctacatgtcagtgacccacgttagagggcagtactttagatgagccctttcccaaccaaccatat

SEQ ID NO: 36455 - DNA, 1002 bp, Oryza sativa
caatatacgatctgaaggtttctcataaactctctccgtcccaaaaagaaccaatttctcgctatgaatctggacaagatcatagccaggaattggttctttttgggacggagagagtacaatctaggtataaaatactccctctatcctaaaaaaacccaatcctacgtttgaatatgtatgtccaaattcaaacccaagattagtttttttttggagggggtatgtgtcaatcctgttataaaagcaccaacttattttgtctctcgttatttgcttgttagcttatcaattccaactcaaatttaattttattaagttgattttgagtcttttttttattgtagtctattttctagccttgccctttttctattgtaaccaccaaggtttaacggaaaaaaaattgtttttggttgcttttttttcgacttatttgtagttctaccatcatagccaaaggtaaatttagcaagggtttcgccaatttaccttttaattttttaaactgttgaacatataggggtgggcagaaaaagaccgaaccgaaaaattcaatcactaggccagtcaggtgttgaaagattgaattttattcggtcaattcggttagtactcgatcaacaacccaattaaaccgaattttgacccaattttagccttcagtatgctttgatttgatccatgatagtcaagagtctattttgtgtttatatttttttatctagaaattaagacttcgcttgattattttggaccttctaaaatttcggtcatgatttagacaaagaccgaatttcttggtgtccaagaccgatcgatctctaattttaaatgaccaaaatttctaaataacagatcgagactgaatttttcggtcggattaaacgcccaccctataaacatatcggacgaagcttcatgtaacgttacaaataccataaaaaatgactaaatttagcatgtagtactacctaggtataactcgctaaaagtatttta

SEQ ID NO: 36456 - DNA, 4703 bp, Oryza sativa
atggtcggggacctcgccgccggcggctgcggcggcagcggcgggggtggagtggaggaggaggaggacatgttcccgcggcagtcggaggagtgcgtggcgagcttggtggaaagggagcaggcgcacatgccgagggcggactacggcgagcggctccgcggcggcggcggcgacgtggatctccgcgtccgcagcgaggccatcggctggatttgggaggtgcattctttgatcgatctggcacaggatgcgccattgcctgaaagaaagaaaaaaaaaggaatgatttttgcgctgttttctttggtctttctgagtaaatgcaatagatctgccatgattagctccgttcatttaggggggaaaaacgtgtcttttttacttcgtttctggatggattcaaaaccattcctgcaacttgttttctcggccagttttcactaatctgcagctagcgttcgtccacgggcgtaaatgcaatgcatattatgcactgaagagttttttttttcactgtgtttcgagtaataaacattgtttgtcgtagtgcgataaatgtgacgatgacaaaagcaaattggggttaaattttgggaccatacatctcggacgaagctggcctttcatccgttcgcttactcacgagatgtcgatgtgcattgtctgattctagtttgtactactacaacgtttgcaatgatggggcggcattttttcggagccaaaaaaaaaaacttctgataaaagcatagaagataattgctgtggagttcttgtcctgaaaaatttgtttcttttaccatgtgatctctaacttattgtgttttttatctttctacaggtttacacttactacaacttcagctctgtcactgcctatctggctgtaaactacctggaccgtttcctgtctcagtacgagctgccggtaagaatcaaaaagattgtgtttgtaatcatctcaagatgtggccaatgctgtccatgttcatacaagtactagatgatgagctaagattcatgcttgcaaatacaggaaggcagggattggatgacacagttgctctcggttgcgtgcttgtctatcgccgccaagatggaggagaccgtcgtcccgcaatgtttggatcttcaggtcagcatcaaaccgtgacaagcatctcagatttcgcaatgcgttgcgtttttgtttgatattgttctaagcgttgttcttgttgttgatcagattggggaaccacggtttttgttcgaggtggagacgatccatagaatggagcttcttgttctcaccaacctcaattggaggatgcaagccgtgactccattctcctacatcgactacttcctacgaaagctcaacagcggcaatgccgcgccgagaagctggctcctgaggtcgtcggagctcatcttgcgcatagcagcaggtgtgccatgataggaagctgctgaacatggtttcattcagtgacatcctatagatcagaccataattcagcattctcagcatagtctgacgatgcatgttaaacttgtcaggaactggattcctagagtttagaccctcggagatcgctgcagcggtggctgccacagtggccggagaagccaccggcgtggtagaagaagacatcgcagaggctttcacccatgtagataaggtacagattgatgcaaaccctcacgtaaactcatcctcatagactcttactagctcgtttaattctgaataactcatgtgtactaccaatttggatccatcacattcataactgaattataataactcataatttgcaaccggtactttcgtagaacacagtaccggttcagaatgcgtgaaacgcatttatgggcgtgtgagctcggggagttaatgtgctgttcggcttttgccgctgtgtgtctgcaggggagggtgttgcaatgccaggaagcgattcaggatcatcactactccatggccaccattaacactgtgcaacctaaacctgcaagcaccaggagaggctcagcctcagcctcctcctcctctgtgcctgagagccctgttgcggtgctggatgctggctgcctcagctacaaaagtgatgatactgatgcagcaactattgcctcacatggaggaggaagaaggaagagttgctttgatagctccccggtcactagcaagaagaggaggaagcttagcaggtgactgaccagtcaaagtgccaaatgatagatcactctctctgtagtctgtacaccactcatctcgacaaaggcaaagtcaattggtttcgattgcaacgactgttagaaagaaagaacactggaagggggccaaaagggagggaattttgacatgacgagagagagctagctagcaagaagttgctgatgaataaagaggtgaggttgacaacacctaattgctaagcttttgcaagccagcaagccatggtgatgagaggtgcccccaaagaacaaagaaaagctttgtagcaacataaaagcttgatgagtttcaaaaaaaaaagaagaaaaaaaacataaaagctacatgagatgatcaagacaaaggatggtgaggggctttaggcaacaagtccaagaactaggcatgcactgacctggctgtgtagtattcttttgttcactagctctagttgcattagttgcagtattgttttcttttttccatttcatttgtaaggagaaaattagaggcggcagcactcctttttgtgatcagcaatgatgatcatccacatgaataaaataacatggtgtaaccagaaaagaaaattaacaagacccagaaaaagaggaaatgggtttctttcagtatattgctctgcctgcctatctctatattgtttgactgcttgtctgctttaagagcaggtataatagtaggctataagccagctgtaaatatattttaaggagataaataaggagagagaaggatagcgggctataaatttgtagccagctgtagcacgaactgtaagacgtagtatgtgtatgacaggcggggccaggtatcaatagtgtagtatgtaactattgtacgaatgaactattagattggctatagatgaattggagctagtagtaggctatactattaaactattaaacttgctctaagaccatgagcaccgcattccctaggaaataaaagaaggggaccttgtgacctgtcagcacgaaccttgggaagacaaacttaacaataccatgcggtttcagcgttgagcatctgtctctttgttcgaattagtaggtgcttctgttagtattttactccttaatttaagggctaaatgctcaatcatctaaaaagaacagttacatagggctgtcaagagtatgaatggtcccatgccgagttgggttggatacttggatcctatcataaagaggtccaatttgttacgtaaaaaagaatccatcgagggagatgaaaataggacaatttagaatttttcttcaaaattgaaaataatatttcagtaattttgttctctagtcatcgagggtgattggcggcggcgctcgaggacttgcggtaactagcgtgcctcaccgtggtgaatgatgacgacaaatgaggaatgtgattgagcaaggaaaactcctagccttgtttcactgtatgctacgaattcatagatttaccaacacccggtagtatagaaacacagttttaatccttttaactataatatagttaagtgagaggacacattaatctaaacctttatatcacttatactataagtatactagtatattgtagcgtaaaagttcttaaatattactccctccaacctaaagtatggctgtctctaacattacactgtcattaatcttttataatatattattaacaaatacaaaattaatatcatataaaaatacttccaaatgtgaatataatgatacaatatacataacaatagaaatacatttattggggttgtttggctgcactgtaaaaatgttgcattgcagtcagctgccgcttgacatgactgtggcgcagccaaacaacccacttgttactgacttgctagttaaagactacaagtgttgttttttcttaaaattactgaaaccttatgatatgggatagagggaatatgagaatggaatataactcaatttataaagaaaattctagcactagcactttataagaagcaattcattccccacaaaaatgagaaagagcccttagtttttatttttggctgcaaattgcagtgatgaactctcaccggattggaaatttcactgctcattcaaactagaagaccaaagactttttggctttgtgcccaacagtggaggctgaagatgtaaagttgtaaaccatttccattatctaaaattaaaattcaaacttggagacttaagaaaattggaatgatattgtaagctagtcactttaaatatatccttacacattctcttataatctactacatgtgaaattccttacattttaaaacggtacatttgcattctcacaaagtgtatataatgccagatcgatattcatacaagtgcattatcaccaatgagtgacatactggcatcaggtattagtatctcgggaaaaaaaatgattgtctataattcagttgttggcacttgaaattaggaaaagtttaccatatgaaagtttgtgctagtgagtaggg

SEQ ID NO: 36457 - DNA, 5855 bp, Oryza sativa
  unsure (1)..(5855): unsure at all n locations
gatgttatgatgtgtattagggcattggaccacagggtttaggcgtctacggagattatcctaagcgagagtctccatcatatctagtactactcaacgctgtcacatacacatttataatccttgtctcctttcatggccgttctatatgtgatcttgatctctgcacattacctaacattacgctcaagtataaatctacttatctacatatacccgtcagtgtacacaacgtctcttggcacgcagaaaggttaagaacaagaattccatttgattaaatttgcgtatgccacaccgttaaattatcacccgagatgtgagctcttcgatgttttaagtaaagtttattaaactcatcacgtttcgaggaatcgaccagtggcacagcaagaggcagcaggcgcgtacgtacaaagggaaagcctggaagtaactggtaagctcgcagtcgcagtggctgtcactcacagcgcgcggcaaaagctggaacggtacgtgcaaaagaccagctgatcaccgatcgctgagattattaacttttaacaggcgtgtgcacccgctaaagacgccgtcttttttactagtttttcgccgacggcgccgtgcagcgctgcatcaaaccaaccgtaactaatctcctctccctgaggagcatagttaaccatatcttggtatatcgctggggcgatgatgaacgtgtagcgacgcgggcggcagagatcgatggaatcgcgggtgtggaggcgaggcgaagcagctcatcgcgtgtgcgttccaggcacggtgctgactatctagctacggagttggtggagctcacgatgcgaggcggtcgactgcgtcgtcagactggtgtcgtgttacatacttacatgtttgggcaaaatgtgcacgcaggatggtgaatcttgtgagttgggacctgttggaggaagcttggggatttcttttatggttagcctgcttggattgcatttttgtgggatgcaacttgcgaagatacatgaccgatataacgtaattttagcataaaagacttttatcctctccagacaaagaaacccctccatttataatattatctttatctatatactacttaaaacattgatagtgtttttgtctaccataaatccaacaatcatgaccctttatccaatagatctaatggccagattcctacccctcgccttctgcctccacccctgcttcccgaatcgaactcggagttgatgagcaggactgatcggctccttcccctcgcctttcacctccgccctcgctttcgagtcggagtcagagttgatgagtaggatagatccaacagccatatccctactcctcagttgcccctcaaccttccgtctccacccccgcatctcgagtcggagtcggagttgatgagcaggaaggaagccatgttgaacatggagaaaaagaaaaaggaagagattgatcggttgatttcttaggctgaggtgatttggacgcaacgagcaggggtgcgacacatggccgaggtgcagcaacgtatggcggcaagagagcttttggtcggcgttggctgctttgtgaggaggcggtggaggggaggtccaacggcggtttcctatcttatcgatgttgtatctttacaatgataagctacctaatatgattgccattattgttaaaaaaaacatgagataacatgtagtttaatatgtttgccttcacccgttacaacagactggcattcttgctagtaacggtataaaaaaaagtaagtggtggacagtgaatctgtcgtacgtcccaattaacctcttagcttttggaaggtagaaaaataataggtgtggagccaaatggctcgtctataggttggaatgtagaaattaatatgtgagaaaaaagtaatggcgaaaacatattgagaacaatgttttatcattaaagttagtttaaggatgacttataattttttttcatatttacactaaaattttgaataaaacatataatgaaatgtaatgtccaaagttgtaataaaaaaggtgataaagaagagggcctcggtgttgaaataaattagttttgccggtttgacgtattttggaaataatttttataatgggacctagcaaaaacattttgtgtaaatcgatccttaataatggagtattgtgatcacagttagataccaattaatttaacgtcttgtaaattgatacgtacgatagtgcttgggcagatggcagatcagtagtgggacatggagaaaggggccattgagacgccgccaccgcaactaaagccaaggtcaggatagagtggtgggttgaatctgtagcgagagcaaacgcacaacgatacattaggagacagagggtgcataaatagatcagcggcaacatccgtcgaagacaaggaagaaggtaacattggggcaccgaaggcaagttcgatggcaatggacatggtagagaggaggtcaacaagggcggggtagtccagtgggctttctcaacatcaaaggtgacaccagcgaggcagatggatatatataacgtgttaggaagggaaatgggaggcaacggtacaatactagctagatcaagagggcgaaacaatatgtgttgggttgacgatatagaggagactaatatagtagtaagtccagacctagtttggacggttggattaaattttatcaaaaaaaatctcatgttacatttaatcgagttacatatcccggtgattttttgacagtctttaaatagattgcgtattgtgttgtccacgtgtaacaaatgcttcgaagagtaagttttctagcaaatcagttgtaaaaaatacccgttgaaattgttgtgtagggaattattaacatacgttaattaccccataattggctgcacaagtgggtaaagctaagctgcagcagagctcatcgagcgttctgctctgcaaactcggtccggccaatcaaaggaacttgcccgagccatcatgacggcctgcaaaaaaggaagatacaaaaacacagagaattttcgcacgggggccggctctcgagggcatcgagaattgcggggcgtccctgacgaggcgaacgccggttgaagcgatcggttcctttcgccgggacaccgccatggccaaggccaacaaacacacacggccagggtcgtgccgtgcaatgatcatcccgatcgatcgatcgatttctacggctttgcgagctcgttggcgagatgattttaccggtggaccagatctcctagcccagccaaaaagattgggcatggaggtagtaagctataccagctagtgccggaaagattcgagcaacgcgtgcacgcgcgcccgtggagacttccgcctctctctctctctctctctctcgtgcgtggagagaccgagacggggagagtatgtgtgtgtggctatcgtggtgtcagggtgcgtgccacattggatgctcggttttgttcaaggggaccaaccgaaatatactgcatggggatgcatcattgcaccactcaccacacacagcaaggtgcacatagtggtggtgcgcttattagagtacccgcaatggtaaagtgctatctataaaacatatacatctcagcaatagattagattaatagtaaaccacttcaatggtatgtctatatgggtatctatagctctctaattcattgccttgtttttctctatagactatctccaggttagtagatagctttgctctctctcttcatttaatctcttccaagtaggaaaatatgctgacatggatctcttgtagagagcctatagataaccattacgggtgcccttactcttgtagtagcagtagctacctatcctatatactccattcttggaggcttggagcagctagagcactagcgagacagaacggtgtgttttcgctggaaagaaagagagagcaaaagccgtgccaaagctaaccgttcgtttatagtactacgagtctgtgacaacgtgagccccaacattcacaacagaacaaaatcacacgctatcagctgatctctttcacagcaacacaacaacaaaaccctgttggatcttacgggtgacaaggtttttacaacaagcatttgtcaccatgcctctgcatggggcccagggacgtgcagggcagctagcctgtgttgtgtgtgtgtgttcgcctgagaccaaacatccccagcctgcaaggctggcgcacggctgcaattggattgctcgcgttgcagagcggcacagcttcgcgttcctctgccaagcgaagcgcgcgtgcgcgcgcgcggagtgtacgcagcgagacgaagtccccaaatcacaagtcggctctgggccaaacacgtcttgggccaaaaaacagacatgcttgcccatagatacgccgtacgcgttcacgagatccacctaggcttatatgggccttaagcccacaagcccacatcgacttgaagtccagaaaaaccatggccatccagaggacagtgaggcctagtgggagagaaggcagagagctacagtaaggactgacgcagcaacaatttgtggcaactagctcggcaaagcgaggagtgaggaccatacatatatacgtacatgacacagcaacatacccctgggacacacgtacatccgctcctttatactaccagcgtgcacatgtataccgacgactatagctagccaactgtggccaccatatctccgaatcaaactgaacagggcgcgagcatcgtcctcctacgtcggatagcagtgtagcgccactgtgctcacgtatgcacgctgcacaagctttgattttgctcgtggattcgtgcccggtagtactagaagacagttgttacagtagctatatagctacatcccgatcgataagctgttttacagcgtactgtacttgcgcacgatgctgtgtgcagtgcaaataatactgttcctgctgctgctgtactgcagataccctaatttggcatcggtcagccatccagccaggctcagggggctcaggctatcctgcacgcataaatccggcgacatggcatgagatctctaggagggcaggcatcacccatcacccgacatggcatcgctgcgacgcgctgcacagtgtcgcggcgccggggcgtgagccgtgagcggcgtcttcgacgacgacgagctagcgcgcggccggcgatcagcgtgcatgttaggcttagctaaaggccgtcctcgttttgtccctttcacgcgtagtactacgtacgtttacacaaccccctgcgacgatacgtccaagacggctttaaagcgcgagagagctagctaggtcctctagtaagcgtgaggcctgcgaaactctcgtcagtttttacggatagatagatcgatggatggatggatcatggatagctcgatcttttgctgagctgctgctccaacgtttgactacgagctcggccatgccgctgtctccatcaggtgtggtggacctacctgcaggtgatacacagcatctgatcccatgcatgtccaccaagtaaaggaggcgcctgctcgctgcatatgatcaccggcttgccatgcactgttacccgtctctgtctgagagagagagagagagagagagtaggaggaaaaggttgtgcaatggggatcatatctttagcaacaaccggtccacagtacaagtgcgtgcatgcagacagccgaggcatttggaaccttactgccgctgcggtcagcgagacagcgagcgagctgcatgcccatggatgatggatcaagttgatgtcgtggtggtgtctagnnnnnnnnnnnnnnnnnnnnnnnnnnnnnnnnnnnnnnnnnnn

SEQ ID NO: 36458 - DNA, 3441 bp, Oryza sativa
atcatatctttagcaacaaccggtccacagtacaagtgcgtgcatgcagacagccgaggcatttggaaccttactgccgctgcggtcagcgagacagcgagcgagctgcatgcccatggatgatggatcaagttgatgtcgtggtggtgtctctttagctagggctttagcttggctagctagctagctactactacaccttttgggggtcgactcttcttcctcctacactttgctcgctttccatcaagtcgtcgaaccggaccgaacatgtgcaacccctactcccatgtcgactactgctctcttccgtttcaaaatatagtaatcttagtatgtgattacacatgtgctaattctacaaacttgatcaatttcatagtaacgaaaactatgttttatttcatactatatatgttgctgtatttttttttttaaaggatggaaggaatacatgctttgcggtgttgcggtaggcgatcgatcggcgctgctgctgcggctttgctggctccggagtccggacggaccgccggttcggcccaaaaaccacaagttgggtccatgctcttttgccgctggtgaaagggctggctctgcattttgtcgcatcctagtgaagtaaaggctctccctcgatcgcctctcccgagaactacgacaacaaggctgtgcttatcctgctctccagctttgtatgtgtagttgtgtactatagcaatgaagggaaaaaaaaactgcacctcattactgtgttctgctgttaacccaaagtacaggaatggaaatttggattatcgttccagattaattgggcaacttggttttgagcaccattgcaagtttgcaaccagcaatcagtgcaacaatctctagtgatcacgggagccttagcagcttcagatagtaatctccctaaaaaaaaaatccaaattctaaccaaaattttatgggtttgttcattttgaaccttttctaaccaaaatttgataagataacaatctaaacaaaatattaccaatccaactctaccaaaatttgataattccaaaactttctactctcaaaacttctaccaagagttgaaaaggcttccaaccaaaccttaccttatcatactaaaatttgacaatgataacatttggcattaccaatagttgataaggtctctttttttttggcaaagaagcgaattatccccaagacacgcagctacaatatcaagaagataaattagtagcaaaaaatgggatgactctatagctagatatgcatatgggaatatgtgcccgaaaatgaccgtggggcaataactgggaatgaccgtatcttaacgcctcctcacactctttaaagccagcgaatctcgtctcggtcaggtacggtaccaattgaacaagttgatgatcgcttgcttccactgaatgtacagtactaagttgcagcattgaggatcacatgtattgcagcattgaggatcacatgatgtatacggcatctgtacgccgtgttgatgaatgggctcatggttaaatggcctcgacggacgtgaccggaccggccggccggatgcccggaagcattcagcgtcaacatgccgacgttagccttacagggttacagcacacgacggtgcaaggacatgcctggcaatctagcatttcacattttcactagagtgttggcacggtcacctagcttgcgacctgcttgccagtacatgagtaattgctaactacaccgagtacaagattactactgctccagctcgtgatcattcctggtacaattcgaaaaattcccccaaagggtcacagctgtattacatttgaaaattttgtcaagggttaagtccaactttaactcatggaatttgcccaaagtccatttctatctcacccaaaaccaaactacaaaaccgtttgtttttcacccacaaacccaaaaaagtcaggtaaatggtttttcactaatatgaacatacgaatgcttgcgtaataaaagtacgaactagctagaaaaacaacttacatttaaaacaaaacaaataaaaagtactagtaagttccaggatgtacttcggtttgcaacattagtcatcttttgaagagttcataatgaaaataatcaggttgtagttaagataaaagatgaacttcgaataaacttcaaggtccataaatggattctacccattttgtaagtggatgcatcatcattttagaaaatatcatgaaatgaacaaaatgaagattgttgtacaaccaggaagtttttctccggtccctcaatattttcaagaatcaaggaaaaaacatattgaccttttgtttttccttcaattgaactggagtacaaaacaaaatgggagcggaaaatatgcccctctcctaattaacgaacaccaaaaatctgtccgacttctagaccacatacataattgcatgtgtaattcctgcatgtataatatttttcccatcctgattagtgctacgagctatatatacatcttgattcctccccaaaggccataaagaactcagaacgtatatatgttcacgagactcaaatatttagatcattcgggagattaacacccaccgccaacgcacataatcccccaagcaatataccctccaactcaaaaagaattatccatgtgcatagccaaaaaccaaagtttcttttttagacgaaggtagtgcataatagggaaactatcatgaactctcgaggggatgccccctcaaatagttatgaaaaaaaattaagatgtattagcatgtgatatatcactccataaacatacaacttagattttaactttatatttcgcaacaaaaaaacaaattaaactacagctagttaacgtatattgacagtcaaatttgtttttttcgttgcgacatgtaaaaaataaattttaagttgcatgtttgcaaagtgatatatatatatatatatatatatatatatatatatatatatatatatatatatatatatatatatatatatatatcacatgttaatatatttctcaattttttcaaaatttttcataataatttaagtaacatgcaagcaacgaaaagacatcccctcgagagtttaaaatcaactcctgtgcacgtaacaatccaatgggacagaacaatgccaactgggcatgtcttgctccgccgatatcctcttgaccctaatctgttcaaatttccctaccatgaaactgaaatatagcctaaatttttagtacaggtcaactgtagacacaacttccctttcgccatatagctaaggattacatatgcatgcacacagttcaggcgtcgaacccagtggcgcaaccagtggacatgtgagagcggccgcgctcagacagcaaacttccaactccaaccgccatccgaaacccaaccagatttcttcccaattaaatcc

SEQ ID NO: 36459 - DNA, 1760 bp, Oryza sativa
gggaaaaggggaggctcttcgcttttctctcccccccttctgcgctgcgctgccactgcacgcagtgcaccagcctagctagctcaaggccgcagcagctaatcctatccacgctctcgatcacgcgccacgccagcctttcgcacggcgcgcgccgccgctgtcgacgacgacggcgaaggcaatgcgcgcgggccggtgaaaagcaagaaagtggccggacggacggccaaaagagagatcaccggagttgttttttttttctccctctccccgtctttctctcccccggcctttccttcaaaagataaaggagaggcagcttgcaaggctggctcccggcccccggccccggcacggccgtctccttcctttccggccgtggagcctaccattttaccttgcgagccgcgccattggcggatgccatgatgctctcaattcctatccctctcgccaagcataccgcatggtgatcatggccaggacataaatgtgcatgctagcctgcgagctagtagacgggaggagctcgtcgtgatcatcaatggcgtatcacgaattcgatcgcaatgaatgcaacggcctcgtttaataaaagcagaaaggtggatcgatgttgccacgaagtaaatggcatgagcagaaatgcacattgctgcaagcaagcaaagagagtagcaagacaacaagcagtagtgtagagtaaagagaggacgaggcttcattgaattcacataggctaaattctaaaaagtccccggccattgctatagcttctgcaagctctgcgtcctaacacatgggcagcaatgcggcatcactgctcgcgagatgtggaagacgagtaaatgcagcggatacagtgagatcgagaactcggaagaaaaatgcagcgaacatggtagctagagaaattggaatttcagagtagacaggtgaagcggacggatcatggacaagttggtgcccaggtctggaaattggaagcgagggagatcgatgtgaatgcaacagtgttgcagctcatatagttgcagccgacctttctgaatctttatctgccctagttgttagctagacgaactacaagtgctactgatgatgaagtgccaagcacaagaaatataggggaaaagaaatgatgaaacaaacaaaccgtgcagcaacccaaatccccaggaaggaaatttcaattgcaacacaaaagtactacattcccaagatctaaatcgatcggcaaatcgccatccatgtcctcttccttcccaacaccaaacgtcgtcgtcatcatctactaggaaacaacaacgacggcaaccacaagcccaaagaacccaaccacaatggaataaaataacgaaaaagaaacaaggaaggatgcaaaagcagcagcagcagcaaccaccacctcccctaaaaccaacaagaacagcttgctcgctacgaacctagctaagcttctactcaggtgaggtaaaagaaggcaaagaaaaaggctaattagccgcgggtaaggaggtagtagaagtagatggagatggtgatgcatgcagttgcagttgcagtgcaggtacctagcaccgggaggagatgagctgagctgagcttgcttggcttagtttagctatggcgcctttatgcccagggtgtgcttgttgttgtgcatccaaaccttgaggacatggcgctttgacgcagaccttctcgcaaaactgctgacggcggcctcgtcggcttttggatgcgcacccgagccg

SEQ ID NO: 36460 - DNA, 5320 bp, Oryza sativa
cactcccgatacctcgcccctcctcctccaccaacaccaccaccaccaccgccgccgccgactccacctcccggcttgggcaccccgccaccgccacctccaagcccgggctgcatcggcgcgtcgtagcccgagctcagaggcatcggaggcatctcctcgtcgccgtcaccctcgtcatggtcgtcgaaatccatggccgccgaccgaccgaccggccggccaccccctttcttttccctcccttttggatttctcgggtgtgttcttggcgagcttaagaaaagcttagggagtaatagaggaaggagacgaggctatgagcaagtataggggagtgtgaaactgtggacacacacctgctaattttgacgcgccgctgcaagcagcagctgctgctgttgctgctgtacccttcagctagtaggagtagctagctagatgatgcaataaactctctctcactcactagtgagagtgttactagtagtacttgtctggggcgcacctgtcgcgccggggcaatgacggggcggtgtgtgagtgaagtgtatctctgttgtctcgcgatgtacagtagtatgtagtaagtacacgtctccgctcggcggcatccgtgtgatgttgtatgctactggaagtgggtttggctccaactcgttttaaaaatgggggtttagggctgtactaggagtgtttttcggttgattgtgacaggtgcttcgtgtttgaaactcgttatccccatcataacaaagtagattttgtgttggactaacgcatgatttggagtttgaaggtacggtagtagtaccgtgtttttagccccatgttggaaacgggcgtgatgtgtcctactgggatttttcgtaagagttcaatagtagtagtaacaattaataaccagtccattgtttcacaagatttccggatttcagacttcagagaagtcctccaattttgtttgcttctgcaatctttatatggctttctaaggagcaaccacacgctccgtccatcccaaaatatagtaatttgggagtggatagttcaatgaatctagacaagaggttgtgcagatttattggactaggatatgtcacatccagtcctaggttgttatattttgggacggaggtagtacgtattttgctagtacgttgtaatgacttatatacaactagtatggtggtccgcacaaattgcgcggctaacatcattatattttctcttatataacagcatatgtgttttctcattatattattcaaatatattaaaatgacaacataattttaaattttgcaataactttacaaaactactaatgtgtaatattcatatatattttatatacgtgttagttattaattatttttaatatcaaattttagttatttgtaaattatatatattcctatatggactctagactcgtcttttcatatttctttttttaatttcgaattttctgtaaattgtatttctatatacactctatgttcttcttccaatattatttatttttatttctgaatttttattatttctaattgtatttctatgtggactctaaactcatttttcaatattctttaatttttaatttcgaatttctgttacttctaaattgtattcctatatttgtattcctatattaaccttaaactcttcttcccatgtttttcttaattttgaatttttttattgtaaattgtatttttatacggactctaaactctacttttaattttattatatttattctaaattttagttagttttaaattcctatatggactctatactctatttctaatattccttattttttaattccgaatttctatttttttcttaattgtatttctatatggattctatactctacttctaatattctttatttttaattctgaatttctattattttctaattgtatttctatatggactctatactctacttctaatattccttatttttaattccaaatttaagttatttactaattatatttctatatagactctatactctacttctaatattccttatttttaattccgaatttaagttatttcctaattgtatttctatatggactctatactctacttctaatattcgttattttaatcctgaatttcagttatttcttaattgtatttctatatggactctagtctcctcttctaatattccttattttttaattccgaatttcagttatttcctaattgtatttctatatggactctagtctcctcgatcttctaatattccttattttttaattctgaatttcagctatttctaaattgtatttctatatggactctagtctcctcttctaatattccttatttttttaattccgaatttcagctatttctaaattgtatttttatatggactctgtcttctctttttctccgattaatgtgagaatttctaggccatgagagcgaacgtggaggcttatttttctattcctttaataatataatggatggatggatctttaagaagatatcaatatgtaccaagtacgagtagataatccttatatccatcgatggagcaaaggaaaaggaaaaaaattctaaagatgaatttgacaattttagttagaaattatatattttcaaaatttctagacagtatctcaaggttttacatggagatttttatgagaatgtcactcatttgaatatgtacgaggctaaaagatacagacccaattcaaatcaagttcgagtccacctcgtcatccatgagcagccgcaacaaaatcgccgcctggacctcattcggactcccttttttatgttctagatatgtacagaaagctaacgagaccacctttccaatggatttggtatcacgtcaaacatacttctaagtcaacggaaactatcgaaacaagagagcgtccaaaaactgtcgggatgttgtatcattgtctttaaacctattgagccgtgtatcatgttagagtccactagggatgtgtttaggggtcttaggtcggccctagaaccaatttaatcagtaaccatcatcgaattagagttgtgttttacttagattattctgtcactacagttttgttgctagtttggtttgtggaacccagagatatcttatcaacacagtatatttagattgaatcttccactcccttactagtgttagcgattcgtttgcaggagacgactttttcgatgaggccaacagaggggcagtgtagtgattgcgaggagttcggtcattctagtaatcagagcctctggatcatcaactttgagtctccatgatcaacctatctagtatctaatggaagattgggaccctagtcctcatcagtttttagccaaccctaaggctcaagcattgtctcaagcctggctctgcccctgattatatccaaacattttgttataaaaacaggtatgatcggcacccatggtttgaatctccaacaccattaatatgtgcattgatcatggctgcttttgaggtaaaccaccatgccaatttattgttgttggattctggatcatttggaactagtattttttagggcaatacgaaaataccatacctgcatatagcttttgataagggaaaaagttttgtcgcatatatattattagaggaggcctacaacaaagataaatgtatgtataggacaggcaaaaaccatgcctacaaaaggaggtaactaagtgagctctcccaaacagaggttttcggagtttgtacgcctccgctttatcgaagtcactggctctttttctttgatctttgctattatggtaggtagggatgctaccacgttgcagaaggctcacacattgcacttgcatcagacttcccataccacatgtagtaactccttgatgaagctctctctcatagcctgatcttctggtgaggggataactctcacttcaatcaaatgcgacgtagctatcaaccagagcaagttcaggatgtcatgcaatcgctacaccataaaacgatgtcgtaccaattgtgacacgcagttgatgatccctgcaatgcaaaggagagaacactgcaagaacatgataaatgcaattagatattgcgaataggtaattaagcacaaagaaatagctgcgattgaagtggtagatccaatcgacccggcaaatcaacacaccaattatttggagctttgagtctatagtcgttgactaatcaagtgaggactagagacaagacgaatgtcacctggcaaaattcaactaaataaaatccaattgttctagagggtgtatatagacatttataaaggaaaataaagctaggattaagtgctagttcatggaggtggagagaagcacttctaaaatgggcctaacctattgcaaggcccaaggcccaagttcggtttcaacaacaccactttattgttttgatgattcccattgacttcaaatgaatttggatatgaaaccatatgcgtttgacaggtgacaagataagttttccaacaagtctaagattatctaaatcggagttaacatgaatgtgctaggttcgtttaaagttagtgttgtctctggaggccgaactggacttggacttggaattgtcattggaacgtgtgaagttatgtgcgtatcctatgaagtgatgttctcgagagtttaaaacactttcccatcaagtatcattttaaatatatgaagacatatatatagttgccaattgtttcgacactagcaatcataataagaacataattattgtttaggttaaactaaatactttttttaacagccaacactagacggtgcaatgattcattaagtagaacagaaaaaattacaaagctagcaccctagaaggtagtagctaggaaaggaaagaaaaacaccaccaccacgcaccacgcaccgaaaacacatacacagaactcagcagaaagctagcaccgaacctgttgcacctatgccaacagagaagctacaaccgggccacccaaagctaaatcctaacagcgagcaccgtactcagctctatccatgcccttagggttcaaggagagaggatgagagagaagatggaaccgctctcctctacagggcccgtcaacatggccaacttgcattgactagggcgcctccgaaagaggacatcaatcaagaaagagcacgcacaacctgtcggagagaggttttggtagtgtctcctgggagaaaaggcgacgatgaacacccatatcgttgttcttgaggcctcgaggagaatcaagacaaggttttcaccaggctgcctacctga

SEQ ID NO: 36461 - DNA, 13807 bp, Oryza sativa
  unsure (1)..(13807): unsure at all n locations
ggcatgtggtcaccgatgtacctgcacaaccccacaagtcagcctccccggcccccctgtcgtcggtgatgtcagcctcccgctccatcgagcgggccggcctccttgccatcgcccgaactaaccctcctggtgccacacacgccgcgccagccttcctgcgccgccaaagaaaactctagcctcccacatcaaagatacctgcaccgaggaggtgagttggatctggctctagatccggcggcgcccaatgcggatcctttggtgcccatcgtggccacggcctccgacctgtcgtctcgtgcttcacgctcggtctatatccctccgcttgtcgcctccgcctctgtttggttctggatctggtggcgcctggcgtggattcggcaacgctcaccgcagccatgacctccccaccaccaccgtctttggtctaccccaccacttgtcgtctcctccgcccccgcctccacctccgcctatcaccgccgtccatgcgtaggatccgtctggcgccgcctccgtctgcgcgccaaccccgacaccggcaccactccgatcgtcccccaccttcggatccgaccgcgttgtatctagggtggtcgccatctcgagccccgccgctgctatcctagcaagccgccggcaaagccggtgactctcttaggaggcggcaaggcagaggaggaggggaaggcgggtggcagcggcggctagcgtttctgccgcccgagtcgcccgagccggaggtgacacatgtatcacttatgttttatgacatccctttatttatcttaaaatacttcatatggagtcatttgttaaaataggagtttattaaggttctaaagaatactccatttgaatcccttatgcttacactaaatgattttttaggggcacaaaaattaatttacaaaagtttggatttctcatcaactgggcaacagcaccatccaacaaaatgcgaagctagagaagcaatgcgttgtcattcaactgctaatgcattgcagtattgcaccatcaatggccgcggttgaacatcgacccaggacggctgatgtgctgtgttttgggccgggattacaatctcttttgtacaccctgaggttaactacatatacttagattccgtgaacatttgagtgtttttaattatgtacttgtaaactcactcgatcaccttctgtttttcttgctcaaacaccgtgccgtcctatatatatctgcctggcataaacgggacagcctcgtagctaattaagaattgccatccaaacatccaaaaccctcgatcaatctcgtaactaatccagctagccaacgtatactcgtacgagagagatactgtaaatctgaataatgatcctaactatacagatcttaattgttgttcagatcgataagcggtacaattacgtactctacttagagcaagtttaatagtatagccaactactagctccaattcatctatagtcaatctaatagctcattcatacaatagttacatactacactattaatacttggttccacctgtcatacacacactgcgtctcgtagtccgtgctacagctggctacaaatatttagcccgctgccattctctctcctcatttatcttcttaaaatatgtttacagctggcttatagcctgctattgtacgtgctcttaggtacacgtacatcaccgtttgctacgtacttacaaaaggaatctaggctgaacactttaattatcagtacatattttgatgatctgagatcgatcagagctgtacgtgttatggcgaattggcgatcactgttcatttgtaatggcctcacatgaaaatggcaaggtcacccggtacagtttgactaactagacgaggtacatacatacaggatgcatggcagtatagtaccgtatagtactacgtacgaattgaaagtctggtacatatatattgcgtacttcacgtaccgaagctgcaaatcttaattgagtgaagtgtgtacagtagggatcggatcgaccactagctagctagcagctcccacacgtactagctagtacgttttctttttattcgcatgatgaattaaaccgtgttaaaaatgtgatgtcgtagtaataacggatcgccaaattcttatatgtgtgaattgttttagccttttaggaatagattgatgagcacccaacctagacaaaacgtcgccggccggtcaaacagtttcatttggctgtcaggcaaactcggagttatatgttactcactttatcctaaaataattttatttttcacctaccttacatatatcaatacgtacaaaagcaaaatgactataataccatcactttatcaaattccaatgtaattatttctcattttatctactcttagtgcaattattttctactttcataaacttcgtcatgcgaaacaaaagatctattcactccatttcatattattataatttactttgactttttgctaaatcaaacttctataagtttgatcaagttcataaaaatgtaacaactcttataacaccaaattagtttcattaaatctaatattgaacatattttaatattatgttcgtttggtgttaaaactattgctatgtttttctataaatttgatcaaatataaaaatattaactaaaaaaagtcataagtctaataatataaattaaacgggggaatagtcattactacaacatttgagaaaaaaaaaagacgagaactagtgtccgatggaactatattaattagaaacacacgtataaataatctaggtaattagactgcaacatccataataatttgaaaagatgaaacattgttaaatccaaaataaaacaaacattaaattgccaacatctgtaagatgaaaataattaataaaatcacaaattaaagatgtcagacatattaaacgttgcattcccatccctgaaacttcatattccaactgctggaacatcaaataaattgtaaaagcattctaaatatgtccctttctcttgacgcctcataaatcggaatgtggaggacatcccattagttggctgcaacgtctcgttggctctagtgtagttgttatcggcttcgtccttcttgtacgtcatctccacttatggacatgagaaagcaatcctgatgatcagcttgcctatccgaatgtgtcgttttgcctttgaggttgaattgtcccaaaattgctaccaccgcaaaggtcaccacctccacgatgcttcacatgggcaacccctcacttatcctcatgcgcaccttcccatgaccgatcgatatccccaaatttgacgtctcaaagcttagcgtggccagatctaatagggagacgatgataatgaggtgtccaaaataggtgcacggaggggagggagggcgttggggtggggatgcacctagggaactccctggtggtggcaatggacacagtcagcgttgttggatgctagcaagcttactcgcaaccgggaggagcagtagagtatgagagtgagtggacgaattagaggagcgtcttattttctccttgggagttagccgcacaagcgaaagcatatcaatgtttttgaccctttcatttcatttctaaaatgtaggttgtttcatatttacgtacgatcataaagtatttgaggtggaggatgcaactaagctatttgagtgatctagccattaaatccaagaactgaaaccaatcaaatatattgccctactactctccttttcaccttcctgtatccctgctgccggccggcttgcacccgcagtcaggactagtcacatcctgcacatagatttatccacatggatttcttctatgtgattcttacctcactttgaattgttgtgtaggttgttgctgtgtattatctacttaactataaggataaattacatattttaatagaacttaacaaataacttaaaacacgtagtctaagaaatataagtagaagaaagttttccaagaaaatgtatttctttacacgtggaacaaataatttgtttcagcgatctggtaaataatctgcaacaaaaaatattatgaaaaaattgtccactcaaaaagtatttgccttatttatgcaattaatgaactatgatagaaattcttcataagttctaaacttaatttccaaaatactcataaaaagtaaatggtagatgtctttccacaacacttaaaataaacaaaagaccattagcacttaattagtacacacggaatttaaatgcttacatctgacaacaataaatataaatatacttgtatgcttggcttgtatagaatcatgtgatctcaaatgactagcaaatcatgtgacatgatcataaaacatgcatggtcagaaagagatctgatatacctaagaagttcatcagccacagaaataaaagatgagcaccacatagtgggatgggcttgggagagggcccataagccaccatggttaagtacttttgtaggatctaaaatagatttgggagtactatctttcgtaaagagtgtattatatactaccgatcatattgacatatgtatatcgcttaatactacctttattttaaaatttaatatatttgcctatgtagtacttggataggttcgtgtctaacctctttgggtcatctagtaagttatcctatttagaatatgtcaacgctaacacgatcacttcatggcaccacctatcacgacaatgtagaatttgatttgaagacaatcttttcattttccattttgcaaaaataaagcttttttttccaaaagtgtacacgtgacgtcctcgtaatgggtaactccaatatgtctcccttccttccatttggcgacattgggtacgtcatgtcgcggttttagtgagtgataacaactttgacaatgaagttggataagatggggttttttttactttgatgattcagtatattttttgtaaaaaatttcaccattggattatttattttataaaaaaatgaaggaaaatactttttttttaaaaaaagggaaaatcctgtgattactcgctattaccacaagaacacaaatcccatagtacattggtgttagccgaatacgaaacagatatcctaaattcttactgctccctccgtttctaaatatttgacgccgttgacttttttaaacatatttgaccgttcgccttattcaaaattttttatgaaatatgtaaaacaatatgtgtacataaaaatatatttaacaataaatcaaataataaaaaaattaataattatttaaattttttaaataagataaatgattaaatatgttaaaaaaatcaacgatgtcaaatacttagggaatgaacgagtactcattttctcctgtcgatagaactagtgaccactccacaagtgacggtggcccaccggccggacattcaccggcgcgtgtttgggtccaggaaagggagaaaagctctcgcgcctctcatttttggcgcgggagctgctgctgaatccgaatccgatcgaattgtgtgcgagtcgcatgggaccccatagccaaactgtacaaactatcgggtaatgtctgatttgtcttatcattgttactactacaatatagctagcacacagtgtgtgagagctatagagtggaaacagttacgagctagcaggccctcacttttactatgtgcgttgaagctaaacaggtattttatctgatctgccttggaaaaaaaagggattgtgtctgcctgtctggtctctgttcatacttgcaaaattgcaagctggtcaatatctcacattctatccatgcaataatctgtgtagaagtaggaattgccatcatctggtccataaattcatcccacacgaataagttattatattcttttgcctaaaaaaagtgaagttcaaaggataatctaattattttttttagataatagaatgaaagaatcccggcctttgctcaaaagagctgcagccaattattagagtctagcactctcgaagagtgacattcaaaataatctaattaataaaagagtgaagacatagacattcaaggtttaaaagatatggattccaagtttcagcgtggatggtgagtattcgctagggtttacaaaacatgtacggagtataaaacactttattttcaagctactcgagatcatagaccactcattagttaacttacgaagttcaacaaaattcaagctgattttaagtttatgcaagatttggacaaatttcactgttggtcaatgatttcatgaaaaccgaaaaaccacttgggagcgttttccaaggtagatcaattttgtgaacccagggatccaatttctcccaccaacaagtgagtacacatcgcaagttatatcaagggcaatgtatcttgcttaaacattcttactacctccgtcttaaaaaaacaattttcaagggttaatttggataacaatcagttcagtttcattctgacaaaagttaccttatctctaagtcaaagggtgcaggataaaatgaattactactaattcaagtagtacaatttatgtagtaaaattctcgtgtttctttttttaggggtaaattctcgtgtttcaaagaagccataaaagacatgaacaagattgggttacagtagtgtagtatagtagctaggatgcgtggcgcattttcattttgcagtacgcaatagttggctaccccctcaaggctcaagctatagtagtatcggcaacaagtcaacgaccaccatcaaaactcaaaaggacagtactgtgtcgtctgtgagcatatcatactgtatcctccacctacagtatgtctcaaaaaaaaaaaacgatcgatgacgatgtgacgatcctttctctccatggttcggtgcgtgcatggccagatcgatcagatggaccacacgatctccatccaccactacacacccgcgcgcgcacacgccacgccacaccacccagatcaccagcaggcggcgcacgcgcgcgacgcaagcagacacatggtgacctcggatgcgcgcatgcatgacgcgcgccgccgcctgatcggctgggcatatgtacgtacggcgccaccgcgccgtgtgctagctccggcaaaagatccggccgcgcctctgctgctgctgctgaggcgcatgataccgcatgcatgcgcggccacacggctcttcgcgtttccgccgctttgtagcctttggcgggggatgcgcgcggcgtgtgcgtccaaagaaaggggatgaaaaaaaaaaaaggcgcatggatgcaatggatgcatgcagcatgcaccaacgccaccaccgccagcagctgccagcagcagcggtagcaggttggagtaggatagcagcagcagctagctacagcctacaggagggacgcgtccaagcagctgaaaagatggatcagaggttagctgcatgttgggacttggtgccagccgaggttataggcgacaaatgcccaacagttctccagctctactcctccagagtccacaccatgacgacgttcctatagctctagtcttgatgcggtagtaccgagtacactcttcttccactactcacgatctactcctccgttgtttgagcaagtttaatagtatagccgaattctagctccaaattatctataactaatataatagtccattcatataatagttaactataaaagtatactacaccattaatacctggttccacctctcatacacacataatgtcttgaagcccatattgcagctggctacaaatctatagcccgcttgttgatgaaaaaatcgaacacactgacctgggagatctgcttagctcctgtgcaggtccaaatattgatgagatgcgggcgtgccagtcagtttgatcctacaannnnnnnnnnnnnnnnnnnnnnnnnnnnnnnnnnnnnnagtatatctaaacagccgatcggctgacaagccgatggagtagttccagccgatagccgataatagccgataccgataccagccgatagtgatagggtttaagcaatcggttatatgtccaatgtggataatgatataaagtcaatcggctgatgatgatgtacactacaccatgcccctagtttgcttactacatatctgtcaggacaggacctatatgctgtcaaattatttgtcagcaaaacttttcccgacagatagggtctgtcaggccaagtgctgccggcaaaagtctttcccgacagataaatatgtgctgacagatagactgatagtgttgctacatatttaccgacagatagttttaccaacagatgggcatttaccgacacttaagaagattcccaacagatagcatatcattgtgttatagatttgccgacaattaatgtatagatggctagcacaataacttacaagcaatcagtcggtaatccacacaaaaaaatatactaattacctattagcatccattttatgaaccatacctcaaattaaatttgcaacatacatggatgaataccactccaaattttgcaacacagattatcatttttagtaagttacacacatgcataacacaatattaaactattcataactattgttcatccatcaagtagccttcaagtaccagtatcacaatagcagtattctgatacaaatagcagttgtccatcagctcaaatagctattacataaatgtccaacttagatataatggagttcttcaagtacatagcaataattacataacttagatgcaactaaggttcttgtaggtgtatcgaggttccaaaaacaatacaaatcatctcttttatggttcttgtaggttcttggttttcttttacagcacctctgctagccctttttatggttgcctgcaaaataaggaaagctatgcttcagtccacaatatcacattctctttgctgaaataaaaaatgtaaacagtatagaagatactgccaccatatgtgaaagcccaatttttttcatctaacagttccatggactatttttttcatagaagcagcacatgatagcccaacaaaacaccatgtgaaacatgatagccaagattcagtgtcagcctcacttgtggtaaccacaacgaaacaacatatatatgtttgcagctgaaatagggaaaggtgaattggaaaaaaaacaggtggtcgacttcagaataagggaatactatattgatagacttcagaactactatcatcaatatatgtaagctaacatccaatgctataatcaatgaactgtacagattcagatgccccaataatgacaaaacattactgtattcagattcagatgccccaataatgctaacatccaatgctatgcaaaaatgtagacacacctacaaacaggacagtcagtgacgggagtaccaaggtccaatagaccacaataccttgcagatacaatgttaagtataaccctcatggagaggactcaaatgaactaattattgcagatacaatggcatttcacttgtcaccaagaagtgttcagttaagtgatcatgtctatgaatgttttcatggttccacactcaaattgccatgcaatttataaaacactcatgaaaaaaaagtttgtagtactgattcagcattttgtatattggtcctatcactcacaaggtaaactgttgagtgatcactagttgtttccatgatgagttcacacattttctacatgggtataatattttatctcctattgcagacttgctaaatgcaaaatcaaggaaattgtccactccttgtatatagatttgtgtgtgcctaggctcatccatccacgccttatccatgatgattagctaacgtccaacttgagtccacagtaatcttttgatatattagttgatatattagttgacagaatcagcaaacagtagcataaacgtagttgagcaactgtgattttttttctagcctatatacaagtccagtttctaaatacacaaattaagacatgatattggtccctttctcttgagtaatcttgcagtgtattttttccagaagcaactgagctagagacaatatacactacattgcagcttaccaagtataaatagtatgatttttatgtactcagattatagaataatgggagaatatataggtactaatctgataaaaatcttgttgatctaaattttttaaaggttaaacatactaattttggatttatttcagaatactcacagtgtggcagtgaaaaaaacaaagtgcataactctgaagtgtgaaacaacttggtatgttgcattattttaattttattatgtaacttagtttgtcatatttccaggctatgtctgcggagatgttttccagtacactgagtagattagccaaagaagctaatatccaaaaaaaaaacatctagctagctacaccacatcaatccaaggggaaaaaatgcatgggattaacttattgccatcgcagctaataggagagggaggaaatgctgtacatgttgcaatcacatcgaattcagaaacacagctaatcagatcgagagttaattgaggtacctgctcactggacagcaaggccttcttcttcccaaatcgaaacacaccttctctggctcagggaaccaccgcgctgcatggcacacatagaaaatcatcatgatgatcttgcgggaaaatatgatttcgtttctaccacgtaccttgcagcttcgaactttgaactcgccgccgccgccgacttggatgaaggtgtggagaaggtgggaggatttcgccgaggcacagggggaagcggggcgcggtggatggggagcgaggtggcggcgcgcggcggatttggccaaggaggaggtggcggcgcccagtggatggggaggagcgtggaagggggagaggtggcggcgcgcggtggaagcggggggaggaggcggcgcgcggtggaagggggagaggtggcggcgcgcggtggaagcggggagaggaggcggcgacctagctagggttttttttggcgtgttttttttttggcgcacagaatatcggcggttttttttatttcctgcctgagctttcaccgcgctctatcctagccgttgaatcaagatctgacggacgaagtattgctgacagatggattatcattaagttttcctgacatataattggtttctagtcttaaaattgctgacagttattttgaccccaaaaaaatttagaattgctgacatataatatgtcttattacatagtattcccaacatataatttgccaaaagcctttgccaacaaatagcctatcaataattgtttatctttaccgacagatgtctgttggtaatctagtgtcatggtgtagtggtaataaaataacaatataatccagtataaaccaatcggcaaataatgatatgataaataagcatcgatccgaaggttaaagcacacatcggctggaggtccgatgtcatgaaatccacaggatcagattaaacaatgaaacctttgttgtcatcggctaaatccaacttatatgtatatgcaatccttatgagctgatgcaacgtccagataactcatcggctgaaaccccgatgaaacccttattggcagtcaaaaagcaggctagagattatggctctaagcacgacttaatagatcaaacttaactgatgcagcactaagtatgaaaagaaccataatatctagacaatcaagccgatgactgattttcagggtggtagatgtctaagctaatctaatctagcaacacgatttagcccataccggcagaaaccctaaaacgagaagcagtcgatagagctaaattgatatgctaagactagattaacagagacatatgataaatatgtaagcaaatatagcatccaaaccagagcaatccaagaggtcgaatgtactgatgcagccttgaacgacgccgacgtagacgatataactgcctagaccgacggaacattggacttaccacttcgccggagatcgaacaccgatgcagccctccgtcgggcaccaagtcccgccggatgataaaatgaagtagaaaaggtaaaaagggtggtgatgcgccgaattgtattaattgtgaagattgattacatagaccccgggtgtacatatttatacccatgggttgatacaagtccttgtcggacaagaaagaaactttcctaaagataaaaggaaaagataaagtccttataggacactaaacacactttcctaaagataaaaggaaactaacaaactatttctaattaatagataacttgccatgccgcattctctttgaactcggtctcttctggataagctttctttagtagatcaatttccttaaccgaatatagcaagaatccgacaactgacgacttgacaactctcatcggctaatctcaggacttcgaagccgatgctgactctaagccgatgactactccgggcttaccaaatttcactgttaacaccgctttcttctcttttctctcttttcttctcgatatgtggttatagctggcttatagcctgctattgtacatgctcttatgggcctgtttgcttgaagggacgaatatccattagtccctctactttaggctgaagggacgaatccattagtccctctactttaggcatgtgtttagttccttccaaagttgaagcttgggttgaaattggtacgatgtgactgaaaagttgtgtgtatgacaggttgatgtgatggaaaaagttggaagtttggatctaaacacagccttagtcctaaacagggatgagtagaaataatttaaaagtgtattagtctattagtccctgtgaaagaagcttatatgaactaaattgtagtaccgtagtatttgagataagaagaaagttttggtttcgtattgatcaaatttttaattttatattccttggattcttcttctgagcatctaagcacatgatcgattggctgaaaaatgctttctttaattcctatgcattggaatcactatcacacaaagtcttatattttgtgtaaaatttaaatcttagatatgcttttctaaagaaagcatttaggaacggagggagcactaattcttaaaatgtaagtgaaaatcttgactattttaaaaaaagaaaggttactaacagaaaccacggcctttaaaactccccaataaaaccttgatctctactactctcgaccccactttatacggagtagctacttttagggtttatattttgtcccgtaatattgcaacttcttcatttttttatatcaaccaattataaaaaatttctcaaataatttttacattaactttcttatcttaatcaatcactgtcttatcttatttaatttcactccatttgttaatctcttatcttatcttaatcaatcaccgtcctatcttatttaatttcactccatttgttaatctcttaaggaagagtggtataatatgagacgtagagagtagtctgcagcatgatgatgcatatatagtactccctccgtcacataatataagggattttgatattttacttgtactgtttaaccattcgttttattaaaaaagttagaattgttatttattttatttatgacttactttattatctaaagtatttcaagcataactttttgttttttatatttgtacaaattttttaaataagacgagtgatcaaacaagtgaagcaaaatgtcaatatcaataagtagcaggtcaaaagtaaattaaggggaggaataaaatcgactgcatat

SEQ ID NO: 36462 - DNA, 1267 bp, Oryza sativa
  unsure (1)..(1267): unsure at all n locations
tatatgcatgctcggtccgtacgaattactagtaggaacattggcatggctaccgtggcaggagacacgcaggcagacagactacgtggcagaggcaggactgtctggcagccatggggccatagcgtccgaaacaagggaacgatcacatcgctggaaatggccagtcgcgcagaaggcagaggcatgagaacgagcgcctgatcccgtgcatgcatgtggtcacggcgtcgtcccggccggcgagccgcagatcgatcagcaggccggaccccctgtccgtgccccctgtccgtgctgccgtgcgctgacacggcgacaccgcgtcacggccacccacaccgcgcgagtaccacgtaccacgtacaaccttcccgcagttacaaccgttcgtcccccgatccgtctcaccgaccggacaaccgaggcgatcaccgtcgcacgcggcaatctgcgcaacggaggcgcagcgcgcggtgcgggaacgtatcaccgctagcacgagagctggaacgcgggggaacgagtaaatagcgagtaaatatccgcatgatccgtggccacggcgcgcacgggcacatagctaggcgatcgacccggacgctacaggattattctgggggcgcatatagctactgcacgggcaacatccggttaaatccgttggtgacgacgttaacggaactgtctggcggtacattacatattcgaaaggtacaaatcagtatgatgaggatttatgagaatccatatcattgttggatattttagctagattcatactccctccgtcccacaatatctcgattcctaggggagggctttgtcaaaaaaaaaaaacgattcctgcacagaaaaccgaataacctcaactctatcgtatcatgtgtggggataggtggatggcgagttggcgacttctccataaccttatctcctcctagccgcatatcgcatctctctcttcctctcgcgtttctctccctttcttccccgtcgcccctctggatcgattgcatcgacgcggcggcgtccagatgtacgaccctgcaagcttccgactccctccctacctccctcccgctcctccccgcccgtctcgcctcgctccacgctgctcccccaggctcccacttatatagggtttgttgtagtggggtgcgctgagattcgtgatccttgccgccaatgaagcaatgctgagatnnnnnnnnnnnnnnnnnnnnnnnnnnnnnnnnnnnnnnnnnnnnnnnnnnnnnnnnnnnnn

SEQ ID NO: 36463 - DNA, 7345 bp, Oryza sativa
  unsure (1)..(7345): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatatattgagcacttaatggttgcagcagaagtaataatccaacctgtactactattttatttgtaaccaatgattggatgtactttcactgagggtatttcagtcttttgccactttgttctaaaattgccttgggattctagggttggagatattgtgggacggagggagtatgatgttaggtaagaaagtattattttataaatggtgtgtttgaatttatctattcgataatgacataggctatgtctatggattacattaaatcaaatttaatatggaacatagagatgaatatggtcttgggggagtatgagatgccccaactgagtctaatttcacttggcaaaataactatgatgataggagaggaggtgcaacactttattataggtagattagaggggaagaagttacaataatatagcagagactcttgattacggtgagcctggtgaatacttgtcgggacaattcagagtgaataacaaatgaaaacaacacaagtcctgacacacggaggttcgcgcaacaaacatatttaggttgttcagcatatttctcaaggtgtggtttgttagagattgtgccaaatatttgtacaaagtcggtaacagtttaggacttcgaagttgtaataggtgtaagacatagttaaagtcaaattcatcataggctctcttaaatttagagctggcatcctggttataaccatatgtgtttagttcacgctaaaattaaaagtttgattgaaattggaacgatgtgatggaaaagttggaagtttgtatgtgtagtaaagttttgatgtgatggaaaaattaaaagtttgaagaaaaactttggaaataaacacggcgtataataacgtagctgttggtatgactggtatggctagtcagcggtccagtcaatcgaggatcgtggatacgatgtaatatgctatatagggataaacgcatgtaatcagtatatcgggatataagattcagttaaacctcgttaattaacaaatatcatgtctgaacactatttgattatcgatctcgattttggatcgattttataacacatgtattatttcgcgtagtacgagacctggaacgcgggaggagtaaattagccaacgcgatcctcatgatccgtggcgacggcatgcacgggcacgagtagtagtgaacgatcgaccggtcgctacaggattattctgggcctgtgcgcgcactgtggcggtggtggcaactgcgtgtgtccggacgaatggccgtgtgtcactgtgcgtggccttgaatgcggggttgcaaccaaaagtgattaaatttcaaactgggctgtccccttgggagagggagagagagatctgctggaaaaggagtgggtagatagtgacaagacgacgaaaaggaggaggggccggggggacgcgaccgtgatttccatttctattcctggcagccttttgttttcaggacccctatttttttaatctttcaaacgttactcccagctgaaaataatcctgtcaaattaccgagctgcaagtccatgtttcatactttcagcaagtaatcagctgaaattaaattactgaagtaactaggacaagtttggtaccggtggcctggctttatttcctgatgacctgaatcatgcatgggtagtacagtactccatgcctctagcaacaacctgtgctgagagcctgcaatgctttgagagtaaaatttgcattgctctccagttttcacctcagtaattaccagagagcagtgagcgtaatgtacgctcggaagcagtaattattcagtcgtgcacgaacagttggcagcagatttgggtgccccaccaagactagccagctataggggagtatactcgccatttcgccatggatccagctgcagctgcagctgcaacagcgagccccatccaggtgagggagccgaggtcactgaacatattccattgttgtctctattctcccctcatgattgccataatttcctcctgcctctcctcctactggctacagctactccagcctagcctagcctagcctagctactgcccatcctcaccaaaggaacgaataaatggcgccaccctccaccggacagtatcagcccagattacctctcttcttttaccaatgtgtgcattgttcatgtctccgtctcacaaacatgactctactctacgctcccatgcataaccatacatgcgttacaggaaatggagtataaagcgatgggtttggatagaaaaagcggaaattctgttggtcttgagtagtggagtactactagatttacccgaggttagctgcgaatgagatacatacgtacgcgtgtgtgtatttcatttttatttgagaaacttagtacaagcgtggccatgaacatacacacccacaatctaaaccgacctataagcacatatttaattaaaaactagttggatggcccgcgcaattactcggctaacacccaaacaaaatcatataatttttaagtatgattttacttaaaatttattaaatagctatcttcttctcttaggactttgaaagaccaagccttatcatccccgtatttctaattaaatagttgttaaaagtcacaccagttagtaccccttacttctgtcatatccttttttattttcttactcgatctaccactattattcattctccttggaatctttaaaaatttaatctagaagtcccttacagtttattgtctcgttggttttcatttttatgatttatagaagtcccatcaaacgctgccattatacccctctacggcccgcccactgtcttttctctttattgtcattggaattttaaaaatcaaacataattatcgttcgagttcattttttacttttagaagtcccgccaaaccgtcaacggctttgccattgtactcctttatggctcgcccgctgcctcccttctttattgtcattaagattttaaaatcaaacatgattttcattggtttttttttactttttagaagtttcgaacctttaaaagagttggaccttatagttttcagagtttattgtctcgttgggtttcattttttataatttttagaagtcccgtcaaacgatgttactatactcctctacggcccatctgccgcctactctttattatcaatgtgattctaaaaatcaaacataactatcgttggaattcatttttattttttagaagtcccgctaaccgtcgggggctctgcaactatactcctatacaccccgcccgctgcttttcatttttattgtcattgagattttaaaaatcaaatatgattatcaatgaggtttatttttttttactttctagaagtcccggcaaccgccttgcctgtttgcttcatggcctgcctgttgtcccttcttttaatcatcattaggattatatttggtgttttactaacagttttatatgtcgtatcaaccgccaccactctactcctttataggtctattacttaatttatctcgtcatgtgtttcagatggtattttttttcaatagtttttttatcaccaactttagttatttataaattgtaatactaactgaaatctttttttttcttttccaactttagattttttttttcaaattttaattaataccgtataatgttctttaaatatttttattttttatttttgaatttcagttgtttcaaaagtgtattcctacttaactctcttttagtttttctaattttggatatgattttattttttattctgaattttaattgatctcgtattgggtttttatatggattcttctttcaatatcgtttatttttaatttcgaattttagttaattttaaattgtattcctacttaaattttccttgtactttttactaattttggattttatttttattttattttgaatattagataatctcgtactggttcttatatgaacttttctctcaatattccttatttttaattccgaatttcagctatttctaaatttgttactacttgaactctccttttcttttctaatttcggattttattttatttttatttcaaattttgaataatctcgtattggggtcttatatagactcttctttcaatattacttattttttgttgcgaattttatttttaaattgtattttatacttggactctctttttctttttctccgattaatgtgggaatttctagcccctaagcgaacgtggtaccttctttcaaggctgttttaataatataatagataccgggctggtatattttaaggttgatagtcatgatagacattgacatcttaagattaacaaattaaccataagtatgagcatctatgctaagtttaacccttaaatccggttaattagcatgtttcataaaaaaagtctaaccaattaattattctaaaaaccatggtgtcaactcatattagtatagacgtttgaggcttagtctgaaaataggtgaagatggcagttaagataacctttctgaatatgtagtcatactgtagggtgaaaacggtcccagtaattcccgaacatccggctatcttttaaattgcattctagataatataattaattctggcttttggttcacagaatatacatccaattattacatatacaccctctgaagaaatggttactaacagaaataaaaataaaaatactactattttcgtcccaaaatatttgtcgctttgagtttttgtttgtaaattttgatcatttgtcttattaaaaaagttatggaataatttttttattttgtttgtgacttgctttattaccaaaagtactttaagtatgacttgtctttttttatatttgcactaatttttcaaataagatgaatagtcaaacgttacaaacaagaagtcaaaacgaccacaaatttggaacggaggtattactagaaacacaatatgaaagtagaaacaaaaaatatttttactagtctactaagcatggttgttaaggcgtctgtaaggcgacgccttagcgtccataaggcggtaaggcgtgtccagggcgtaaggcatctgctccgccttacgggaaaaactagaggagaaagagcaaaatcaaggagataaaccgatcctgtagaagcagcagcagcaggggaaggtcctggagaagcagcaacagcaggggaagggggaggaatacaaagaactaacctaaatcgtcatcaccgtcgtccccgaccactagcaaagccacatccacctccctcgatggctagcaccacccgacgatgagtggctgcggtaggggaagaggaaggaccagaggagcggaagggatgaaggagatggagacggtggctgggcagggttcttgccgtcggcggtagtggagcggacgcggctaggtgtcgacgggattagggataaggatggggtcggggatggggatggattgataaatatctatcaccatctttcgttttagtccttggactctgtagatattgtgaagaagtccttcatttcctattttcatcatccattttagtccatcgactttgtatatattaaaaaaagtccttcatctcctatttttctatctgcataaggcgtcgcctcgccttacgctttaccgccttagggtcctcgccttatgccttaccgccttaacaaccatgctactaagcgttctgttttggtttattatattttcacagaaattattagtattctataatatggtaattactatacgtctaaatattagagtacctgtatatgtggcccatgttttgatatgaaccatatatgccataccatagaggcccattaactcctctagctgctaaaccttatatttatatgtttctgtccaaataattttatttttccaatattcctaatattattttcctttttagctcagccgttttcggcaacaaaagaaaaaaagaagacctgcatgcatttgccgaaatgatccacatcatttctggccacttttagctttagttgtgttttgcccatcgtctatattgctcggatactccgatacatatatcgatacatgatatgccatatgttaaaaatatagctatttctggaattttcatggaaattgaaccgagagttaaaaaaaaagagagactagaatgccttcattaactgtcctgattagtgggtggtggggattgtaaagatgatactttctccgtttcaggttacaagacgttttgactttggtcaaaatcaaactgttttaagtttaactacgtttatagatgaatataataatatttataatactaaatttgtttcatcatatcaataattaaatatattttcacaataaaatttttcttgggttgaaaatgttactcattttttctacaaatttggtcaaacttaaaacagtttgactttgaccaaagtcaaaacgtcttataacctaaaacagatatttgaatatttcatcactacaaataccaattttcattatggtctgggagtttttttttataagaagttcctatttggtacgaacacaatttagtttctacacagtcccagaattatatatatatatatatactccatgatggagtttacataattacagtacgtactagtagtataaccaacgtaatggcaatctatatctggaatttcttttagctacaactcctcctactactaaatagtactccctccatcccaaaatatttgacgcattttactttttttaaaaatgtttgaccgtttgtcttattaaaaaaaattaagtaattattaattcttttaatatcatttgatttattgttaaatatacttttatgtatacatatagtttttcacatttcacaaaagtttttgaataagacgaacagttaaacatgtttaaaaaagtcaacggcgtcgaacatttagggtgtgtttggttggagggatatccctagatgggatatgacgacccagtttttgagtgtgtttggttggtgggcgagggaggatagggcggcccggagagggaataatccacgaagatgttggatgagtnnnnnnnnnnnnnnnnnnnnnnnnnnnnnnnnnnnnnnnnnnnnnnnnnnnnnnnnnnnnnnnnnnnnn

SEQ ID NO: 36464 - DNA, 2238 bp, Oryza sativa
  unsure (1)..(2238): unsure at all n locations
ttgaatatttcatcactacaaataccaattttcattatggtctgggagtttttttttataagaagttcctatttggtacgaacacaatttagtttctacacagtcccagaattatatatatatatatatactccatgatggagtttacataattacagtacgtactagtagtataaccaacgtaatggcaatctatatctggaatttcttttagctacaactcctcctactactaaatagtactccctccatcccaaaatatttgacgcattttactttttttaaaaatgtttgaccgtttgtcttattaaaaaaaattaagtaattattaattcttttaatatcatttgatttattgttaaatatacttttatgtatacatatagtttttcacatttcacaaaagtttttgaataagacgaacagttaaacatgtttaaaaaagtcaacggcgtcgaacatttagggtgtgtttggttggagggatatccctagatgggatatgacgacccagtttttgagtgtgtttggttggtgggcgagggaggatagggcggcccggagagggaataatccacgaagatgttggatgagtgtatccggacaaattggccagatgaggatatccaccttagctaatcttgatcattagttcttgattagcaataattaaattatattgttgttaattagtaattaacttgtcaaaattagtgctaattagatataattactctattttattgttaatttgtataaactatagctatattaatgataattaacatattttattaataattaatatgttgttgttttcattcaatccattctcattcacccaaccaaacaagaaactggatggccatatccatctaaccaaacaaaaaaactgaaccaccatatcccttaaaatatagatgacaatatcctatctagccttgaccaggaaccaaacacacacccgcgggaaggagggaggagtagtatctcttggtgtaataggattacagtatttgcgtaaatttcgtttcagcacctggtgatctggaggggtcacgagtgatatagacggagctcatgattagtcacttcatgtctcggcttagctgctagttcagcgtactagttcgtcgtcccaccactccaccccgcacaagcactgcaccactccacaccacgcaaaaggcgaacacagccgggggctagctatatcctgtcacttgccatcacaccccatctcatctgcagtttctgagtccacaggtgggagagctggctggctgtgtgatgcatcctgtcccccctctcccctctcctctcccggctgctagctcccgatcgtgcctccgttccagcaatcatgctctcgccaaaaggaaccagctcccgggagcggaaaagatgtaaggcgagagcgatcagctcagctagctcaccgacaagcagcagcggcgacatgtttttcgcattacacaagagttcattttgtttctgtgccatgccatgcatggacgcatggtaggcctacactgatcgtggaatcatcctttcgtcaagttcgacatcttttgtcccttgaagaatctaacgttatcaggtgttggtagacctggccgtatcatactactacatgcatgcatgcatgatgcagaaatttggaactgtaactactattaagaaggacatcacttgatattttatgctgttcttcttgctgaatcaactgacctaatttatcatcgtatataatcctctcctccatagggtttatgagaggtggagaagacgttaaacagtagtagtggtggtacgaaagctctcgctgtctcgcaacatggcagcagcacggcatgcgcctccttttcctcaccagccatcattagcaggtgtgtgcgtgctgagcgagagcgatactgataggatcgcgcccgtgtccggacccggggcacggaggaggcaatcgattgctgcggtgaaacaatgtctcctgatgaagacaacacaatgggaagccaagacgacggccagcatggatgcactttcggtccggtctaatccaatccaaacatccaatccatcctcgcttcccaaaagccaaagccacctctccctctctctctctctcgctctgcgttgtgttcagcagctggagtagcttttcttcctttcgtttnnnnnnnnnnnnnnnnnnnnnnnnnnnnnnnnnnnnnnnnnnnnnnnnnnnnnnnnnnnnnn

SEQ ID NO: 36465 - DNA, 2155 bp, Oryza sativa
gtgaagcctgccctccgggccgggagaaaccgggtcggtcgtggtcgtggtgcgcatgcagtgtgcacgcgtcgccgcggaactgacccggagcatgaggggcctggtgccgctggtagctaatctaatagtcaattcatacaatagttgcttactatataattaggacatggtcctatctgtcatatacacattacgtcttaaagtccgtgctgcagctggctatagatctgtagcccgctgctcttctctctcttcctttatctctttaaaatatgtttataactgacttatagcccgctattgtacatgctctaaagagtattctacactcacaaaagaaaattcagtacgcctctgcctctgtcctattttaaacacaaccatgagttctcgtattcaattttaattgttcatattatttaaaacttttatatgattagtatttttttataatataataaaatatgaataatgctttatacgtgacttatgctttctaatttttttattaaaattttttaaataagacagacgattaaagttgaacgcgaaaatttatggttgcgcttaaaatgggatggagggagtactatactcctaaggaagaaaaactaaagcgtacggaatactagtttatcacacggaaaaaagaatagcgtttgtagattagtgcaaatgaaatgataaaacccatttactacaagtgccctaaaatataaagagttttaaaattagacatgggtactgagaattggtgaaattcaatggaggaaagttatgaatgtgatgacttcgtcaatcttaagatatgccgacccaattttccagagttactcatattgattggatgtttgtgtgtgcataagggtgagtgtgcactcattgtgagcgcatgcgtttgtacagtattccaaaaaccgggaaaaagttatgattagtttagaagaggaggtatgtaggaaatttgaatgggaaatattatgattaggtggataagttattaaattttaagactagaagttatcgtactgtttatatgctggtgacatttatcttctcttatgtcttatatagtgaaagcaacaactttttttacataacgacatgccacaccattacaaacatattgaccattggataaagatttggataaatgatgttcattggataaaagggtagcattaaagaatatcacaagtaagctttttttgcctactcctataatacttttagacacgtgatataaagggaggagggagctagggggaggggccaaagaccatgatgaaaaaaatatattaggaggcttctagcatgattgaaaaaattaattatatgattgtatatgttttaaacatacttatgttttttcatgtccggatgtggtagtagcacaaataaaatctgcttccgcgtgatgggtttgactgctgttgcttcgtcaatacgcacagtatcttttgtggtgtcagtggtgtcgtcaagcgttgcagccagctagcctcgcttagagcacccgcaatagtaaagtaaggtgctctctataaaacatatacatatcagtaatagactagattaatagtaaaccacctcaatagtatgtctacatgagtatctatagctctctaatgcattgtctcgtttttctctatagactatctccaggttattagatagctttgctccctctcttcatttaatctcttttaagtaggaaaatatgctgacatggatatcttatagagagcctatagataaccattgcgggtgcccttaaagacgatcgagctaagcagtttcgaagccaaaaattatcaaagcctaaaactaagtggactcaactaagtgcatactatataagacagctataaacacatatcaagaaaataaataaggagagagaatagcactaggctacagatttataaccagctgcatcacaggctacaagacgcaatgtgtgtatgatatgtgggaccaggtattactagtgcaatatatatctataggtaattattgtttgaattggttatgaaattgactataaatgatttgaagttagtagttggctatactattaaacttgctctaatgaagtatttttttaaaaaaaattatatcatgacttaaaagaatttaaatacgattttgg

SEQ ID NO: 36466 - DNA, 7801 bp, Oryza sativa
  unsure (1)..(7801): unsure at all n locations
nnnnnnnnnnnnnnnnnnnnnnnnnnnnnnnnnnnnnnnnnnnnnnnnnnnnnnnnnnnnnntagctttgctccctctcttcatttaatctcttttaagtaggaaaatatgctgacatggatatcttatagagagcctatagataaccattgcgggtgcccttaaagacgatcgagctaagcagtttcgaagccaaaaattatcaaagcctaaaactaagtggactcaactaagtgcatactatataagacagctataaacacatatcaagaaaataaataaggagagagaatagcactaggctacagatttataaccagctgcatcacaggctacaagacgcaatgtgtgtatgatatgtgggaccaggtattactagtgcaatatatatctataggtaattattgtttgaattggttatgaaattgactataaatgatttgaagttagtagttggctatactattaaacttgctctaatgaagtatttttttaaaaaaaattatatcatgacttaaaagaatttaaatacgattttggagataaagcttatggctcaaagccaagctattctagatttgtcttcaccaatgtggcgaattgaagtgaaagatgctggctgtggccagacgctgcagcctccatcagctaagcctttttacgtccctatatgacccggcccgcaatttttcgcggcgccggcccagcaccacccgcggacgggctaggcgtcggctgggccttgcaggcctcctgctttctgcttgccttgctcatatgatcatatactactagtatacctagtagtatggtatttcctctcttttaaaatataataatctagtattagaataagacagatcttagtaacacgaatatacgatatattttatttggtattatgttgctgtattttagtacgaaataaataatactacctccatgcataaatgtatgacgttagttagtttaattttgagctaaccaacgttaaaaataaatatggagggagtaccggagtactggtagtatataacagtgtagtgcactgtgcagaagaaattcggatacagattgatgacccaccggccggcttgtgaaacaaatcagagtggtagctgcgtagggacgtggcccctggtgatgtccaagtgtccgtcgtcattactgtatcgaaacagcttttcgttcggttgtagatttgcggtaggtaggcagcttagctcggcccacagtgttagggctagtactaatgattgtatgaactgaagtagcaagaaaacagtgtgcgagtgtgactgtaactgtatgtgtatctcttgcagcaatagcctacatactggattcgttcgtaacagtggtctgatcgattcgttctgcatactggactgatggagtgatggttacatgggccagatgttacatggatcaatcttgactttggctccccaagactattattccccacatcgggttacccgttaccatctgcagtacaagagattctcaaaggacacacattcaggcaatggtagtagcaagatgccaaaaactctgcactcgagcgagaataaacgaaatctaatgatcacgcctaacaaaagaacaaagataatgaatgaccgatcgacgacgcagctgatccgtttgagctcaacacacatgaaaacaaagccgctacgtccacaaaatgcacagtgcaaagttccacggatcgatcgatcaacgagctagctgctggcgactttccagcggcttgtggctcacagtcacaggcactagccaatggacgcggctgctgaatttgaggtgatagaacagcatcccaaaactgaagaactctggaaagctgcgttcttgttcggtacgttcctacgggacctcaggcgaagacgcgaagatcattagtctgagtcttcgacttatgtaaaccttcccttcttacaatggaggtaacttaaaaaaactaccgcaagtttttcgagtaaaaaacttttagatataactatagtatatagtatagctagagtataattacattgtaactacaccgtaactgcactacaactacattataagtacactgtaactatggctagcaccgggatcttatgcatgatatgtgtgaaaaaaatttctaacatttttttccttcattcacagatctcgaggtaatccaatggtcacaaatctagaagttttagaggggggacttgctaaagttttctagcaattctgttttatgatacacataaatcacaggcgatgaacaataatataaaaaattcttgtaagcacctggatcaaaaacgctgatagacagtagtaatgtatactcctttaataagagtagtaatggtaacgagtggtaaatctttctttacaaggagtggtgttggtgacgagcgataaatctatcacaattttcaccactaacaacctaacatggaaatggcatgcggggttagagggttaacatgtcaatcatcccatcagtcaaagagaaaaaggcaaaaaggtaatccctctgttccaataaacttagggcccttttgaataaaaaaattatgaaggaatttcataggattaaaatcttacaggaaattttcccatgtagctctttgattcaaaggattgaagttttccaaatcctacaaaattcctatagaatggcttgttgcatataggttttagagaaaacttagcaagaggtccaacctctttgtaaaaatcctttgagtctatctctctcatctgattcctatgtttttcctatggtccaatcaaacgatcattcctgtgtttttcctgtgttttgtaatcctctgttttacacttacattcctgtcagaatcctatgtttttcctattcctccgttttttcattcctacgattcaaaggagcccttaggctgcgttctttgtagctattggaacttagctactcatcaatctccgttagcacttttcaaactgttaaacaatacattttacgtaaaaacttttttttatataagttgtttaaaaatataataaatttattcatcaattttttatatatttgtacttaattaattatgtactaatcacatttctcattttatgtgcggctaattagccgtttcaaacctttgaaaaacacaaccttaacctataatggaatgtgacccatactaatacaataaatttggataaaagcttacttaacctagctagtatgagatgtgatctatcctggtacgataaaattaaattatatgggggctagtatgtagtcggaggacccatatgtatataattgtattacatattagtgatagttattatctatctattattatatactaaaagtccattaaacttcctacaaacgatctcaagccgccacatgggatttctaaaagcgctcctagatcaccatgtgacgttttaatatattaaaaatatctagccctcgattttcacttaaaaggtgggtccattattttaggccattagatttgattagactaaaaaaaaaattagtccttcccctcatctcacctgcgcgtacgtaaggctccctcatcccgattgcatggtatatatcataccaaaccaaaaagaatatcctaagtacgtacgaatatatagtactattcacctgaaaaaaaagccaaaaaatatcatcctctttacgtgcttacttcattatttaccgaataaatttgtttttaatgtaaattggcgggtctattattttagaccattatattagattaaaatttgtttcagcttaagattattgtaatctagattataaattataataaaccgacataaaataaattgttagttgtttgtttttgggattattggttgttaatttgtttgctattagtcacccaatataatgtaaaaaagcacctttgaagtggattgttggaattaatagataggccttagccacgtgtacatacacctgcttcatcccgtttgtacatacacctgcttctttcactcccccatttaacccttttttttttgccttacaaccattactttttttatgctattcacattatttgagtgtatatttgatcattcatcttcatataaaaattatgtaattataataagaaatactagaaattctgaccttcgattttcacttaaattgatgaaccagttatagtattagatcacatctattaaaaaataactcctcccaaaaaaatcccacgtacatataaatacattgtactgacaaaaaaaaagccaaaaagaatatcctgtgcatatgttaccctccttaaaaaaactgcatggattttaaaaaaaatgaatgacccagattaggaggcacctaacatctaaacttcctacaaacgttgtcaagccactacgtgggactcctaagaacatgtacaatgtaaatgctctaaaaacggtcctaagttgttacatggggttataataaattagaaaaaatctactgattttactttaaatcgatgaacccattaattttaaccattagatttctctaaaattaaaaaatccggtaacctcaccctccactatacgtccgcaactacgtactccctccctatagccaccctccaactcttcccttctctcttatttttagctaacttcttctattatttagctaacatggatctatcttaagattttgaaattacgttcatctggaaaatgaatcacacgtagaaaaagtcctctatctcttcatggatgtgcacgtctatttgtacctaccctgtttgttctttccttttttttcccatcttggttacatgagatagaaaatcagtattcacattaactatattttaagttgtaaaaaggcactttaataaattagaaaaaaatctagaaaatgtgaggaaaaacaaaaatatctaaccatcaatttttatttaaattgatggattcgttatctcggactattagattaaatcctattaataatctctctcctaatctccctcagcgcaccgacgagagaaatgtacgtacgtacgatttgtaaaaaagccgaaaatacatatacaattgtaacgtacatttaaaaagataaattggaaaaaaaataaaaatataaattacttatatcagtaaaaacgtacttttgcttccttcttcttccttctattctccatatatagacgaaatcgtaattattattagtgataataaattttaagaaattataactttataaacatagattatatatatcatcatatactatattattttaccctttatattaacaatacaatatttttttacttaaaccgagtacctattatatcgaaccattattctatatcaaaattttaaaattacattgtttaatataaatgttacgcaattatattatgtaccagtaaattaccaatttataatctatattaactaattttttacattaattaatgaacccactattttatattatttttaataaaaaatattttgatgtcggttttcacttaaactgatggacctattaactagacctattaaggacctattaacaagactgtcatatctatcttttgtaaaaaaagaaaaaacttctaaagacttctcacgtgtgtatatttgccttctgcacgtatgacgaagcattgtacctgaggtaactaaggtgatttgtactacccaactaagcaattctgcaagtgatttgtgtcctaacaaaaattatttacaactttagaaaagaatataaaaattttgaacttctactaagggaaaaaaattccatctttaatttggttgtcactaaatcatgcatttttatgagacgattcgatcataataactttgagttccttgctattgcaatgtttacttgtagtgatattgtactgtatatgttcaaatagtacacatgatatttactcactcggtccaaaagtcaattcaaaagtcatatgaccttgatttatcttctaagtcaatgaatggtttttttagatatgtccgatctatagtttactcttttaagatataatttctaaacgaactatattatactataatagtatggatgcccgcacatcgcgtgggccaccttcctagtttttctgaatgatcgatatgctagtatacgaaatgatcgatatgctctcttgccatgacctcgatatgctctcttgccatgaccttttcctagatacgtgtaccttttcgtttcagttccaacatcgcatcgtcgcatgcatcaccgcttacgcacatgatacgagttattcatgggaactcgttatcgggctggacatgaagaggtcgacgacatgcatgcatatcctccttgggcccatgcaaatcatgagcggacagccacggcttccttcctaattgtacacctcatgttaacctggtggtcatgcttggtttctattagctagctataagggtaagttttacagtggaggtggagtcacatctaatttagaacatgttattttcttattaattaagagataacacatacaacatatcacatctaatacacaaaccccaatattagtccactctcacatcatcttgcacttttcttagagattgtgtagaggttgccctttacataaggggtggcttattctctctcttctaacttctctcctccatctcatcttctaatcttatgtgtcaaatttagaggcaatatgtaggggtttatagtacttgccctagagcggctagcgtgtgacacacttttgccaacggaagataaattaacaaattaattaaccatcactatattagaaaacagacgggccatacatctcaatctgtgtactattaatctggaaacccatctgtaatcatctccttgtcgtcgccgatcgcgcctaccagtagcaaatcttgtgaaaaggtcgtccatctaatagctccggtctcacttaattaactgcacgttgcaatagccagcagtggccagtgacagcatccgtgaaaaaattagcatacaaaactatgaagccgcgaccgaccaaatttcagaagcatcacatccacatgtgtccaaactaaatttcggctattctaaaagaggtagcgaacaagcagaaaagtagatgatttgtgagacaaaagggttttatacaggttcaggcattctcggtgagaagtaatactctactcttattcggagaaatattccgctgattgtgttattgatctgacgatctcaagtgaggatatgccctcaaggggcacccgaccctccttatataggtgagggagtcaagattacaagatagagattttatctcttatggtttaaaactctgtagatactcccttcgtttcaggttataagacgttttgactttggttaaagtcaaactgctttaagtttgaccaagtttataaaaaaaaatagtaacattttcaacccaagacaaatttattatgaaaatatattcaattattgatttgatgaaactaattttatattataattaatattactatatttgtctatagacttagtcaaacttgaaacagtttgaccttcaagtttgactttgaccaaaatcaaaacgtcttataacctgaaaagggaatactttacaattgtaaccgactagaactacataatatttccttgatacataagtaaacgtaatatccgagtcattatctatacatattctactcatatgagttatccctgttaccagttcagatagcataaccttgtgggtatatggtacccataatatccccaacatgtgctatcctttcgggccctatatattgtacaatttgcaaa

SEQ ID NO: 36467 - DNA, 546 bp, Oryza sativa
gtcgaacccagtggcgcaaccagtggacatgtgagagcggccgcgctcagacagcaaacttccaactccaaccgccatccgaaacccaaccagatttcttcccaattaaatccccctccctcctctactcgatcgctctacacgaccgatcgatcgatcgatcgagagcctgacccacgcgtcgtaccggaccaggatgttggattccattaatgccagcagctatagcccaagtagcttagctagccatacaccgccgtcggccagcttggcgagaccgcgacgttcgcgcgccgcgcggcaccggccgggagggggggggggggggcgagcgcgacggggacccgcggccgcgcgcggcacggcgccttggtccacgtacgcctatctacctagctcgtgcagtgcggactacgcatgcagcgcccactaccaccttgccgcgcaacaccagcatttctttttcgcctcgtctcgtctcgtctcggctcggggtcggggtcggggtcggggtgtgcagtaaaaaacaaaactttgcaccattca

SEQ ID NO: 36468 - DNA, 691 bp, Oryza sativa
gagactatttgcacgctttaggatgcgggtcagttacctaatatatttcacgtaataaacgcccttccatttccagacagtaaatattcaccttttcagtagccttaacaaaatgtgcacaaaaaatacccaaagatgcgcatatagaaagggtttaaaacaaatttaattaccagcaattgctttcggtctgtgcccacgcgtcatgaataacaaaaagagtataaacaaaagcaggacggtgttatggctaatagcaccaaacttgtaaagcatcaaatgtaaatcgatcaagcatacgccacaaacataaatccaagattccaataggcaatacgtgcacgcgagctaataaataccaaaatcatagtagtctcgataatattagcatcaatgagcgaggaagagggtgagaggcaggtagtcaatatatgatgatgatatatacaaggaaacatacctagaggaactggcgtctttggctgactgctggggccagctgatgtcgatggtcaggacagagaagcacaactcaactggacaacagtcctaataattaataaataaacaaatgggtacatctaaaattttgaagaaaacaaacttggaccgcttctgtgcttttctgcttacccttcaaggcggctctcgaggtttggacggtttcaattccttgccttcttcaataagc

SEQ ID NO: 36469 - DNA, 1091 bp, Oryza sativa
gggtcccacgcggttgacgttgagggatttttcacatgaaagggattttttaatatatatatatatatatatatatatatatatatatatatatatatatatatatatatatatctgcggttggtaattggaattggaaactattctaaggtaattggtgatttttattcgttttagaaattagaagaagttcggatttgtcacagttgcctaaacttcatgaagcttttatttaggcaaatatatttccatcaatatcacttgttctcaatattgcctacccgaaatattcgatgccataaaataaaatactgtagtaataaactaataataatcattttagtagctcaagaccttttgcaaaatagcccaattaaatcagtttttttttttctgtcgacgtcactttttttctgtcaatggcgacgagggaagaaaaaaacagagaaatcaaacaaatgcagcagctgagacgaaccggcaaatacgtgccaaacaagcgacgcttttctccctttttcctcctcctgattcgcagcgtccgaagtaggcatggtttgcctcacctggctttcccccacgtacctttcccctgcgcacgcgacacgtcacgccacgccacggcgcgcgcgcgggcggcggcgtcggcgcgtcgcccacgtacacacacgcttgtcgcgccaccgccatcctcgcgcgccggcgccgacgcttcgcggcgccgcgggcggacgcgcggcgcgggcgatggcgacgcgccgatgtgatatgcggctggtcggcggacggcggggggtttggttcgccgaggcgacgccacgtcggcgccggagtatccctgaaggaaagcgcggccaccaaattccagacaaccgactcgccgactgcatctcgatcacaaaaacaaattaatcatgctgcatggtgacatggtgtgatctggactctaaatagcatcagatcaaagagaccaattggtggtaatcatcaagcatcagagctagatttttaatcaattaggcagcgggtgagttctgggacgaatccatcgatttccatcaacgggtaccgagctcgaattcgccctatag

SEQ ID NO: 36470 - DNA, 1226 bp, Oryza sativa
ctcctctgtgtttttaagcaaggcctttgagttctccatttcagttcttgcattagtcaactcagattgcgctaatgaaagtttcgcttttgcatctctggcatcagttgtctgttccttcaaagctattgccaaatcatccatggccttcttgcacttctcctcagcttcgacagccaacttgagttcacgctgtaatgaccacgtctctacctcaccaggatcagcaaaggagaaagacattattccccttctcctgagattcctagccggttggctaggattagaagacagtgcactgaaggcttccgagctctttttattatctttgagggaagcaatctcaagcttggcctcctccagagataccttggtttgttcaagctgcttcgtttgggcccccaatgacactagcagtttcttctctgaatcccttgctgcctcctgttcaccttctaactgctctaatctgtgcacaaggtccaacttatcatcacctccattgcttgtcaccttattctcattctttttcttcttgagccctgctatctcatccagagcacgcgccttctcctttttctcattcttcagctcttcctgcagcttgttcaatttctcctgcatctctgatgcctcggtgattgaattggaggctttgtcaccattggaagttgatctgacgctgtcaacaaaaacattgttcatgttgattcatggattggtggaaatcatcaaaacagtaaatctaaaaacaaggaattaaacagaaattccactcaatgaaaaccgagatgtcaaaaactcacaaaatgattccagaacttgaaaaagaaaagttgggaatagacaattactctacctggacctgaaggagaacatcttgtccattcaagaaccctgcagccagcccagaattagccgaccatgccacctgcgttcctccaaagtcgtatactatgaaacccaaaattctatcagtaagatagagaaacagagaatacggtgttactctgaaatggtggtgtccgcataccggaggctacggttgctcctgggtatagaagtagagatcataccgcgtctttcgcgttgccagaggaaggagaagatgaaaaggcttattgaagaaggcaaggaattgaaaccgtccaaacctcgagagccgccttgaagggtaagcagaaaagcacagaagcggtccaagtttgttttcttcagaattttag

SEQ ID NO: 36471 - DNA, 3167 bp, Oryza sativa
  unsure (1)..(3167): unsure at all n locations
nnnnnnnnnnnnnnnnnnnnnnnnnnnnnnnnnnnnnnnnnnnnnnnnnnnnnnnnnttatgtttgtggcgtatgcttgatcgatttacatttgatgctttacaagtttggtgctattagccataacaccgtcctgcttttgtttatactctttttgttattcatgacgcgtgggcacagaccgaaagcaattgctggtaattaaatttgttttaaaccctttctatatgcgcatctttgggtattttttgtgcacattttgttaaggctactgaaaaggtgaatatttactgtctggaaatggaagggcgtttattacgtgaaatatattaggtaactgacccgcatcctaaagcgtgcaaatagtctcgtggttggtgaattactgagttggttaatggttaatgctgatcggtctcatatttgttctctctaaaaagccaagcgtactatgctaaatatttaggcaaattttgctgcagaatatcgtgacttctcgtggttttagctgtaggacactgcacgaaatcactaatgagaaaacgctacagaacatcgtgacttcatagttttagcggtaggacaccatatgaagtcacttataagggaacacactctgtaaatgtggttatttatccgaggacactccatccattaaattaatgttttcgtgctaactagacgagagggggcctacttttttacacaacttgaccaaattgcccctcctctctcattctcatcctccttccttatctcttcatctctctctcattctcttttacaaggcggcggaggcctgctcaacagcggcggcacgcgtgacctgctcggcggcggtggcggagcccggagcacgcgttgcccgcttcttccccgcctcctttctcgcgatgatggcgtctttcgtcgacttgacatcacaattgaacagcggttcttggccgcgcccagctcggcccgaagcagctcatgctcctcgccaagcggcatggaggaggggatagagggaagagagataggagagctaacatgtggcccaagggcatttttgatattttacgtgatttctctctcatcttcaaccgaaaattattattttaatgagtaagatgtccactagtaaatatctaacttttgagagtttcttcctcaaaagtcacttcgggcggtatcctacagctaaaaccggtcacttcgcgcggatactacagctaaaaccgcgaagtcatagtgtactgtagcaacatttcccaaatcttaaacacctaaatctttctttttctcacctttaactcctagactatgccccttgtaggagtagattttttgtttttatctaagagcatgttcaaagatagaatcggtatgatctgctatactatacaagattatttagaaactacatccatacaataattaagacaataaaactctaagcattaacccaatatatatgtttttattactgttctctcattttcatcatattcctatgtaactactatgtaattgagtgtagctgtaagttggatatgtaaaagcacgaatcttgatgcaagatcttacgaataaaaaagtgaaaaataggagcataaaaatctggtgcaagttaaatagcaaaatggttaaaaaaaaaactcctatgtacccattccataagaaatttagcataagctcacatctcatgttttatttttcttcgctacgtccaatacacgttctctctctacgatttccagcaaaattcttgtgttttaaacttttaattcatgtgaatcatccaacgacattatctttaacgttcttctagttatttttttcctatttctgtattttgaaaatccacattccaaatgatcacgctttctctaggatttttcctattcctacgtttgtttcccaaattactaaacggtgttttgcttacaaatatttctattagaaaattatttgaaaaaacatattaatccattttcaagtttaaaataattaatactcaattaatcatgtactaataacacacctcgttttaataacacgcctcgttttatgtgtattctcattttttttctttttcctctcaaacacttcataagaaccaatctttttctttcccctcctctcaaacattccaagaacagactcctctcaaacactccatgagcatccctcctttccccgccttgttccttactgtaagtttgtaacggtaatattaactcaactatgagaattgttagactttataattttattaggatataaaattattgattggagtttttgtgagttacttcctccgtccaaaaatcaaggcctattttcctttttttttttggttttttcaaaaacctaagagctatttgtagtctctatagagctacgtgctaaatttgttgggtgcaacctaagaatacatgggttttatcacatagtgaatgagttaattactcactgctctgaataacaaaataaatataggtcttatatttctggatggagtagatcgtatctttgacatcttggcccaattaggaattggcatgtgtggctcatgagagctgtgtgcgcatgtttagtaccaccttgcaagtttagcaaagttgaaatcaacttagaaggcctcttccctccaaccatgtcactctcaagttaatccttttatacgaaacgaggacgaaaatgtaagtggagtggtatgtgtaagtgggctcacccgtcagttgggttaggctacatgtttttggagggagggctgtgacaaatggtatcagagccgattctcgcagttgtacgtatgggtcggtgtgcgagcatatggctcatgtggcatctatgttgaggcacatggcatggcgtatggcgccggccctagacgactctcgggttaactttttacacgaggtgaggatgaaaaagtgtaagtgcagtgttatgtgtaagtggaccgcccgtcagttaggcttgtgacggtatctaaacctaataatggagtagtggtacttcattagccacagtccacggtgcgccagagctatcaaatgatataagcatttgatgattcatcagcaacgatccatcctatagacgatacgattnnnnnnnnnnnnnnnnnnnnnnnnnnnnnnnnnnnnnnnnnnnnnnnnnnnnnnnnnnnnnnnnnn

SEQ ID NO: 36472 - DNA, 1604 bp, Oryza sativa
  unsure (1)..(1604): unsure at all n locations
aaataattctgattctccacgattcccctccgaatatttttgggtggaaaagcaaacaagacagcacaaaagttcaatggcataattaatttaatcaattatcgaacatactaattcattgcacatggtcgcacgccatacgcctgtttgcagctgcatggttgcaattatttggcctctagctgtttgcatctttcctcccagatcaagcagtgattattgttgtgtaaattacacaacaagctcaaaccaaagcctaatcatcagtccatcacaaatcatcagttaaatatcgaacaagcatagccattcaatcatagtaaacaagagttgacaatccttgtcctagttaaaggcttgaggcactctcccacacacgagcaggattccagcaggaaagtaacaaataatacatgaggatggcgatagcaatataagtaaacaaagggtaagcaaagacccgacgaaaggacacaagaaaatggtccttgtacaagcatcataactacccccagcggttaagagacagacgactgtcactaggatctttagctagtgctcatcctcaggcttggttgcatccctcatttcatcacctccatcgtcctgtacatatagaacagttagcaccagtggcaatagtatggcaagtgttgtgttcataagttttttgcattttcgactagcatatacaccgatctacctgcatatcagaagtccacaaagtgagattgtcgcgaagaagctgcatgatcagggtgctgtccttgtaggattcttccccaagggtatccagttccgaaatagcttcatcgaaggcctacataaaccagaaagtatgatcacatagtgaatgagtgaaatacaacatgagctgcctattatcagtaatttagtttttctgttgtacccaaaaaagtttcacagaaatgtatgaccttggacaactagacttctgaaggcaggaattcaaagcaataataccactagaagatacaatgttgtacatcaatacatgcatatcatcaacagcatgggactatgtcccttatagaattgactccaaaagaacacttgaggagcataagctcattgcaacaaacatatacagctacataattattggcattcatgagcaaacaagtttgtcaggccagacagatgagcggtatggtacacttcttttgttaactaagcaacccatgccatgacttaagcctgcacatagcaagcaggcatatgggccaccactctgcaagataacagcggtcacatcttggatgcatgcggcaatttgagccggcatggatcacagattctcacagctaatacaggatgccaacttgccaagcaaccatgaccagatatccaaagcagctaaagcactacggaatgcaactgtaactgaagaatttcacactctctgaacactgtaggctcagtgaggcatgaatcatacggaagcaagcattacaagtctacaagatctaccttggcatgaaaaaaactctaaatattggaggaccaattggacaaagaaannnnnnnnnnnnnnnnnnnnnnnnnnnnnnnnnnnnnnnnnnnnnnnnnnnnnnnnnnnnnnn

SEQ ID NO: 36473 - DNA, 755 bp, Oryza sativa
ccaccactctgcaagataacagcggtcacatcttggatgcatgcggcaatttgagccggcatggatcacagattctcacagctaatacaggatgccaacttgccaagcaaccatgaccagatatccaaagcagctaaagcactacggaatgcaactgtaactgaagaatttcacactctctgaacactgtaggctcagtgaggcatgaatcatacggaagcaagcattacaagtctacaagatctaccttggcatgaaaaaaactctaaatattggaggaccaattggacaaagaaactaataaatcagctggaaccttaccattggcaagcaacaaattgtagatctacacactgttctttgaactgactaactcggaaggtaagcaaatcacctgcttggcgagcgtgcacgcgcggtcgggcgagttgaggatctcgtagtagaacacggagaagttgagcgcaaggcccagtctgatggggtgcgtcggcgacagctccttcatggctatgtcctagagaaaggaaaatccccaagatccaaaattatttttagtcaaattggtcggataggtcagcaagaaaagatgggagatgttcgtggaggaagagtaggggtacctgcgcggcctggtaggcggcgagggtggcgtcggcggcgtccttgcgctcggctccggtcttgaactcggcgaggtagcggtggtagtcgcccttcatcttgaggtagaagaccttggcgtcgacggcggc

SEQ ID NO: 36474 - DNA, 3154 bp, Oryza sativa
ccgccgtcaccaccttctccatgaactccaccatctcctcgtacctctccgcctgctccgccagcttcgccatgtacaccatctcctccctcgtccctcctcccgccgccgccgccatcgtctctctctctctctcttgcggattcgggtggagttgagttgagcctgtgagtgggtgggggcgaccagaagaggggaggaaccgaggaaggagaagaagtggggaggagcggctgcggttttaaaacgaggtgtggtgtctgtggtcacttttgcctttcttttttattatcgctttctctctttctttcttttttgtccctttattagtttttttttccttctgttctgcgccgtagtagtagaggtgttggagataagaacgagaacgagggaggggtgcgagatttgtttcagttaaaaaaaatgatatccatgtgttagcttctgaatagctggattttttttcctccctttgggaggggggcgagattggacggatctttgtatatgtagcactgtagaataagtttatctcttgtcccttaacttgtcaacgaatcttatcttcgtccttcaatcgaaaaaccagagataataggtctctcaactatcaaaactggtacatatgatgtccctcggcagtttagatggtggttttggctgacgtagtggctacgtgactgatttgactcggttttcatctggtgtggtattgacgtggcgcttatatgtcaatttgatccggaaaaataataaaacctgtgggacccacatgccagtttcgtagacaaaataattaaaaaatggtgagacccatgtgagccccacatgtcattctcacacagtatcacttttccttgccaagttatagagaaagattttaagtatgtctccttgaactgctacatcatttgttccgtgtccgccttctgctcatatgacagatcttcagccttgacaaggacgatgttatctttgtcaatttctgaagttgacatggtgaatgaatgttttcatcccactggacgtgccaaaagcttgttactgggaaaacacgacgacatgggagatctgcttagctccagtgcaagtcaatggcctgcctagtgcgcttgtagggcgtgccagttagtttgatcctgcaactagcaagaaacatagaaacatagttagggtgtatttggttgtgctgtggcttttggaaaaactgatgtgggctgtggaaaagcagttgtggaaaaagcagaaggccgtttggttagagcagttgtgaaactgtaggttgtagaagaaatacctgttgtcggtgatataggtccggggtaaaaaacttaaagggaagaagccccccccccaactttcacgtggcgctccccccaccccccgagggggtcggtcccatggatgggtggcagtcgccccttccgagcctgaggggtcgggctaccggcggtcaccatgtggccaccgagcgtatgaggttaggtggacgctccccggcgtctacctaatcgcatttagtgcaagcggagcgagcgcaccacgctgcattaaatgtggcgtgctgcgtgcctgactagcatgcgaccggtatgtgaccggtcgaataacagatgggacggcggcaagccacacgcgttctacccgagtgtcaggcggcgtgcggcaggtatgccccgtcccatcatgatgatgagaggttatgggcctctcaactgatctggaatcggcttgaccgctctggacatgcccgagattgtgttcctggtgcacgcgtgtccccaaatccttctccattaaatgcgtgtgggcctacgtcacccgtgtcagccggcatgatttgatgggccccacacagcagctgacgtgcaaatagcttccgggttaaggcacgagacacacatttaatgtagagaatatttttccctcttcactaattgtcactcacagcgcgtgtgggaaccccttggagtataaaaggaggtccatgtcacggtcccccactcaaggagttcatcctccgacacctgtaatgcccctaaaggcctgtgggactatttatatgcaaattactcgtgaaaacctattccgtttaatattgcatatttaaatagctaatttggaaagagaaaatatatgtttccatgcatcaaagtaatatggccaacatgaatagaacaaaacataaatggtttatacaatgatgccatatctcaaaataactattctcctcttgcactaaccaaccaaagcatcagctatcctagtacaaatagtgttcacggtatcagcattctcaacatcttcactctcattgtatgccatgtcacttgtatcttgtactccctccatcccaaaatataagggagtttggagggatgtgacacatcttagtactacgaatcggaacaggttatttgttcagattcgtaatactagaaaatatcacatccctccaaaatcccttatattatgggacggagggagtagtaagtagtccttgtcagcatcacatctctcaaactccttatcacgtaaattgctatcacggatgaagttatgcaaagcaagacaagccatgatgatatgattctgggtagtaggtgagaaacttgggatgcccttcaaaatatgccacttttacttaaagactccaaaagacctttcaataacattttaagggaggaatgtaagaaattgaacacctcgtactttccttgaggaggtcccgaacgatgccgaaattccggtatatggtatgtggttcttttgtaaggtgcaagataccctattcaatttggataacccgagtcgactagataatattttcatataaaacgaagttagtaatgcaaataataatactagggtacaaatatcaaaattaatgaaggaaccatttatacctgcaggaggcacgggaaatgaaggaaaatttgccaatgcacgagtgaagatgcgcgagccgggccccgacgagcggggtgtcggcgaccggtcgaagggagatggggaatggtgtcgagggccgcagtcataagtgattttgaaagtcaaaagtcaaccacagaatccaaaagccataagtgattttgctttaaagctgcttttttttcgcctggacggtgcgctcctcttcacggatgcgcga

SEQ ID NO: 36475 - DNA, 677 bp, Oryza sativa
caaatatatggttagccaacaaattatcatcaattgatcgttatcagtgtaacgaggtcagcggtgcttcattcacctcctactccatccggagtgggccaggtgtcagcatgtacgagcagtgcgtgggcaatggcccattcagtagcacgcggcatgcccggctggcacggagctgggccgctcacttcggacgttggggggtggtgggcatgtgggccgggctccgacgcggacgtggcgtttgtttgggcctccaacttgttgtggtggtgggaatttttttatttatacatttttttattaaaatatttaaaaaataattttttgtttcgaaaatttataaatctaatcgcctgctgtctgcccttccagagagcggcaagggatctaaatgcaaaatttttatttatgttcaaaccctttccaccggttttaattgcttaaaaactaataatgcttattcgatactctaaatgattttaaatgaaaaagtgataaactacaaagttatagatctcatcaagatctacaacttttatataaaatttatctccatccaatgtcgtttgaaatatagatatgagatttttttaaatgtgttttatattttgtaacgaatatttggatatctaaaacatcttaaatgaaaaagttgttaaatacaaagttgtaga

SEQ ID NO: 36476 - DNA, 772 bp, Oryza sativa
gagcctcttcctctgccaagacgcagcaaacaaacagcacatcggaagccaagccccaggaaagaggaacgcacgagcagcatatgtcacagagggccagcgtcccacactcctcctccatagccttcgccctccattcccatctactcgtctccagtgagatgtgccccagctcctattggcagcaataggaatagaaaagattgctcctttcttttgagctttcttgcaattttggtcttctttccttttgatttggtttctttccgtccgatttgtgaagaggaggagcaatggggttcaagggatttgtggagggtggcatcgcgtccatcgtcgctgggtgctcgacgcacccgctcgatttgattaaggtgaggatgcagctgcagggggaggcgtcggcggcggcggcggcggtcgcgccggcgcaggcggcgctgcggccggcgctggcgttccacgcggggcaggccgtggcgatcccgcatgacgtgattgcgccgccgaggaagcccgggccgatagccgtcggcgcgcagatcctgcgggcggagggcgcggcggggctcttctccggcgtgtcggccaccatgctgcgccagacgctctactccaccacccggatggggctctacgacatactgaagaagaagtggacccaggagaacggcggcgtgctgccgctccaccgcaagatcgccgctgggctcatcgccggcggggtcggcgccgccgtggggaacccggccgacgtcgccatggtgcggat

SEQ ID NO: 36477 - DNA, 8269 bp, Oryza sativa
tagcctgcctccccatggcatatgttccttctgttcctgcattcgaacgaatttggatggatttgatcaaaaacttcaatggaatccgcatttttaaatttcttgtgtttaaaacgtttccagtgtctcatattatttcgtcagtaatacagtaacctccaagcatgttggatcttggaacgtggcaacctcaagccctcaaagcttaaactgaattgaatattccatctcggtatttttagatgcagtgcacacaaccaagaccaaggtgatctagtagtgtttgaaacagacaagaactattctcaaacgcaattgaataatcaatcaacaaccaccctcccccagttcgaccctactcaatgatgatggagtaaattgctaatctaaaaatcataggattccgcgtgtgcgagtgagttccgctaattcagcagcaaccagtaaccagaaacgtgtctctcgcgccgttaaacatttgggcaggacagtgacgtgcatgttcctggccataggaggcttggggattgggacctgggggtatggcagtgacatttcttcttttttcccctcttgtatgattgcatctttgtatctaaatcatgtgtccatgttcacgctgcaaaacaaaatgtcaccaccacgcttggtagtggataccgatgcaaatcacacaagcctataacaatggtggtaagtgcagccatgacataagcgctttgctgtcaattagtacaaggttagtaccaactaaacacgaacagcacaggagccgttcgccaatgctttgtctgcacaatggatgccaactttggccttgtcagcaacagaacaagtgcaggaactttaaaaggctagacaagatatccgctgtaacaaattggatccacctacggacctaccaaccagcaacaggcaaatttggccgatccggcgatgacctactttgaaacacgctagttttaggcagcgttcgttctgggagattggaggtagaatgcacatcgttttccgcgtgcacgcttcctaaactattaaacggtgtgttttttgtaaaaattttttataggaatgttgctttaaaaaattatattagttcattttttaaatttgaaataattaatactcaattaatcatacactaatagctcacctcgttttgtgtatctcccaaatcttctctatctcccctttctcaaacacagccttaaatgccaatgcttttttaagacatgctttttagatggactcgagacacgtctgaaacactatagtttctaattctgaaatttcacaggacatagggaagattcatgtgttacaaacaaggactttgcatcagagctttctagtcagtaataaaaaaaataaattgcatcaattgcagcagaggttaaaatctgtactagttttgcaaatataactggtagtcatatcacatcttagaagaaaatgtagacgaggttagctattcaccttttgtgcggagtttgagcagaaaccagttgtttctcttgagaaatcacatgattgtccttcaagcacagcatcctggttcaaatttagcctttaagctttggcttcccaaccttgcatgcaaacttgttctgaatcatgctgaacaggaaacacatagcgtcgatttagatgcaaaggactacttcttggacatgtaacaagcaacagaaaattgtctgtcaacttgcattagccaattgtgggaattaaaaaaaaaagcaaaagaaacaagcggcaactgatgacatcataccaaattgaccggtaccataagaatatgcacaacgaaagcagtttgagacatgatggactgattttccagatgcatttgcaggacattagcagcagtgttttgatcggccatacctttttggaactcttacagtaaatttagatcaacagcttttcggagtcatcaagaatatttaggatctcactgacatgccttattaacaacccattttcacgtcagtgtggttggaggccattaaactcagtagagacctgccgcaagtgcagttttgcaaccccacctgcaatacatcccggcacctgagccctgaaaattacattgtcttgcttacttaaagaacaagaaaatgatcgtcattctttgatgcatgtgaactgagaggcatattatcaaggaggttaactttaacctcttgccctaataggttcaagtcctaggatcaacttggatgaccatctcatttttaattgaatgacaatattcacattatccaagccagtttttcttttactctttatcgtttcaataaaagaagattctggaagcacaatattacctcccacagtcccactagagcaatcatgcccatcactcaacatcagaaaatatgtcaaactcaacatatataacagtgtcagcttgataaacagcttgcttcggtaagtggcatattatcctgcatatgacagtatttcatgacatattacgtcatataagttatggccaggctgtactacaaatatccatttatcaagctctaatcagttcaagctagaaggtggcactggccagtagcaatttcatacaaatggtaaatgtaagcttgttagcaaaagattatatatatatatattgtttaataggagcatgagattgatatttaggcatgaactctctctagtctcatttggacaagaatatgattgatgtagatcatgtaaaaccaataaaacagtgattcagaaatcaaatgatggtgaccacgaacctacaactggtcctgtatcaatttgatttatctgaaaattctacaactattctggtgttaagtggatgctgattgctcaagaaattaggtatacgcaaatatctgaaaaatggagggccacaagtctctagtctacagcataattggagtgggcttcacaaatatttaactgtgatatatttccactaaattgcctaaaaaggaaattgtttcattattgccaatttgatgctaataaattttggccaaattaaagtgtcatgtcacaacataactccaatatgcctcaataaatctttgcaactgttagaaaattggctacataatgtatttactcttatccacataagtaggcattctatgtgcgaaccagtaaaaacagagttcacaccacaggtccattgcctaccattttgatgaaggatagagatgtgtacctaaataattactgaatggtttccctgccaactccaactgaatttctttgtacttgagagccaatcatgatccttgactggttctatcattccactccacgatcatgataacatgatgttgaagatggaacatgcatgatgcatcagtaaggttaaaaatctgtgcatttgcggaaataccagaaagggactgatactctaggattctagtttctacaatacaactttgaaacaggtgcttctcatctcaacacaggtaggggcttcaaagaagcatactgaaatgagaaggataaattacgcaatacaagtcaaatttaactttgaataaaagaagcgtcaagttttaccttcagcaggaacatatgtgagaaatctaccagattataggtgcaggttctgcaatcatgagaacataaagcttcctattagttggtacaactataacagaattctgaagtttgcatcttgcacttttgcagacacttgaaggatcacactatttgggctaaaattggcctccacaacttgttacccgattggacttggcccattaaaatgttttttcagttgccaggaacccagactggtaagaagatggaacatgcatgaagcattagtaaggttaaaaatctgtacatttgcggaaataccagaaagggaatgatactctaggattctagtttctacaatacaactttgaaacaggtgcttctcatctcaacacaggaaggggctccaaagaagcatactgaaatgagaaggataaattacacaatacaagtcaaatttaactttgcataaaagaggcgtcaagttttaccttcagcaggaacatgtgtgagaaatttaccagattataggtgcaggttctgcaatcatgagaacataaagcttcctattagttggtacaactataccagaattctgaagtttgcatcttgcacttctgcagacacttgaaggatcacactatttgggctaaaaattggcctccacaacttgttaccctattggacttggcccattaaaatgttttttcagttgccaggaacccagacatccagacaaaagatcgtaatcttttcctgtcttacaccaacctgttacttaacaactattcaacatttctaagacatgttgcaatatttttttatcagctacaactttcctaggtaggcaagctgacacttattcgaagagttctcacatgttaataccataaagtcaaacaaaccccttaaataggtcagaagtagagagaaaaaggttaatcttatttcaacttttcacctaaaagccagagcacacgtggtaatttgtgtgcaactgtgctatgggtatgcaaacaaacaaaagccatgcacatcaaatagcaaattactcagtgatacaaattttattcgtaatgccatctgttactttcaataattcaaggcactctacttaaccttagaagactcccttatgctaattctgcaatttcagaatggttacagcaatgtgggcaccatggtttgattatgccaaagacatactggtgactggtgagttctgtactggccataagcatagcttctcaacattactacctagaaggccattatggtacataagttgaatagtactgtaccagtttatggtagtattaaactggtcaagaatatttcagacttctattctattggcattcatattcgcatgtactagagattaaaaaattagccatattgaaggtggctgcaaagtttcaaacaaaaaaaaaggtggctgcaacctgcaattatagcagattaatattggaggatgatattcaagagcaaattcaaaataggtacgtcagcataagaaaagaagtgcattattgtgcaacaaccttatgttggtagcacctgacaagaaagcagctggtgtatttggtacttgtaaagaataatggaagcttcaatcttggcgcaaaccaagtttcaaacctggcgcaaacagtgtgtgttttcagaaaaaaaaaacgttttatataattagcaaaaacataaacgtttcacatcctccaggctacaagaaatgcttgcagcggtattcaaaggggtaccatcaagtgtatccatgtgcacacgctgaagtgcacaataacataatgaagaaaacaatcaaattgacaaccatgtggaaaagctatttcctaaatcaaaaggccggggtactgccaaaaggatctgtgggtttttctgctcaagtgcaaactgattatagttaacctatcaacttctctgtcaaagctctacctttttgataaataataaagaagctctggtgacttccaaaaagagtcctagactactagttatctagtaggattctaggtcaaagctgaattcacaatgtaatgtgactttagaatggcatgtcttcattgaacagactaggaccactaagaaagaacaaccgtccttcacattgctcagaataactaaaccaggaatgaggttttaatagccgacgttctttttctatcaatgccagtctggattgaggtaacttttaatcaaaagaagaactctaacatgcctagaatccatcccaaagaaaggaatgacgacctcatgcctcaaactgatacaccacccaccatcaatattcaattcttcccatcaggcgtcggagctgtgagaggcatatcccacctaaacaacaccttacacctacagcacgatgacccaattcataaaccccccaaggccccaactccccccatctccaggacgcgaacgcgcttgaccctactgccgcattacatcgaacacctagcgtgcgccccgcccgccacaactccacccacctatccgcacatgcggcgcgcgggcagccgagtaaatcgccccgcccccgcatccccgaacaaccgccatcgctgctggtttaagcacatttgatgcatcggtggtcctcgcgcctggcccgcgtgcgcgcgaaaagggaccgcgaccgaatctctctggcttctctagtaaagttggtggatgatccggagattaataaacatttaaacaattgggatcgaggtcggtggtaggatgggttgggtagccctggtaggagttgaccgatcgatcgatcgatccaataaacaactgtttgacttggggaaattaaaggagaggagaggaagagatcgtgcgtgcaaaatgtgatgcggcggagtccaaaactagtcgcctgggttggttagggcgactagtcccgataggaacagcaagcggtggagagaatggcgggtagggggtgaaacgatcaccttgtttgtggccgccgacgctgccggcggcgatgtcggcggccggatcggagaatcagccgtggtggcgtggtgttggtggacgactggtagacggtagtggcgggaaggcggagcagataatgaattgtgtttagggcaaatttgaattaagacaattgaatattattatccaattgtagtgtaaattaaggcaaattgaataatattattatcctacagtctgcaaattaaggcaaatttgaattcacctatccggttatcaaattgtactataaaagaatattgttaagacgaaatcggataggtgacactggtacttttataaatttgaattgatctattatcgttaaggtttctgtcaatatcttgctcccgattatttcttctctatctccggcgcgcatagtacaaaatgattgtcatagcggctgatggcatggatggccgtggagaagcagagtggcgcaagcgcatcgcagcgatgtgggggctcgagctcacctggcgaggcaacgatgtacggacttaagctcccaagggcgacatcgatgcggctttgagaggcagacaaagctcggtcacactgaaggacaatagtgatagtggttgctggagcgagctcctaatagcgatggcaatacaacttggagaggttaaggggagctcgatgacagtgagtagaggcgattgtggttgctaggacgtcagtgcatcccgttctgcctcgtcgtcctcttgccattgtcggatcccttgcctcctccaacaactcctggatctcctcctgtcacacctcttccacctgtcgctgtcaaatctcgtctttatcatgtctactctggtcgccattgttggatcccttcccgtccatctgtcgctggccacctcaagaggaagaagttacatgctttgacagctattgcacgtttcttattttagaatagtgaagtgacacaaatatactttcaattttgttagtgacatttttctaatacaatgtttcagtggcatgatcaaatttaccctcttgtttacgatgaagtctactaatcggacaaaaaaataatgaatgaacattcaattaaaggatatatgatagattatcttattctacattaatatttagagggtaacggagttaaaagttattttaaatactatcccaagaatgtatgtatttttttatggaaatgctaaataccgggataccgtttgctagcgttcaggacgggatcttctcccagcctcacacagctacagataagaatggtgtggagacaaccaggttccacggcagccattgcagtagagacagtctatttcacgcgaggttgcggcatggcgtctgtcgccgtaggttgtgggcgtcgccgtcgtgctgctcagctactcacgccaactgaggacggcgatggcgcgtggggcttggccgccgttgctgaatcgaagagaggtgccgtgttgaggagcagcgcgagctcgacatcggagctgatggatgtgggttgtcacgacgatcggggatagagctatcgtcgaagtggatagacgcggagcaaggaggacacagccgctggcgatgagctccgacatggcatggacggtggaggatgcggccatcagtgacgagcttcggcgtggggcctggatgacggagaggacacgaccgccgccactgagctccgacgtggcgtggacggtggaggatgcagccgccggcgacgagcttccggcgtgagacgtggacgatgggaccaccggcgacaatgccttgg

SEQ ID NO: 36478 - DNA, 2127 bp, Oryza sativa
ggaccacggccaacaatgcattggtgacgggctcctgatacctcgcaagtatcacctaatacgtggtaagaatcgcttgatacttgacaggtataacctgatactttgcaagtatcacctgatacgtggtaggaatcgcctgataccttctaggtatcacatgatatctcgcaaatatcgcctgatactggttaggtatcaggacatgatacctcagaggtatcaggacctgataactaattggtatcattctgtcctaacgggattccgttgaatagcagccccgtttttaagaaatcatgaatcctacaaacttagcgaatataaacatgatataatctatgatatgtaagtggaaaagaacgaagaaatttgaataattttttttctcataaaagaatgaatttgaatagggttgacatcatgtcatcactcttaatgtctttttcccctatgatgcaagtttcacctattcgtgaattatcaagacataacaatgcgatatactaatcttcaggtcatgataatatattatttgactcacgaatggtgccaactccatggacggcataatgtatgaactagccagctaggtatatttagtttggcacacagtttcaaacccagccgcaacaaattctttcgttatcttctccatgcaacaaagaacaaaacagaaggaatcagctaacttaaaatacaatcaagcatggaggagaaaacgtgtgtcgccatcatctgacggtcgcaggttagcgatggaaatatggaattatctgaaaccttttcttcctgagccagaattctgtacgcaagtaataaaaaacttcaggcgattagcccccaaccaatgctctctcgcacttagctgatggaccacataagcattagcatatcaaagaaaagtgtttatctgtcccagaatggcaagagaacaaaaaaactgaaggaacttggcaacaaaaaggggcaaaatgcatccggtgagctttacagaactttatgcactgtaggttatagtctgatagagactttggtttaatctgtagagataacgtgctgcaaatacaagttaaaatactcttatacgaaaaatacaagctaaaatacagtctttctaaaagttctagcagaaattggtaagaaatagtcatgacttgttaagacaataataataaaatagttgaagaaattagataagagatagttgtaattagctgagatgaataaaataagtagaggaatggttatactgcggtacaaattttcaatctaaaaacagtttggagaaatgcttatattgcaaaggctgcaattatcgaaacgaggaggttgcttctgcaaacgtaacctgaaaaaaaaaatctcatattctcatttgttacgcacctaatcccgccaaataagtttgatgagaagattcagctcggtgaaatttcgctaattgcggaaacaaatcgccctgctggtcgttgcatctaatcgactgaccacaaccgtggaaagcaaccggattagttgcgaaatcaatgaatggtttgattcgtcaggcttttggactcccactgaggaaaaaaaaaggtcagtgcatgtactagaaaacaacgcatgcttttgctgcagtattcttcagcacatgtacatgttgaattcgttggaagctaaaccaccccacaagctattggttttcgggaggaaatttcttcagggtacgagcttgattagcagagctgaatcgtatacaccacgtcttggcatgctcttggacttccatgttaacataattcaatgttgccatgttggcataatttcaattaccacttttacctgaataatctcgtctgttactaggctagcagattcctgagcagagtattagctggtgtgttgttcgttaattgggtggtatgaaaatttttaattgtttcgacgtcgcatcatgctgatagacagttgttatacaaacagcgatactacggcttggttcagttcccaacttttttttaaacttttaatttttaatcacataaaaacttttctaacacaaactttcaacttttttgtacattattttaattttagcgaacgaaacacacccctacagctcgtggaacaaatcgggtgatc

SEQ ID NO: 36479 - DNA, 530 bp, Oryza sativa
tatacgatgataaattaggtcagttgattcagcaagaagaacagcataaaatatcaagtgatgtccttcttaatagtagttacagttccaaatttctgcatcatgcatgcatgcatgtagtagtatgatacggccaggtctaccaacacctgataacgttagattcttcaagggacaaaagatgtcgaacttgacgaaaggatgattccacgatcagtgtaggcctaccatgcgtccatgcatggcatggcacagaaacaaaatgaactcttgtgtaatgcgaaaaacatgtcgccgctgttgcttgtcggtgagctagttgagctgatcgctctcgccttacatcttttcggctcccgggagctggttccttttggcgagagcatgattgctggaacggaggcacgatcgggagcaagcaacccggaaaagaaaagggaaaagggggacaagatgcatcaccaagcaagcaagttttccccctgtggacttaaaaactgcaaaatgaaatggggtgtgatgccaagtga

SEQ ID NO: 36480 - DNA, 437 bp, Oryza sativa
ccgcggccgccgccgcaacgggcggctacccgcagcggcccctcgcgcttgtcgtccacctcccactcgggacgcgacgagggcgacgacatgtccgggatggtcggccccatggtgattggccccatggtcggcatgtccctcggctccgccggcccctccggctccggctccggcaagaagcggttccgcacaaagttcacgcaggagcagaaggacaagatgctcgccttcgcggagcggctcgggtggcgcatccagaagcacgacgaggccgccgtgcagcagttctgcgaggaggtctgcgtcaagcgccatgtcctcaaggtttggatgcacaacaacaagcacaccctgggcaagaaggcgccatagctaagctaagccaagcaagctcagctcagctcatctcctcccggtgctaggtacctgcactg

SEQ ID NO: 36481 - DNA, 544 bp, Oryza sativa
  unsure (1)..(544): unsure at all n locations
ttgaatcacattttgttgcctatgtattttccgatctacctttatattaacatattgcaatcatccattgtacaaagtatgcttttgtaatataattggaggctagttctagtaatcagtatcatttggcaaacccattgaatgtgtaatttcagatgcgatatgctatcatgcttttcaggtacattcagctgattctctgttgaaactagtgtcagagcttaagagaacagctatcttttctgggcttgcttctttaactgaaaatgtggataggcggattgaaatctttagtcaacaagttgaaggaacagagagaatgctggagaggattgggcaggaagcagcaggaagcctcaaagagttggaggcacattactactcatctgttgtgcgaacaccaccggatgaatgaggtaaattctacctttctctgagtgaaagatgtttccttctaattgctggaggtgcgtagttgcttannnnnnnnnnnnnnnnnnnnnnnnnnnnnnnnnnnnnnnnnnnnnnnnnnnnnnnnnnnnnn

SEQ ID NO: 36482 - DNA, 544 bp, Oryza sativa
ttataaatgtctatatacacgctctagaacaattggattttatttagttgaattttgccaggtgacattcgtcttgtctctagtcctcacttgattagtcaacactatagactcaaagctccaaataattggtgtgttgatttgccgggtcgattggatctaccacttcaatcgcagctatttctttgtgcttaattacctattcgcaatatctaattgcatttatcatgttcttgcagtgttctctcctttgcattgcagggatcatcaactgcgtgtcacaattggtacgacatcgttttatggtgtagcgattgcatgacatcctgaacttgctctggttgatagctacgtcgcatttgattgaagtgagagttatcccctcaccagaagatcaggctatgagagagagcttcatcaaggagttactacatgtggtatgggaagtctgatgcaagtgcaatgtgtgagccttctgcaacgtggtagcatccctacctaccataatagcaaagatcaaagaaaaagagccagtgacttcgat

SEQ ID NO: 36483 - DNA, 1084 bp, Oryza sativa
  unsure (1)..(1084): unsure at all n locations
tttttctttgatctttgctattatggtaggtagggatgctaccacgttgcagaaggctcacacattgcacttgcatcagacttcccataccacatgtagtaactccttgatgaagctctctctcatagcctgatcttctggtgaggggataactctcacttcaatcaaatgcgacgtagctatcaaccagagcaagttcaggatgtcatgcaatcgctacaccataaaacgatgtcgtaccaattgtgacacgcagttgatgatccctgcaatgcaaaggagagaacactgcaagaacatgataaatgcaattagatattgcgaataggtaattaagcacaaagaaatagctgcgattgaagtggtagatccaatcgacccggcaaatcaacacaccaattatttggagctttgagtctatagtcgttgactaatcaagtgaggactagagacaagacgaatgtcacctggcaaaattcaactaaataaaatccaattgttctagagggtgtatatagacatttataaaggaaaataaagctaggattaagtgctagttcatggaggtggagagaagcacttctaaaatgggcctaacctattgcaaggcccaaggcccaagttcggtttcaacaacaccactttattgttttgatgattcccattgacttcaaatgaatttggatatgaaaccatatgcgtttgacaggtgacaagataagttttccaacaagtctaagattatctaaatcggagttaacatgaatgtgctaggttcgtttaaagttagtgttgtctctggaggccgaactggacttggacttggaattgtcattggaacgtgtgaagttatgtgcgtatcctatgaagtgatgttctcgagagtttaaaacactttcccatcaagtatcattttaaatatatgaagacatatatatagttgccaattgtttcgacactagcaatcataataagaacataattattgtttaggttaaactaaatactttttttaacagccaacactagacggtgcaatgattcannnnnnnnnnnnnnnnnnnnnnnnnnnnnnnnnnnnnnn

SEQ ID NO: 36484 - DNA, 582 bp, Oryza sativa
tgcattgcagatcttgctgaaagttggaagtacaggagccgcttgtggtatggcgttggaatcccatccaaatctgatacatttggtggcggtggaagtggttgggaattttggaaatctgttctggagaaggactcaaatgggacttgggttgaccttccacttgtgaagaaatcagttgcagtgctgcaggcattgctgttagatgattctggacttggtggtggtctaggtattggagggggctccggccctggtatgggagttatgactgcactttatcagttgctggatagcgaccagccattcctttgcatgctcagaatgactcttgtttcaatgagggaggatgacaatggtgaaggtgatgccttcacaggcaacatcagcataaaagatgtcatatcggaagggttgggccatcaagctggaagcatgatgccacttgacagcaacaatcgctcatctacaaggaaaccccgatctgcacttctgtggaggtatgcactatgcaccatcaagtatcatcagttaaaatcaaagttagtggtatgtgtttaactgcaggataaaaaatggaag

SEQ ID NO: 36485 - DNA, 1119 bp, Oryza sativa
caaatatgtcgctattcttgtctctggttttgcgttggcgcggaacttacagcgagttgaggtgaatccacttggaatatgtccatttctgatatataaatttaccataaatcatatgaactctggaacatgcagatggagaggcaaacacaagctgatgtgctgaatcgacatcgggtgtcaactggagttcgagcatggcgccatcttcttcattgcctaacagagatggacagactatatggacctttcggtgaacccttgtgtgctcctgatcgtgtatgtacaactttttctaatctttcttcttttttttttgcatatgtgtgtgtgtgtgtgtttttctgccctgttccccagcaaattttgtttccagaccagcgcattctggtatactagcacccttacaaaagaaacaaaaatagaaggaaaagacaacctgcaggacatcttttgatgtttcttttctttcctgtatttcagattttctggaaattagattttactgaaagttcttcaaggatgagaagatttatgaaaaggaaccacaaggggtctgatcatttgggtgcagctgctgattatgaagagcgaaagctaagtaatgttgcacaatcaaatgaatgcaacccagagggtacagaacctttagtaacagacacacttccatcaactgcacctataataacggctgaggccatgtcagtggatgacagaaatgaggacaatgagcagttagaatcagacacaactcaaagcagtgttgacgatcgactccaacaagcagatcaacagtctgtgaaaggatcaatagattcacgaggttctggcatttctgctgatcgcaatttggttcggtcgacggttattgcacctggatatgtgcctagtgatgctgatgagagaattattgttgagcttccatcgtcgatggtgcgaccattgaaagttgtacgaggaacattccaagtaagtaattgatatttactaaattttgatggtgccatgaccagttcttaaaaaaaaataatcagaaagtgaactttaattttattacaacttggctcatccacgatctgtcatactgatgtgttctgatagactccagaatgtcaattt

SEQ ID NO: 36486 - DNA, 416 bp, Oryza sativa
actctggttttatcaattcttattttgctggtactcttgggatttttcagtgtgcttggtcccattctcaatatgccaattaatgaatctaagagacaaagggtgttggttgcttgctctattctctattcagaggttagttttaatattcttaacctaagcatatagtttgtctaagtgattgtggacccatgctacggagtggaacatctaataaaaaatagtgcaatattttagttttttttctatcgtttatcttcaagaaagttctacagattatatcacctgaaagtagatttctttctctgcaaatttttaagtgactagatgtatgctcacatcttaaatctattttctttttctttttctgttaattttctcttttcttttctaataatttacttttaaaaaagaga

SEQ ID NO: 36487 - DNA, 833 bp, Oryza sativa
actgtttttggtaggtgattatcttatctgtcatctcatctttaaagtgtaatccctcttgtttcttacaaggtgctagttttgcgtctagaatttctgaaacaaagataagcatcagttggtgttcccaacttcccaatgttcccatcagtccgctatcaaggcagcgtacacgcaagtggattttacataaaatctttgaccaattaacggcgaatagtctcagcataacctctatgtgatggttgcatccgtatactcaaaacatagccaaatgccaaaatttacatgtacaaaaatggggttgctcacactggttcaccctacagagaattgtaagacagaaaactgtctgaaccgagcaaccaaaaatggatacaacgctgcaaacaatgtaaaatgactattcacccattctacaaaaagaaaaaccatcgggatttttacagggctactcgataaagttcgtttactcagcagttcgctgaataatatgatctgctggatatggtgtacgacctagcctttgctcagcctaactcgcaggtcctattacttatccactttgtacagatagtacatctcgagccatcgattcattatgctaacacgaacagaaaatgatctttaagctagtaatgatttaccaaaataaatgctttttgctcatgactgaagaagcccgtcaccttcccaaccaagacgtaacatctgatccactaccttcaagctcaactgcaacattaccagctctattagaacgaaggttaagtggcaacgtaagtactttatggacaagcaagtgctaaatggattttgatacatcaggaatt

SEQ ID NO: 36488 - DNA, 1564 bp, Oryza sativa
tttatggctgaacgcccctttagttgagttgaaccgccggtccggtccctgtgatcttcacacacatctacatgtatccagcgctttatggctgaacgccccttcagttgagttgaaccgccggtccggtccgattttttctactgtgatctccacacacatctacatgtatccagtgctttatggctgaacgccccttcagttgatatgtgctatataaattatctacaaattttggataggaccttcagttgatatgtgctacctaaattatctacaaattctggatagggctgctaaaaagaatttgctacctaaattatctacaaattttggatagggcagctaaaaagaatttctccaagaaacatatttgtttcttcttgaggttgtagctcctatctaacaaattgatgattgtacctactatctaacaaattgatgttaatcaagtcccgtcatcatcaaattgttaaccattggatgaatgcattagatcgcttttcagacgttggatggaatacaacatagagcccaacccattagtcaccgagtgagtctcttcgccttctcagtgtcaaatgtagcccacatgaatatattgacccatctgcaccatagtataaaaactcggaccggacgtcgaactggtgaggcctcggttcaccggtccaaccgcggtgttaaaatttattgtttattgcacaccacaatggtcagtgtggtgtagtggtggggaacttaacgctccatccaacaatcctgggttcgatccccatgcttcacccgatttttgaacaataaaataaaactgggccttaggacttgggcttcccattagggaagatgctgtccggtggcccagctcgtttgagccggccggttttaggagtccccgcttcagaggtttttcctgaaaaccgtcggttcacaccgggtcaactgcacgaacagtccttgaaacacaccgaaccggcgaggtccctagtttaggttttttccggttgaaccgccggtccggtccggttttttctactgtaatctccacacacatctacatgtatccagcgctttatggatgaacgccccttcggttgagttgaaccgccggtccggtccctgtgatctccacacacatctacatgtatccagcgctttatggctgaacgccccttcagttgagttgaaccgccggtccggtccgattttttctactgtgatctccacacacatctacatgtatccagcgctttatggctgaacgcccattcagttgatatgtgctatataaattatctacaaattttggataggaccttcagttgatatgtgctacctaaattatctaccaattctggatagggctgctaaaaagaatttgctacctaaattatctacaaattttagataaggctgctaaaaagaatttctccaagaaacatatttgtttcttcttgagggtgtacctcctatctaacacaataatgattgtacctactatctaaccaattaatgtaaatcaagtcccgcagcaacgtacggggcatcctttagttatacatct

SEQ ID NO: 36489 - DNA, 481 bp, Oryza sativa
gcatgcgcgagtaggttggtagatgagggcggcacccttcaatgccgacgggaacggggcggcggagctcgcggggagcatagcggcgctgctttggccggaggacaaaggcggcggcggcgggggcggcggggggtcgttgctggtggagccgagtcggtgctggactgcagggggagcccgagcccgcccaactccacatcgacgctgtcttcgtcccatggtagcggcgcggcggattctatatctaccggcgtggcggcggtttcggagagcagcgcagccgccgccgaagccaccagatgggcggcccccggcgaacacggcggcggcggtggcggtgagctgccgcccataccgggggccctggatgtgggcttcgtcgcggaggagagctgggaccccatgctcggcgaccccgcggcggcggcaggccaagaacaaacatttttgaactggatcatggctgcccccggcgaca

SEQ ID NO: 36490 - DNA, 993 bp, Oryza sativa
aagcagcatcttcgtcgaatagtacggggagaaacagtaatagtaaccaggacatggcaaggacactgccaatccgcaagccagaaaattcagagaaaaatacagcaaaacaaggccaaaaaaagagagagtaacaacaagcttaagagaaggcaacaaacgacaatcgaagaatttgatacggacagggaagaagagattctagccatttatagtggcaccgatcacatagtcatcaattggcataaaacggcaagcgcggtgctcaaataaccaaacaacttcataagaatcagcaaaggcaaggtgaccaaaaaattgcattgagctacgggaagagctttgcactaagaaacccacaaattcgcatcaaacaacaaaacaggcacgaagtcaaccctccagcgcgtgaaaaaaaaagaggagagagagctgaatcagacctcgattcaaatatactccaaagtacaaatcgaacatctacgagggagacagattttgatcattacccagcgatccaagctaaaagacaaccgtgaggctagtggcgcgagagcgacatagactcagagagagagagagagagagaggggggggggggggcttacagcgcctggacccagcgcggcgggacatcgagggaggcgatcacgacgcggtcggcgtccgacccgagcctccgagggatcgcatcatgacgcgcgtggccacgtagaactcgtaatcccggggagtgcccatgtacatcatcgccgcgtacgcgtgccgccgaggagccaccgccaccggcaccgctgccttctcacgcgccccctacggcgccggcgccggcgccaccaccaccaaagccacggcgacccaccaccagcggccgcagccccgccccatccccgacggagcaaggtcctcctcctcccccaccacctacgcccagatctggctacgctcggggggtcgccggagccgaaccgagaagcatgagccggcgggggg

SEQ ID NO: 36491 - DNA, 30637 bp, Oryza sativa
  unsure (1)..(30637): unsure at all n locations
ttccggatcttttaaacggcttgactcaaaattcttgcgaattatgtacaggtggtggaaatatttatacgggaacttgactcggttttgagggttgttgccatatcagtgatatcactccaacaagtcgtaataacgggcaacggctgtcagctttaacgtttggttttcgtaaatagtagtggtagtagtactaacttcagaaaagtcaggctcgttttgggccgggtgagcaaacctgcggaacattttttttttctagtttaaacgatatattgtgaattgtagcctaatttcgtgagctttcagcaaagccaggaaaagatcttatgcattgcatgcattcgatcattgggctgccagccagcttgtatggataggatgaagacgtcatgaagaaatggacaccccggtgaccatcatctgcatccacgaggctgaccggatggggtcgatgccatcgaactaatttcaattgattactaagacaagaagttttttgttgtaaactggtgtaaccaattcatgaattttcggaatcctaccccacaatttagtcttagagatatagagaatcacgtcgccgtctacggcgggtccagtgaacttctttttttccctgtcattttcaggggagaaaggggatgcgagttgacattattgcaaatcctggtacctaaccaagatggagactaatggagaaaatatcaggattagcacagtgccgtaatgcttgtgaattttcactggtagaactgaaagattgttcacttcataaaaaaaaaactactagaactctgcctctgatgataaatattagaagaaacggaatagcatcgactggttctttgcaactatgggagctaaactatctagctactatccagctccacgtccgggcactgtaaaattgtcgcccagggaatgctgaaacgctagcgtcagctagctatcccaactaaaactgattggctaagctgtcaatcttcaaatgttgattgttccttccatctcaccaaggaactgagaaattccatcacctacatggcaattgttaagtgaaatgaccaaagcaattttgaattaactaggcataatcagaagggcagcaaaaaagttaagcatgacaggaaggatcactacttctgatgggcctctcagcatgaaaaaggcttcagacttcttgggcacctgcgaaacaagaatcccacatccattctttcgctcgcgaagcacctgtcgtataataaaaaaaaaaaggaataataattgagttcactaacgctcgaagtaagatggatctaaaatgtggtatgcaatttctgaagaaaggtgaccttgaatgcatcttcatccgttttatcatccccaatatagataggaagaacagtttcagaatcatctagctcaagcgatcgaagcaaaaactcgacggcttttcccttgtcccagttgatcattggacgaacctctaaaacctgcataatagcatacctgtttagcatacaaatgatgaaccgcctattaggaacagtatattacattgctatctttttaatccttctaccttccgtccagtggatactttaagactaggaaaatcttttagaacattgttgacaacctgtgcgaccaacttccagttctggagggaaacaggtgaaaattatatgagaaactgtattcgagaaaaaaaaaacttataggagaaaacttgcaattgttgcaaagcgacaaggccacaagggaggcaagaatgttccaactaaaccttcttgtcgacattacgataatgaacagatacgcaaaacttgttgttctcaactgttgcacccttaatcgctttagtgacctctatcagggatttggaaacctattgtacacaggcacattagcatatagagtaatattttcaatatcatccatccagatctattgctttctgatgactgaaacaaagagtacctcagttatcatagtcagaaactcatttgcaggttgaaaaagcttggtttctttggtctgcaatagagagctcaacaatattttcaaatgatgaaacatgaagggacgtgtatgtaatgaattcaatcgttaaaaatgtaagagcaacaaatatatgtattcatgcctgaaacctaaaatgatcctacaactactcaccttttctatggactgtctgaatctgcaaaagatgctagtatgtccataccatgactccctgcatagtatatctcagtcagcttgacaaaatcaaacaccgggacatggagaggccagcatcaaacatcagatatgtgattttcatactgacataattgtcacactaaaacgtgaagaccaatacatgtaaaaaatatattcagaccttgtcgcgggatctcccactaactattgctgtagggaagtgctttgcaacacttttcacagtagcacgcatctgaaggaaggtattcagattgagaatattagtaagtggcacatacataaagcaatgtttcaatacatattttatcttacaccagctggcttacctcagaggacatgaatgctttctctggatcattcacaataggagaaagtgtgccatcatagtctagaaacaacacaaccttcttgtcttgcgcactagctacgatttggtcgaagaaacataaggcagaaggacaaatttcctgatataaaagataaacatattaaaatcctttgtagaaaacaaagagaataacagaaaaccgaaagaagcaacttactgcacgagaattctcagtggaatcttcatcagacgaaccgtcgtaaccagattcaatgtctggcttttcacggttcgatgatgtcatcattaccccgacaagtccatcaacgacttcaacaagttcacgcttactgatgtatgtcacacacaatgaagaacatggatgcttcttggatgtaaccaaacatggcattagatttgaaggcagtgccaacactggctggcttttgatcatgggattggtcatgagtggcaaccgttgctcatatccactaccaaaatgaggtggaataggccttcttcaactagatttaacccagggtcttgtcaatgaaaaaccacttcttgagtgttttcttcttggtgtaggtgcgtgcacagttgttcaacagaaagttagcagagatctggaaaaaaaaaacacaagataataatatgacgcaactaaacgcacatatactttacaatcacaaaaatgtgatttaccttcatgtactctccagttcaagaaggtatgtgcatcagaaaaatgacagccagatagaaaaggccatgtaatccgccctacgcatatacctggtcatatagcattggtgcatgcaagagccaagaggcgtcatttatcttgaaaaatctcaaaatacaagatgagttacatgacatcatgcgtacatgagcaaactcatataatggcatctatccaacaggaatcccctttgcacctagattaatcccgcagaaagtaattatgctacatcagcgtccttgtcattgaggaaagaatgaaaacaacataatggtcggcatagtaaaaactttgatctcaacgctctaaattgaatttttatcctgtgggcagaaaagtttatctcaatattttggttgaaaaggccttggagcaaagtataaacattcccttcaaataaagagcaaagtacaaatatgcaccgatctgcccacattgcagaatcaaattgttgttgcttcaaataatctgaaaatggcatgccatttaccagaaggattcagttattacgaatgcaatgccaaccatccacagtgataagctacccgagaaaacatttagcaataagtaactagtatcgatcattaacccttaatgacatggtaggtacgcctaacttctcttttgccaagtgaatcatgagggcaccaaagtcaatttgcattgctgtaaacttcgattttaaaaaccaatcatgcataatttctgtaaaaattcaatctgacggtagagaactacaaggaagtgattcttcagggggggggggggaatatccatcacaaaatagacagcacatgcattgagtctatcatggaataaatacgatctaaagtaataacgacatgttagacaatcaagttcagaaacagaaaacatcgatgcgattcgtgcgcggcatgaatacaccatgtcgcggagtatgccagaaaggtaactacaccatgaacagttccgatctagtatatatggcattcccctaaaagtattcaaatctacaaacttgcaccccggatgtgaaatatcatggaattggaaacgaaaaaaaaaataaggggggcaaaaacacaaggcgagccgacaacgaatcctctcattctcgaaccgattgagagcgcgcgggagaaaagatcgaaaagttcataataaaagggaagggaaatgagagaaacctgtgaagaatttgagatcgatgtgttgcaccaggaaggagagagaagaggagaatggcatctaggcgggggcgtatatatcgagaacggaggggtagaagggggattttgcagccttcaactaggcctgcaccacgggggcccatgggatcgatattgttgtaaggaaaaagtccacttagactcccttaattgttcatcgaatctaattcgtgacccttaactagaaaaccgggtagaatgactcccccaattactaaaaccgggacaaattgaatccctcggcggttttgaagagtggtttcgctgacgtggcatctacatggcaatgttgacttggtctgctgttgatgtgacgcttaggtggcattataactaacaacatacacgtgggacccatttgtcattcacatagaagaagaatttgtgggcccacatgtcagtctatcccttcctcatcctccccaatctcccccttatctctctccctcccaattcagcaggggggcgacggcaggcggggggcgacggccgccgagctccgcatctgggcgatgccgagcttcgctctcgagcctcggtcaggtctgagcggtagcgggcgcgacctcaacgaggaagttgggctgcgcgccatgtcggactcccagacgcagtcgtcggggtagcggacggggtcggtggtgggggtgccgaagttgatgcgggtggcgagggagaggaagaaggcgccctcgaagataaaggggtgaccggtggtggcgttgatgaggcagtcggagaggaaggcccgggactgagccagcgccactagcttcgagcacagcggcgactggatacgcgcgctgctggaggaggccgagaacgagcggatgcacctcatgaccttcatggaggtggccaagccgaggtggtacgagcgcacgcttgtgctcgccgtccagcgcgtcttcttcaacgcctacttcctcggctacctcctctcccccaagctcgcgcaccgcgtcgtcggctacctcgaggaggaggccatccactcctacaccgagtacctcaaggacatcgaggccggcaagatcgagaacgtccccgcgccgccgatcgccatcgactactggcggctccccgccggcgccacgctcaaggacgtcgtcgttgttgttcgtgccgacgaggcgcaccaccgcgacgtcaaccatttcgcatcggtacgttcgtgcgtgtgaattcccaatcttgatgtgtgctttgtgtaggtttgtgatgactgaattatttttgcttgtgatgtgcatgcaggatgtccatttccagcggatggatctcaaggatacgcctgccccgctcgattatcactgatgattaattttcaaaagaagaatatcactgatgaaatcttgcggcggcttgtgtcctgctcagctctgtagttgttactagaaaacacgagttgctgttgatctgttgtatcctccctcgacctccccgccaggcggacgcgcgataggtgcagcgtctcggcgacaaggttgcgccggaggatttgccacacgggcccacatctgcagcgcgtgatggtgtagccgttctcgccgaggagcgagcgcgccacctccaggcggtcggcgagagcggcgccgcgctccacaagggtggcgtgcgcgacgcagcagtcggccacaaaggaggagaaggagggcgacgagccgaagcggcgccacaaatagccatcgccattgccatccaccgctgccgcccgcaccaccgccatcgccatcgctgccggcggcggttgctctgctgtttttatttaaaagatagagggagaagagtgccctgacaagctggccctacgttttttatatttttccctaatcaattgcatgtgggcctcatgactaggctgacagcgagcataatgggccaagtgccacgtcagcaaaaccaccctccaaaaccgttgagggattcaatttgtattggttttagtaattgggagagtcatcctgcccggttttgtagttaagggtcacgaattagattcggtgaacaattaagggagtcaaagtggactttttccaataggctatttgggccttttgagtccacgtgagcattgggctgacaactaatgggcctcaacgtggtgttggcctgtcaagccggccgtgaattatgatggataaactgaattagagaaagaacaactgaattatacatggggcatttgaacgttgtgcttctgcaatttatggtaaatccagtcgatatctaaacaagcccaaacaatttcgcactcgtatagtcttggaagctgatatctcaacaataattgattgcccaaccactaccgaatgtgcacttttaagataagaaggaaacaaaactcaggaatatcaattagctgaatgtttcaggtttcagctgcagaggcaggcagttgaggaggcctttagttaggcttaccctaccacactctaccaaatcttggattacccagttctagctacatgatacattatcctttgtggaggttgtttgacaggtgatgttgattcagagtagagaactgcaaatgcactttgcagatggaaattttagccaattttgcaacaaactagtgtgcccattatgagttctataaatttctgcattaggcagttagttaactgaaataggctacacattccagggggaaaaaaatcctagattagtagtagtagtaatatactagtatataaaaaagggcatacccaaagctgacaccaaaaagaaaatccagaggactcacatcggcaacgttgatgtcgcatccaacgaatgcgattggattggaggtttttgcaattaccatgacgagcattctaatcctatcccttaaatatgatatttgccgcaacgatcccaccataaagttcaggccaatatcctattcctccgatccccgagctgctccacggaatccagaattccagatcaccatccgctcatcataccatcgccattttgcccgtatactttacttcaagaggcagcaaccgcttagccacttcccgcgccgcgacgtccaggtcacacaggttctttggaacgggaaagggagcaaaaggccgaatcttttccgctgttgctgctcctcctttctcgctctcgctctgtccgatcggagccatgagtaatacgctgcttcgtgtgcacccttccgagctcaagatcccctgtaagtgctttccaagaaccaaactcttgattgttacgcagcgttggcttcaagcttttcttgactgattttcttcttgatttcttgtttatgcggtggtttgataagatgagtacaagagaaagaggttttgctgcatgcagctgacgaacaagactaaccagtacgtggcgttcaaggtgaatgaatactctgttcttcttctcgctctgagctgatgctgttgtgagcatgtgatgcgtttggaggaaagggtgacggattttcgttctgcaaaactgacaatccgtaggtgaaaacgacgaacccaaggaagtactctgtgcggcacgcctgcggtatactgccgccccggagctcgtgcgatatcacaggtgaggtttgcttgatttgctctacatgattaccctattacagtgcttaattagttaatatgctcgacttgccgatcggtctgttgtgttcatgtcgtaactgaaattgtgaaatcggtgtagttcaatgcaggctcccgttgaaatgctatccgattctcactgcaaggacaagttccttgtctagagcgtggcggttggatatggggcgaccatgagagactttgtccatgaattggtaagttcttgtagcaatcttcatggatatctgatatctctagccggggcttaccaaaatttagagctgatggtgttgtggtttctagtttactaaagcgccaggcagggtgatcgaggagttcaagctgcgggtggtgtatgttgctgctaatcctccctctccagtgcctgaggaggaagaggaagaggaagaggatgcatcccctcagtcagaggtcatgagccatggagtgaaaatgacatcagtgtttgatgctgtaactgtaagtaatatcatgcattgatgtttattcggtgctacagagaaaacaatatcatacatgtttccttctcaggtatccacactcaccgataggtcagcagacaaagtttcatctgctgaggtaaccatttgctcggttaaagtttttttagtcactaagatgagtgatgcatagtcttgttggttgcattgtcataatggcatccgggttttacattttttaaaaaatattgagtgtactctgatgctttttctatagtaaaaatgcacattgcacacgagccgatgtccgattttaaaagaaaacaaaaatttcaggttcatcacaatcacatgttagctaatgtaatactaaaaattttcatgtcaaagttatctctaacgtgttttacctaacaaccttgtgatgcttctcctgcagaatgagactcttgatgtcattatcaaaagtttagtagtcaacttctttcttcagtttgttttgtctgggtagataagtgaccttgtttggtaccatgccattgtcagtacagcagtatgatacctaaaacaaagaacctgtatgttataattcagtgtattgtcttgtttggttggttgagacaatactatttagcgggttatactcagaatttttttgcagtaaactgacgctttaatctatcagtttgctctgccttgctcatattgcatttgcgtgtggctgttcagggtgtctctgtagaatcaatgctggttgcagagagagaatatccagtagaagaaaatcagaagcttcagcaacagatggtaagatttcagtacctttttcctgtatgttacgctctttgaatagcctgccatttcagcgttggattctactgcagtacctgcttctaaatcgttttcttgaaacaatgtttatatcttgaaggaaatagtgataatacttaactttttcaccctgattatgcctgaggcaacaatattgttaaactgaatatgtttgcactaaaaagctggattgaactctgcaaaaatgacacgtactcaatcaaatctattggtagtttggtacaaagcgaattatttttgagtgacataaaaccaccgaatctggatatctttattggataaatatgtacaaaggagcttttgactccaggaaactgttgaatagcagcattggttaatcaatgaggatatgggatgcattggcgtttggtgatagataggtgatcttttaatgagccctagtcctttagtttccatgaagggaacatttgcgttactgagctacagtagtcgacaaactggagtaggaataatgctattcctgtttgtatcttctcatctgaaataatgatgcaccggtagtggtaggtatataaggacagaataaattctttaagaaacatgactgaaattggcttggcattttctatctctcgagttaaatgttaccagaactacaatttcagttacaggcttttgctaattatgagttattatgccctcaatattgatgaacaacctcagtgtacaacttgtaaattctaacacctgattatcacaactgcaacacactttttttaaaacgactgcttagacaagtattagttgtatttttttgtcaaacgtctgaacatttaaatttaatattgcttcaggaactacttagggcagcaagatcatctcaacagggcttctcagcaatgtttgtgctgctagttttcatgtcatctgtctgcattgggcacttcatgaagcagatcaaggtttagtcatatgtttacgcaaaaaggatctctgtttatttccaccaagctaacgcaccatctccgctatctataatactgtcacaggcaatagagtagtagtgtacgcatagaaaatattcaataggttgtacattttcagatagaagacgagctatttgcattttattcatgtaaattgtatagcataattgaagtacttgtgatctgtaatgccgtgatagatagagaaaacaaagttttactacttcctctattgactcaagaagtgaagagatgagcctagatgacaaaatgaacagacacagatgattgccatggacaaggactcgtcaagtcgtcatagctttggccaagcaaccccactaacctatttaagacaagttttatgcaggattataatctcttatatgcagaaacaaataagggattttaaagtctcggagagaacattcttgttgtttgcatgactcagatagttatgataaaaatgaaaaaaaaatcagaagatttgttaacatgtaatatatgactccactaatacgcaagttacaaaataaaacaaattaaactacaactagttaatgtacattcacagttaattttttattgtaacatgtagaagttaaattttatcttgtatgtttgtggattgatctatcacatattaatttatcttgttaaattttatctcacatgttgattttttttcaaattttttcatacacatttaagagagtttagaatgtatgcagactataaaataccaatatctccttgatttacttcttacagtaaactactacatgtttatgagtagtcggataccacacaagaaacaggaagagcgaaatttagctactctacatgttgctaaatactgtaggaggccacaacgaaaaaaacagcgaaattgcaagggaaacaaatctgtcaggtcggaacaacgtaaacgttttggcgagccaccgacgcaaactcaatcgccaccccgatggcgagcgcgagcaccgccacggcgccggctgcaccgcagcaagcagcgctccgcctccatccgcgccgccgagcagcgttccttgtcgcagccgccggcgacggcgacggcttgtgtccggccctgcgctcggcgttgaacgtggcgccgagcgtcgccatttccacggcctcgcgctcgacgtcggacgtcgcctccaggcagccggtgacctcgaccccgaagcatgactcggtgcacgagcactcggaccccgagccggccgccccgtcgggctgctcctcctccgctggcgccgccgcgtcgtcgcgccgcgcccacttgtcgaacgcgcccttgaggacggcgaagcgcgccttggcctcctccaggtgctccggcagcgcgccgccgtggcactccccctccgcggcgataagcgtctttaggaagtcggtcttggcctgaatctccgcgaagaggctgccgtcgacgtcgctccgccgcgggcgggaggacatcgcgtcggcgaggcaggcgtccagctcttcgagcttcctctccacgacggggttgggccgcacgccctgcgccgtcgccgccggcggcctctccatgtccacgtccatgctcgcgtcgtcgatcggtggcgcacgaactacgtctgcgcgatcctcctctcgatcgatcgagcaaagtagtgggcggtttttgcttttgtttgagcgcccgcgtcgcgtgtgagtgatgggctttgaagaggagttgtgctgtgcgactcttcgccgaaacgggcgcttcggtaaccgcaaagcggctgtgcattggatttgatttgatggaatgcatcgtgccgcgtgagatgaggctgtgctcgtttctcagtggtgggaggagccactgcaattctcaatgaggcctaactaacctcaagaaatcatcaagatccaatgtgaatagtgtttacaatgggccaaagcttataaacgttcaggcctcacagtttcatgggcaactccgcgtatctgggctgagagaagttgggggctatcagggctgaaatctgtgacccatgatagcggttgagagaagttggggcctatctgggctgaaatattccatgtttcgtttaccagtaagagcatctccaacagcctctctaaatcagactctccaaacacctatatagccaactctctatctgacttagctagtcagactagttagttgctccaacagactctccatccatactctccattatgaatctatgacggtgggacccgtatgtcagcctcaaataacccttcttcctccacttctctcccctttttcttcacccacttctctcctattcctctcctctcttctctgcagtgtggcgtggggagaatagaggcggcaccggcgggaacggcgcggcggcggaggacgactcgagcggtgcggggatgaaggcggcgccgacgggagcggtgcgggcggtggaggacgacgagagtgtggcgcgaggatggaggctgcgacggcgggagcaacacgggcagcagaggacgacaggagcgcggccagcctcgtcttcctcgacagccctccaccgttgagcctcccctccttcccttgctactccctcgccgccgcaccctccctccctcaccgttgcactacctcctccgctctgctcgctgcaccagtcagccatggctgaggatgcgagcgagtggcagcggcgagcacgggcgaaggatgcgagcggacggcagcggtcgacggcgccgcgaacaaggggcaacgacgacagaggggcggcgccggcgcgagcaatctgggaggagggtgagggcgtggagagagaatatgggaggggagagggagaggggaaaaggcgtggggcccatgattggcaagtcaattttggctggccaaagttggccagcgggaggagtggtttggccagccggatggcttggagagggagatagagagtctgttggagtgtgtttttgtccaaaaatgtcaatttttaacttggagaggaagatagagatgttgttggagatgctcttacaccaagctaacgagcaacgactgtcttctttatctttaacttatatagaaaccaaattttaactccttctttaacttatataaatcgaacttgattttttttaacttataggaattgaattttaaccaacatgtttcagagtgatatatcacatattaacatatcttgccattttctttcataattatttggatgatttgcaaacaacgagggaatatttcctcaacagtttaaaatccattcatgactattagtaccatcgaaatttactttagaaaacaatcgacgcacctacggatcgggtgctcgattttttttaaaaaaaaacaagaccacacatggatataatccgatgaaaaaatatttagcttattattgaattatttttaaatgttgcacgttgttccaccaagtagatcggaattgtttcactaaatagatcgaaaatgtttcaatcgtttaaaaagctgaaacacaacaaaatcacctcataaaacattttgctacaacgtatgaaaacggttttttaaaaaatcaggcgttgtttcaccttatataaaaataatatttcagcaaatagcgaaataatgttttaattcactgcaacatttgatctatacatagtgaaacattatgagtacacttactgaaacattgttggtggaacaaaaattgaaacggattctctaaataaagcgtttccataatatgtgggtaatttgttgcaaaagaatatttcaattcactgcaacatttcacatttcatccatacataattaaccattataagtacactagttgagaaaaaaaatgaaacgtattctcttaacagagagtttccgtaatatgtgggagatttgttgcaacggagggcattgagtggtggggacgtgtgggaggcaggcggagacgcgcgtggaggagggcgcctttttttcgcggagaggcgcgcgtgggggagagggcgtccgattttttttcccgccggatcgggcgcctgccctagcattttccgaaaaaaccgaaatatgggctggagtggtggttgtctggaaagctcaagcaagttagcatgatatgattcctcctgctttgattccagtacatgtcgacgtcccttccgtgatctatcaaccgatcacgccaaaaaacattcctaattaattcggtttttcgccattggtgcatgttacgaggtacagtgcagccatgccatacgccaagattgtgtgctaaactatcatcaatcaccgaacagaaacaaacgtcagcatgttcctcaaatgcagcatctgggtcactataatgttctaccaaaatatattcaggccaatccagatcaaccagcaaatcatcctcacatgcaagctcacagctgcacccactaatcatccagcattgcaccaaaatttctcctataaatactcaagccacaaatgccatcaaaccatcacaaccacacagcaatcgagctagtaatcaggagctcctgaaactccagagagctaatcgctcgtcagcttagtgcgcgtgatccagcggcagcaatggcaggcaaggcctcgatcgcgctgttcctcgccgtcaacctggtggtgttctcgttggccagcgcctgcggcggccgctgcccgacgccgacgccgtcgaccccatcgacgcccaccccgacgccggcggcgttcggtaagtgcccacgcgacgcgctgaagctgggcgtgtgcgccaacgtgctgggcctcatcaaggccaaggtgggcgtgccgccggcggagccgtgctgcccgctgctggaggggctcgtcgacctcgaggcggcggtatgcctctgcacggccatcagaggcaacatcctcggcatcaacctcaacctccccgtcgacctcagcctcatcctcaactactgcggcaagcgcgtgcccaccggcttcaaatgctaagcatcgataggcggcggcgctactgcgcatttgttccgctggctattttatctggactgtttgattgctactacgtgctagcttagcttgcaacatttgcgcgcatgcatggatcgatcgacaaatatgcatgcgtgcacctgcaaattaagcatgcacacgtaccatggagctactcgattttccgtgtttttattcgtttcatgtgtgggtccttgtatgatctgttgattatttcttttgcattatgaataaaataaatttcacactttgtttggaatgcccaatgtctgtccgcaaaaagagttactagctgttttcgtcgtacttagacgtttaagacaaaagttatcaaaatttgtgaacttttgaccatcgatagtactttctcgaatacttactttaaaatcaaataaatggtatatatagataaattttccttgaaaaatactagtactatcataatatcataaagatgttagatttttaaaacttattctaatataatattgacggttaaattgttttgaaagattgactaaattgtgaatttttactccttgtcaacctattgtgtctggtgcgcaataaatgcccgctgtcatctattggcttggtgacaccgcttgggattatggcatatgtccaacgtggaatgggtgatgtgaacgaatgccaccctgggtttaccaaaccgcttagggtgggtaagaaggttgtaagcatatggtgggtaagctcaaaaggggtcagaaactcatgcaaaacactatttttttttaaaaaaaaggtgccgtaacggcccaacacaaaacattgagatgaactcatttctaatggctaaaaagtagtatgtttgaaatatacctgtggagaatgacccataagaggtataggaccctttatggtgggccatagttatgaaccaatatatgggtagtcgttaaagatgagctttgatctctagagtctataagaaccatcacaaatcatgagcatcataaataacgaatgataaatacgagccattagagaaaagctctctagcaggtctttctaatctatatgattttcaactggcgacctgcatctctattatctctctcgcacaagttgaactcttgaaacgagcagcgctcatcgtactcatgagcataatgcagatgttgccagcttacccctcccctcccccctccctccccaagtctcttccttcgccccctacaaccagcaatgctcccttgcttaaccctctccacaaataataaagtaactgaatttgactacttcgagctcgaggatgccatattcgactagtttgagctcaagaacataggatcttatgtagtacgacgacgataatgactagaggccactacagtggcccatatgacggcgagcaccaacgcggctaccgtctagctcctatcccaagccggagcaccgacacggatgctgctaattaagtgctaaccctcacccatccgagcagaagcaatgaaatagtggcggactgtcgtttctccctctcttttctacaccctcagcctcgagcactgcaagctcccactgtgattatgttttttgcttttttttttgtcgattttcatatatgtcacatttgatattttttggcccgttatagatgtcttgatcactcacggatgttcacatgttacaatgagtcatttctcacaaccgagtaataatcaacatcggatcactcaataattagtgataaccttattgaaccgtcagagatgaacggttatgttgtagcgaataaaatcaaacacaatgtaataaataagtaactcatctggcagacaaaattcaagatctactcctttttccactaggctggctgaagaaagtcagccgaaatttattagagttaacgtctaagatcatagtttttttttaaaagaaaaacacagaagaggacaaagagtgtctgtttttatttaagaagaaaagacttggcctagattttaagagaaaaccaagccaaaaaccctcacataagcatggtttgaagtaaaaacctaggctaaacccacacgaagaaaaagccaaaaaaaacctgcgacggcacaacgacgtgattatatatattggatcaggtagcacagcgacgtgattagattatttacatacgaggcaaaccaaacaagactacaagtgcatatgttcgaattttcgatagaatcatccgacgacgatcccgtgagccaaatgaaacaaaactgcagcctggaatttattttccctcttctgcaagtacgtacactatgaaacctgaaaacaacttaacacgggtgtccttcgtcgaatgattctttcgctgtttattttccctgatcattaattattgcatcgttactaattaaaaccaactttatttggcattttgtgcacgttattagctaggcacagagagacagagcagccaccccatacgcgaatatgcttaagcagaattatgaccaaaaccttcaagcaggtacaaacgtcaacgtgcattcacaaagcagcaatcttggtctctagctagttctgttcaatactagctaaagtatttccagcgtactttccttggagaatccagatcagcttcctaatcaccctcacatgcatggttgctcgtcataacatataaccaatcagcattatattgctttaatcatctcctataaatacgacgtcaaattgaatgccaaaccatcacaagcactaagcaaatcgatcgagttatcaagagataattaatatcgtttcggtttagtgcgcgtgatccagcagcagcaatggcaggcaaggcctcgatcgcgctattcctcgccgtcaacctggtggtcttctcgttgggcagcgccttgcggcggccactgcccgacgccgacgccgccgaccccgttgacgcccaccccgactcccgccgcattcggcaagtgcccacgcgacgcgctgaagctgggcgtgtgcgccaacgtgctgggcctcatcaaggccaaggtgggcgtgccgccggcggagccgtgctgcccgctgctgaaggggctcgtcgacctcgaggcggcggtgtgcctctgcacggccatcaagggcaacattctcggcatcaaccttaacctccccgtcgacctcagcctcatcctcaactactgcggcaagcgcgtgcccaccggcttcaagtgcttctaaaggctttataaagtagccgcgcgatcgatccatgcacgtctcaacgcaacaggggtttatttggttcctacgtgctagcagcgtgttgtcacttgtcatgcatgggcatgttcatgcatgcgtgcatttggtggcaagaagtacgtatctggtttgattcgatatgattttgtttaatttgtggccttctccgcgcgtacgcgagattatgcatcggggtacatgtttgttttattttttggaaattattgtttgattcatatcacttgtattgtattcagtacgtaaaaataaagtctctctgctctgttatttgtaactgaagtgcttgcatgtttactcatcactttcatgtcatcgtctaaaatgtaatgatttttttaaatgtattctactaaaatactccatccatccgtttcatattataagactttatagcattgcccacattcatatactccctccgtcctagaatatagcaatctaggaccggatatgacgtatcccatgtccagattcgtagtactaggatatgttcaattcgattctaggttgctatattttgagatgaaaaaagtatatatatgttaataaatctagacacacaatataaaacggaggaaatatatgacaatgttatataccccggcccccaaagataagcgtgcgcacacgtaaaaaaacatgtaacttgtactaaattctacacatatatatcccacaataaatttaacacaaatttcgtttaattggtgtaatagcacatacatattcttaacaagaagagatcataaatatatagttgggaaaataactcatctgcattgtagatatatagttagtaaatctagtacatgaaccattttttcttaaaaaatgcatgtttaatgaggatgcaatctattagtaggtgcgagccggagtttaagctacacgtcaacaagtcaacaagaggccaatcggacaaggggtgcagggttgcaggcgtgaacattctcgcgtgacctagacatgcgaatatgcctatggtttttccttttacagcacatgtttttttttaatttttggttaagtttatgcactgaaagagtttacatgttcgactccgatttaaaccttgaattcggagaattaaatttaaaaatatactatgcattcaattttttctcatgaatacttgggatgcaaaattttttgtgtaaatataccgtcgatctcacgcaaccgttgcacgaaacctaggtgggtgtgatgtcatgggcggtatcgcgcgttcaaagtgcgagagcgcacggtctcgcgcggtgaaggcacgagagcgcgcggtttcgcgcaatggaagagcgagaccgttcggtttcgcggaatcaaacagcgaaactgtccaccggttccatttaattagtgcttaattacttaattagcaattaactaataataattagcaactaattatcttaattagcgattaattaataaataaataattgctaattaagataattagtcgctaattgaatcagcatggcaccggtctcgctcagtccttgcgcgagaccgttctgtctcgctgtaccattccgtgagaccgagcggtctcgcgctttcgccgcggataccgctcacgacgtcattcccacgttattctcgcgcaacggttgtgcgagattgacggtatatttacgcaaaaaattttacatcccgaatatttataagaaaaaattaaataaacagtatattttcaaatttaattcgaattcggattgaaatacttttacaataaaattttaataaatcatttatatgtgtaagagaaattttacagtgcctcagctcaaagataacaagtggtaaaaaaaagttttagtgtaattttcatatctcctaattaatagtagggtatcaaattttacacatttatgatgtatttctaatacctcctagagtactggacaatcacttagctatgcataaagttttgagtgaattgcatcatgggccaagtattattgcctaatttccatcttggaccaggccatatgcaatattttcactttaggcaagggtttgttaccatctttgcacattgggccactattctatcaatctgtcagtctatccgtttccatttgctagctgactgccaccactactgcactacgcaagcggcaagccgttgcttcttcgggcattcaccaactccggcaatgcatccgagagagagagagcgcgctaggaaggaggtacagtcgagtgcgaggctgcgagcacgtgcatcgggccagttcgcgtagagatagcttcagccttcagctgagctcgagttaatcggccagagcaggcgaagaacggttggagctcatgtgccgaccagctctaagcttctgttgatcaattttgaggaagccacccatgctcgatggcagctcgattgtacaaactgaaagggaggggatgagtggacagaggccagcaacaatcgtgtggaagccctcacggcaccttggcatcctcacagtggtggcgcacacaccaacagtggcagcaggctgctgaagttggagatggtggacaagggtggtccaaagtgaaaaaaatagtaaagttatatggtctaaagtgaaatctttgtattaggggtggttgtaggattgagatgtcgactagaggggggtaaataggcgatttaaaaattaaataacacctaatcaaatctaacctaagttgctagacttggtgagggtgaactctaactaagtaactaagttatgttttgcaaacctagggtgatagtggctcaattatatctctaggaaagtaaattgcacaaatgtaaatgcgacaatcaaatgagacaatgagacaagagatttttcaccgaggttcggaaactcgctggtttcctactccccattgaggcgagcccaactccaccgctcaaccacaaagccaccgcacgcccccttcgtcaaggggtgggcaaggcggaagccggcccacggagaggactacccaagcctcgatcactcggggtagttcttccttcactccgaaggtggtgaactccaaaccactcacaaaccggcgccgggcctcctccacaatcttctcggagaggtcaccgggcaactcctccacaagccgtctaggaggcggcaacctccaagagtaacaagcaatgacccggtgtggagatgatcaagtgccacactagctctacaatggaagcaaatgcacttgactcttggctaaacaaccctctaacacactagatggatgaacacaaagctcaagtgagtgtgagagaggtgcaaggggtgtatgcaattgaattgggtgccaagagagcccccttgctgctggtgggggagtatttatactcccacccaccaaaactagccgttggtggcgaaatcccccaactttgtgctctgccggtctgaccgaaggtatgtggccggtcagaccgtgctactctgcaacggctagaaaactagccgttgaagtgctgtcagagggccccatcggcctgaccggtcagaccgacatggggtggccggtcagaccggcctcggctcggtcagaccgccatcagctcggtctgaccgactacggctccgtcggctctgtatcggccatcccgagcagcatcatctcggcctccagggggccggtctgaccgggaaagtgccgccggtcagaccgcccgcggggccggtcagaccggccagggcacgccggtcagaccgccactatgtggccggtctgaccgcccctggtcaggccgaacccagtgaatttgcaaatgaatgtgtgtgtaatgaaaaagagagcacaaatgaaaatgcaatgacctaatgtggcaattaaaatcatctctttgctaggtcattacccctcttaatagtacggcgaaactaaaattaaactagcaaatttgatcgccctacacctcgatcaattctaaattaaagcgctagttttaccgtcttctttccctttgctttgcgccgtcaattttaatccatcgataatcatccatgcgcacatatgacgtggacctaacttaaaatgtatagctcaaagacaacggttagtccataattagtgcttgtcattaattaccaaaattaacaccaggggcctagatgcttcagtggtctaagctgaagctctggtaaatttatatggcccaatatgcaattcactcacaacagattctcatgttcggcaaaaagataacatacgtgggttgaaccaaaagtgttcacggacctagaccgcgtgcgaacattcgctcggtgaacccaccattcagagcaggtacaatagcagactattagccagctataaacatattttaatgagataaaatatgagagagaagagcagcgggttacaaatttgtatggactccaagacacagtgtgtgtatgacaggtcggaccatatattaatagtatagtaagcaactattgtataaattcgttattagatcggctatagataaattagagctaatagtggacggctgcaactacaagggcaacgaagccatcacacacgttacctacttacctcttctggttaagagtaggtataatagcagactataagccagctatatttaaggagataaaataagagagagagagagaagcaacgggctacagatctgtagccagctacaacacgaactgcaagatgcatgtatatatgacaggagagaccagatattaattgtgtagtatatgtttatgggtaactattgtatgaattggctataaaattaactatagatgatttggagcgatagttagctatactattaagagcaggtacaatagcaagctaaaagctagctataaacatattttaaagatataaagaaagaaagagaagagcagcgggctacagatttgtagtcagttgcagcacggatttcaagacgtaatgtgtatatgacatatgtgactatgtattagtagtatagtaaacaactattgtataaattagctattacattgattatagatgatttcgagttgatagttagctgtactattaaacttgctctaagcacgtgggccggagtggcctactgacctactcgtccacccggctctcggtacaccgcaggggcgcgcgcgcccgggctaatacaccgcggggaggtcttgtcggctgcggtggatttcgtaggtgcaccacgaatccgcgcgcgaccatccttggctcgctagccgggtggtggaccacgtatatagttctcgatccatcagagaaacaagttcggtaccgtattgattatttatgccgtgaccgacccgcaaagtataggaggatccaaagaaattcgccgtccaatatcgcaaggatatccggctacaaaacgcacatcagcttatacgtacatcccttaatttgtaaggtatgcctgtacatgcacgtccgcccaacgcaaaaaacttgattgcattataaaagtacaaagagataagcgaaattatcactaaccccaaataattgtttcaagagatccagatctaaaccctgcccttggtacagtggaacattcccactgcaaccgatctgtcgaaacatactttaatctctcgtcgccgacggcaacaataccatgggtagcgcatcgatcaaatcgtcaaggcgtacatccgtccacccgtgacctcccggccggccgggacgctgtttgtgccggtgaaagtgacgacgttgcatgagacacgagaacttgattacgccagatatttctgttcatatcgtacgcgtggcttatactgattccttgttctttcttgcccgctgcttgcagtggcacagagccgcaggctgggacgcgctaactgtgcagtgtgccgccctccatgcaatgggctccaatccgtgggctgccgttgggccacatcctggaaaacttgatggcgatgaacgtacgtacttctgccgttgacagaggggcatgcatgtgtgcccgtaaccagtttacagcccgtcgacagatcgatctaattaaccatgcaaagatgctttattacacggtcatgattaattgaagaatgaatgaagagcacattagtttctccacggattttacatggatcaatcctcagccagaagttccctgtagccaagcaggagcgtaacgtcggtgcagcgcttcacccataagcaggccaacaaaaggccaaatacagacagagttcatcgtcttccaagaccatgagtactgtgcagacctgatcaccggccgatacatcacagagagttcctctgccacacgctagtgctactgtgcagtccgtgaggtcgcgcgcgactgatacttcgctttctatcggtccatggagccaatgcgcgatcaaccctgtggtgaccagcgcgtgcgggcggccgagctggcgacgatgctgatgtgtgcgcgctccacgcaggccgcgccggctagctcccaagccaactctcgccagccagctcaggacgagctcgctgctcgccctggccctggcatttccacatgggttttctttgatatgcctagctaccagccatatctttttccatctgtaccgaagagtagggaatttttttagtttgattctaagtgtgtgtttagttccacgctaaaattgaaagtttaactaaaattgaaagtttgaagaaaaaattagaattttatgtgtgtaggaaagttttgatgtgatggaaaagatggaagtttgaagaaaatgttgggaactaaacaagggctaatgcctgttctgtaaattgatcagaaagacaggaaagtactccctctgttccctaatataagggattttaacattttgcttgcgctgtttgaccattcgtcttattaaaaaaatttagaattattatttttttagacttactttattatccaaagtagtttaagcataactttttgttttttatatctgcacaaattttttgaataatataagtagtcaaacggtacaagcaaaatgtcaaaatcacttatattatgggacagaaggagtagcgtagaatggatagtcaggcatggcatgtgttaataaatgtgctcatctttactttctttagaagtggtatgcttaaattagtacaacacgttatttattactctatgcgtttcatattttaagactttctaacattgcttatattcatatagatattaatgaatctaaacacatatatgtaatgggtaaagtgcataggcggttcttaaacttataggggtgtgtcatctagatccctaaactctcaaaatgtagattaaaatatcagaacttgtcaaagtgtatcatctaggtcccagaccgccacaacccatttaggatcctacgtagcgctagtgtggcgtggcatggcatcatcttgattgacaaatgggatccacttaaaaattttcattttccgtttctttcctttttcttctcctaaatctatttttttttctcctttctctatgactcgagcaccccgttcagtggtggcctacagctgaactgagaggaaggaaagaagaaagagaagaaaaagagaagaaaaggaagaaaaataaaaaagaaagaagatagaagaaaaaggaaatgaaaatttttaagtgggtcccatttgttagtcaagattatgacatgtcacgtccgtgtggcatgccacattagtgtcatgtaggatcctagagaagttgtggagatttggcacctatatgacatacgttgacatgttatggaatcggatctgtatattgagagtttgaagacttagatgacacacccctacaagtttaaggaacacccgtgtagtttactctttattaataaatatatagaggaaaaataatattataaggcatgtagctaatttttaagagactgtctatctcagaaaaagaacatgctggagtatattctaactacaagcacatataaaaagagagaataggagagaggaaaaaaaaggctataattaagtattaatggtgcgatatatatttatataaaactattgtatgagtaggtcattagagtgattgtagataatgtatcaattttagagctagcggtttgctgtactattaagcttgctataatatttctaagaaaaatctcgctcattcaagtcacctttaaatgactcggatcgtgccatggttcgtgcagctacaataccacctccaatgttatttcttccctcctccccttgtttccatcacaagtcacaatcagggatgaatataaagtattaggttcagtgtctggtgataccgataacttttagcaaaacctatggttaaattgtttactcatataggataacgccattgcttaagcatgattagcatgctatgataccagtatgtatgttatgacactagtaaaccaattttgtagatcgccagtggtctcaatcaagtcacatgccctctccttttgcnccgccacctttcntagccaangtcccctccaccctcccccccccccccaaaaaaaaaaagccttgctagcgcaggcaaggccccaccagccttcttgttttccattgttccaagctaggcgacagttaggtgcccccaccctactgtattcatggtctctgacagcttctaaccctattgttttccttgtcttgcctccaacaccaatccatagctctcatccatctcgatggctcaatcgacatcgccattgcctagcgacctcctcgcatccttcgcccactgctagtcctctgccacttgcggtcatccctccaagcttgggaaagcccgccctttcacctcccccatccacccctaccaaccttataatctgcaaccttagctcgtcaagtggattaaaaaagtcaaccatgtcatatattaaaaaaatactggtggtaacatttaatatgtaaagtttattttattatgtttggcagcttataatttgaaacctctaattctaataccatatcaagctgaatataccaactatttcacataaattcctaagctaagtaataagacgtacaaacaattcactcatactccaataaaagtgttattccgaagatgaattctcaatccacgaggggacatccccttatttcttgtatattacctaaatagttaaagaaaaatgataggataaattaatatggatatatcatttcagaaacatgtaaggtcaaattcgacttttactataacacttcacaattatatttattgttttgttacaacttgtagaagtcgaaattaaactttatgtttgtggagtgattatctcatattaacttatcttattattcattttttttaaaaaaaataatgactactcttactatttcaaaatatagcaaactagtaccggattagatacaactagtaaaacaaatcttgatagacttctaggttgtgtcaaatctcatactagttgctgtattttaggatgaatgcagtttttatgtaagatgggagaaatgatatgatgtttcctctaaagatgaaaacaactttccgtgttactgctagacaatataaccacgaaagagagaggttagggtttgtcctttgcaggtttaccttctataaatatacccacataaccctctcactagaccatccccatctctcactagctagctagctctgatatcctacaccggccttagcaaatagccatatatacccttaaggataagctccatggcatccaagatcctcgtgtttctcttggccatcaacctcctcttcttcacgacggccaatgcctgcggctgcgcgtgcggcaaatgcccgacgccgccgcccccggccctcccgccgccgccgccttcgactccaactactccgtcctaccataacaagtgccccgtgaacacgctcaagttcggggcctgcgccgacgtgctgggcgccatcagcggcgaggtcggccaggtgcccgcccagccgtgctgcagcctcatcagcggcctcgccgacctcgaggccgccgtctgcctctgcacggccatcaaggccaacgtgctcggcgtcgtcgtcaacatcccggtgaagctgagcctccttgtcaactactgtggcaagtgcgtccccagtggctacacctgcgcttaaacaaacttgatgcatatatatatgcgtggctatctacactcgtagccgccgccgccgccgcctgtgcacgcttgcatagttgcatttacgctgcatttatatgtgcatgcatgcatatatagctataccaccgttgatcttctgtcgcaaacgttccaccgcggttctgcagaactagagccgttccagtcgatcgagtgtacacttattggtgtgtatttgtttcataaatttgctacgggtttgatcgtttgttctgtttacaaaggttgcaataagttggagtcattatatcgtgtatttgtaatagcacgaatttgaaagttgtgaatcgttaatatattttcttattgtcctgtcttttggagaaaattcaacaaagccatctatctcaggtaatattcttatatatgctactgttcctttcatgaactttgtttcattttgaggaaaaggttgctttttattgatcaatgacccagtagcactcgagtaagtcctaaaaaagtagcattcgattttcattcgatttaattttcttctattttttttaaaaagacatttttctcgtgctttgcatgaaaggcaggtgttatatggtccctatataggatccttttctgtattgtagtctaaatggtactatataaagcagaaaatgtatgaagatgtgtatacacaagggaatctaaaattaatcaaatgtcaattaatcacttgagatcttagatttttctgaccaccatcagaattattattcttctgaagaataggaagaacacattatttatacaccatttaatcatcaaagttttgaacttcacatgataattgaggtctgagggtcgtcacatcagattattagaaacagataaaaaatcttaagccaaggaggaggagagctgggaccgtggccgttgccatatcatatcatatcatatcagtgactgtggagtatcaaatgttgatcaacaaggtactactaccttgattccataatctaaagaattctaatttgttttgaagattttaaggaggaaggaaaaaaaaactatgacgcctccaattaaattaggagtatatgagtagcgggaggttggtggagatatagtgaggagaaatgtaaataaagagttgttgaaagaaaaagacaagtactccctatgttttttttaatagatgacatcattattttttagacgcacgtatgctcattaacttttggagacctctcttagaccatctccaacagaccatacaaattagactcttcaaacatctatatagccagctctctaattgatttggcaagtaaaactagttgctcactccaacagcctcttcactctagatctataatagtgggaccgatatatcagcctcataaatgttctcctccctcctctttttccccatcttcgtcttatcccactagagatgccgacgaggaagggggtagcgctagacgaggcaacaccaatgaggattagacggtgcgggagggcggaagacggcgcggcggaaggtgaggcgcctcttccgctgtcctcagctctatccccgtccgcccccgctacttcaagaccagcactccaaggatgagctcgacgccgaacagggtagtggcagttgatgctggagaaaaggacggcagtaactgtgcccgagcccatgccaactccatcctcctcctatggtgatggttggtgcctctgggcagtgcctcctgctgtcccgcacgtttcctttcctttgcttccatctcctccatacaaccactgcggccatcaccgcaaacgcacccaagcctacaccagctactttctcgtggtcggcatgtatactgttccctcgagactggcacaaggggagaaggggtagtggcagggacgtcggcggacaatagcgatgtagagaagagagatgcgtgagagcaaaaaagaagagggggatagcatatggggccccacaattaataagtgagtgtggttgatcaaatttggcaagtgatcag

SEQ ID NO: 36492 - DNA, 6792 bp, Oryza sativa
tgtcaagtgtggagccgcaacgaccggtacgcagatcggttacaaccccaatcctccactgtctctggactctctctgcgtccgcttctccaaccgccctcgcggtcgcggcgcctcccccgtccgcaagcctctgtgccgctatacgcgcagcgtgcgtcgtcaagtctccctctggcgtcgcgcatggcgcggacagggtgcagtgacatcaagaccttttcgtacgccgattcccaaactcaacggtgttccctccttcctacggtcttacccgggcgtttcgctgtatcatctgttgtacgtgaaaaggcgtggtcaggcctggacgctggggaggctttcgaacagaggaagagttcccgcctctccgacgggatgatggagccctgatcgacgggccggctgcgaggtgcaccggctgttgttgttagcttggatctgggttgggatgtctgtcttttctggagcagccagtttctcctgcccatcacatttgccttattttactagccgattgttggcaagattgaggtggaggggggacattcttgggaagattgagatacttgtcacagtattggactcgtgtgtggcatatgccccccaatgcacatggatcactcctcgggttggcaactttaactataagtactagtactgcactactgcttggttgttccagaaaccgaagcttgtttctgcacaccttatttttgtcaagtcaacgacgattttccatagagcttctcttggatgagactagtacttgtgcttgcttgcttttggtgcaaaactgcaatctctaatcttcctctaatgatgttaaactgagaggcagcagcagcagtactaagagcaggtgcaataggaggcgctacaccggcgctaaaacaaccacgtaaactacaacgatgagctggcggagaaaaggtatgagagagaatatgagtggacgactaaatagtcgctcagctacacacgcgtttcaagatggtgaaaggctcacggacaaatcagaggaaacaagaagagagagaaccagataaatgaggaataaaatattgtttgcattagctaatgttaaagcctgtttattatacaaattaactactctgttagttataaatgatgtggataaaagtatagctcgcagtaagcgatactattaaccttgctctaataagcttggggatttgaagcgaatatattctttagtcaggacacagaggcgtcaagcagggcaccgtgacttacggagagcatgctcaggaggaacaagctcggcgagcgaacgtacgtactgttgtgtttacttgaagcaaggttccaacccaagattaccaggatcgatggcgagttacgcacgaggccaacagtactcttgtgaagactccatgtctttgcagagttgcagggtgttggatttgtggctagtgcttgttgttgtatggacccaccgagttttctttggttgacaagcagaatagccagtggaatgaacaaaagtgcacacagcgctccaatcccaggtaagcacacaaaacgcagaggaacaaacaacaaagcatgcatgccatattgccatgcgcggcctgaaatctcggctgggatggaactgatgatcagggaggtttgttcccaaattacaccgcatctccatatgtggtggactggtggtcaacgtgagagttcagcaagaactagtagaaccgatgcgtaactgatagctgcaatattgatggccagcaccagcagtgtacagatggtagtagaacacgtgatttctaaattccggatgggcgcgatttatgttgccgccttggcccctacttgcaatcttgcatgcatgctacacacaggtacgtaataacaacaccatcatcacatcattgatcgcgcccatacgtcgggcatgaattcacttgtccggatgtcccactccaattaccctacctagtatcgtgctagctagtataattaggagcgttaatgggctacagcccacgatttcttttttctttttacagtccaacttagttgtttcttttctttttttttctcaaacacgtatacaaaattcagtccaacccttaggatttataggctaaaattttttacatattactaggcccaagaatgcatgtttgcacacaaattaaaatattgctatgaccatttgagccatgactgataagcaataaaaaaggattaattaaagatagtttaccattataacttttatatttatattagttatggtctgaaatctaatgctagcaaatagagtacgattaaagaatatataaaaggactccaaaattaaaaattaaaatttagactgattgatacatgacgataaaagaccataaattagcaaaataggtgatcgatatattttcccaaagaaacaagtgcccatgagatggagctcctaatgaatgctggaacggacctaacgatcatggcggccggaattaaacaagagataagaatattgcaattcataaaatgattgtctaattgcatatatatgtgatcatccgctgtttgaataaggctataataattagtgtatgtagaattgtagctgggtatatatatatataataataggctgacaaatgttgaagatcgatctgttattacttacttgagtagttggcacataaagttatcttatcttatcgacgtgtagaatgcatatttacgattcatgtttctatcaagttttgtatatagtcaacatatagatgtcaacatatagttctcacacggctatcaaacttacatgtataaacatgtgtgtgaacttcaattcatatttcaagcaagcaaaatatctagccggcgagctttctacaaaactacacattctacgatctatttataccgataatattaatttattagcaaattgagcatatataagagcaaacaagcaagaatatgcaccagaattagagattgaacactcatatacataaatcacttaagttgcatattagtaattaagatcatcagacagagtcagagaatgccacagaacgacatactcatcagttgtgagaggggggatgggttctagggccagcgtagtccagatgaaacgctgtgtccacccttcgctcctgatgagagagccggttcgaaaccctaacgacaatcgtagtctgaactgcacctggtgatgccattgccactccgtccttcgccttcgcatcgtccccgctagccatgtgatgatccatactagtacttgataaatccttcttctggttcgttggatcagaaccatgaagcttcatgcttgccgcatcctgcacaagggagaagcatggaaaaattagaacagccaaaaaaaaggaacactttatattccgatatataccaagttattccttcaactgcaccaaccttgtacggcgtaggaggtgacgacgatggttttagcgagctgaccctgccaagggcacgaaggcggcgcgcctcgcatgagccgacgaagagcgcaaagaagacgacgacgaggagagcggcgacagcggcagtgagcttaagctgcatcttgggagccagctgaggagaggtcaagcaagacatggcaaggcactagctaggcacacgagtagtgataatgatcagcaagaagaaatggatatgaagggagacatgaggtgatcttgatggcagtgtaatgagccaaggatcgagcagcaagcgtgcaaggagggaaacagagagaagggccacacggaggggttgccgttgggaatatatacaagggcagaaagttgcatgggttaagcccgatggtttcttaaaagctgttcatagtacagtagtagtatttgtttcccaagttctatgacacagttagctatgtgctatgtacattgtctttgtttttttgtataggagcggtgagaaggccgagaagacctaaatgtactgtgtcccagaactggacaagagctgtgattttctctttggttaagtggggattagtgcacgatctgaaggccaagacattaagcaaatgtaaatccagcccgctaatgatagctgaaaagttggatcacttttaccgccatctgttctggaagtactggaatacttaagtaggaagcgtcgtcacgcggattgagtatcgtttcaaattcaattaccccctcggttaattacatgagccgctgaacacatcaacgctgatccatgtttccttccttcagaaactaatcttcagttagtccactatcacggatgcaagtttgaactgaaatgctgcatactccatactggcgttatgcttatgctacattttttgtacgagcatcccacacacagtaaacgagtgggaatcggtgcgtgaaagaatcggagcagaggagcacgtactaccagtttataccacacactagtgattgtgtggtagactggtagtaccaccacttcgcctggggcgcaatgccatgcgatccgtggaggtgaaaaacgacgagttgccgtggggatttgcgtttggcaagggaggtttttttttgtatggcggagtggtgatcgtgagagatgtcggataaagctgccgcagcggagcgcgcgccccgtttccccccgtctccgttgtccccacggcgggcgtacatacgtacgggtgcccattgctaccggctacgcgaatgtatagtatacccaccttatgcgtaccatgcacgcgtatctgcagatcgatatacttggatcggtttgttacgtgaggaactcgatgggccggtagggccgtagggggtagaaattgttggataggctaagtttcaggagaggcccagaaaatgggttagaccaggcggaataagttcacttgactcccttaagtagtgactgaatgtaattcgtatccttaaaccgcaataccggatatctacattccaactattaaaacgatgtaattagactctttagcggttttggatggcgattttactaacgtggcgtctacgtagcactgttgatcagtctgcagcattgatgtggtgcttaggtgaaaacatatatgtgggatccatttgtcattcacccatttatcctccgcctcaaccggaggccggtagcctcccgctgggtagggagctcctcccaaccttgcgcccccgcccaccgcccctgccactcccaaccttgcacacccggccgacctcgcccgctgatgtcaccgttgctccagccccactccccgcggccggccgaagttggaaaaaggggagagaaagagaaatagataagggagagagagagggaggaggaagaaggggaagggaaagcggagagatgatgacatgtggggtccacaaatatttttttttgtgtaaatgacaatgagtcccacgtatatttgttaattctagtgccacataaacgtcatgtcaatgccatgtaggataaagatcaggtcaacaccgtcgcgtatgcgtcatgtcagcgaaaccgccctccaaaaccaccaagaaatttaaattgcaccggtttaaatagttgggggtcgagatatccggtactgtggttcaggatacgcatcaaattcggtcactagttaaaagagtcaaaatgaacttattcctagaccaggctgtagtctcgtctcggtttgccaattaagattgtcttcttcacggcctgttgcgaaggtgatcgggaaattttctcgtctctgctcatttatttattctttacatttatttttagagaaggatattttttattcagtctttacatcaaatcggatatatgcaacgtttttaaattagaagttagtcccctaaataattcaatctgaaatttgcttctatgaatatttgaattaagaaccttgtagtgctactcaagtcactacaattacttacttgactatgtgccctttcgcgtctctgcttatttatgcacgactgcataaatgcagaatgttttatggttcctattttaattcagaaatttagtttctacgtaatcctcctaagatctgaccatttcaatgtccatggtttcttctagtctgcaatgaaaaatgcccagaggtattttggttagctctacaaggtggtgagctagcctgtctaagttcgaagtctcaccccttatatttatttgatattacgtccttccctaattggtaccaaccgttgtgtgagagattctacggttttctgaaaagtgaaaactagtcaccttagattatgctgctcttcctcgtcttttctgttgcgcgtgaaacaagataagctataagtaaaaataatataggattaattattatgaatttgaaaaaaatatatttttttacgaaaactttcatacaaacaggttttacatgggacgtaatagtttgaaaaacatgatcatggataaagaggaagtaatcatttggaatccagaacgcagctttgtgtaattgcgtgctccactgctccgaagtaagtgggcagatgcatcagctttggggctgttaggcagattggcattggaatgaaatgtaacattcgaactaatttcaacctcccacattatttgatgacaaggatgataaggagattccccggagagataaaacttgaaaaaacagccaagcaacgtcagatcatcaaacaatttgaaaaaaaaaaatcatcttcgtccctgtgtaaagtaggaaaaaaaaactttggtgatttggtctgaatattgcaagttgtggtaggtgaccccgtgacacggttgaatttgtggaagaccttgtgcctactgttctttggtccaatc

SEQ ID NO: 36493 - DNA, 1410 bp, Oryza sativa
atatgcatacattcgcgcacggtccttgtgctgcagctctcgcctacccccgtggcaactcgttttgaagggttttcattgtgtcaagtgtcaacacgacagggcattgaaaggaaaaaaagtttacaagcgtcctttgggaccttgactgattttcctagcaaagtggctattgagacagaagataggccagattcatgtgcaagcaatgaagaaacgtccttgtggccgtgtcaccacactatcaccacaatccttagcaggctcgcatgcagacgcagggctacagctacattatcatcaggttacacttgcacctactatttttttaacgaacacgtaaaataataatacgtgaatagtgtattagaagaaaagagtatttatttacacaatgcaaatcagtcagaccgatttatagcagaaaagagagaaaaacaaaggataaaggaagagacttagggaagagagaaaaaccaaagataaaggaagagactaatcatatcgtctagaaatactattaatagagaatctagagaatgatattatatggagtagatatcatggctataccatttcaaagatatagtaataccgttctttagttctctctatttcaaaaaaaaacaaatctaaatttatctttagagtttgattctttttgagacagagagaaatctaacaaaaaactgtttgctcaaaaccatcgtcgagcaaaggcaggagcagaatgtggatttttaaaataatttttaagcatttttaacttttaaaataaactcatcaataatttattttcaaaacctggtttagcggctagccggcggtgcgtgcccgcttggcgtcgctgttactccaacgccgacgcatgacggcgtgactgcgtgagcattcgctgcgttccatgccgcgcaggggcggtttgcgagttggcccaaagaagggccgggaaaatgtggaagttgagcgcagcatgtcagttgggccggcaattacgtaggctcggcggttgggactggaagacgcgggccgtgtccaaatacagcccggtagtgtgtagtggacatacctctctacaccatacggacttacggagtatgcattgacggcgattcatggcgtcggacgcgagaacaactacagtgtataggggagattaccaacgagaaagtttgcctccaatccgaaaccgaaagttcgtttcagctcctgttatgatccatctacaccttatgtaggagtaaaatctaaacagaggtactcgtactgctccacttgcaactgagaggaaacgaactagtaaccgtcaaagctagctgggccaatcgacacgttcgaggtccacaattcaagctcgcgggggcaaaaaaataaaacccagataaggtatcagggagtaataataacgat

SEQ ID NO: 36494 - DNA, 9132 bp, Oryza sativa
cgctgagatgatgttgcctatccttggcttgccatcaccgacactactcctcaaccagcatcagccgacgccggcctccaccttgttcatgccgttcccctccttctccgaccatcaacaacagccactgctccagccaccgccgaagcgccaccactccgtgcccgacaatctcttcctcctccacaaccagccccagccaccgccgccggcgcccgcgcaatgcctcccgtttccaacgctacatagcgcggtacccttccagctccagccttcgatgcagcatccgcgcaacgcgatgaagtcaaccgcggcggcggcggcggcgcagcagcaacacctcctggacgagcttgcagcggcggcgaaggcaaccgaagtcggcaactccataggcgcgcgagagatattggcgcggctcaatcagcagcttcccccaattgggaagcctttcctccgctccgcctcctacctaaaggacgccctcctcctcgcgctcgccgacggccaccacgccgccacccgtctcacgtctccgctcgacgtcgccctgaagctcaccgcttacaaatccttctccgacctctcccccgtgctccagtttgccaacttcacggtaactcaggcgcttctggatgagatcgccagcacaaccgcgtcttgtatccgcgtcattgatttcgacctcggtgtcggcggccagtgggcttcgttcttgcaggagcttgctcaccgctgtggctctggcggtgtgtccttgccgatgttgaagctcacagccttcgtctcagccgcctcccaccacccgcttgagctgcatcttactcaggataacctctcacagtttgctgctgatcttggtattccatttgagttcaatgctattaatctcgacgcatttgatcctatggaactcattgctcctacagctgatgaggttgttgcagtaagcctcccagttggttgctcagcacgcactccactcccagctatgcttcagttggtgaaacagcttgctcctaagattgtggttgctattgactatggcagtgatcggagcgacctcccattttcccaacacttcttgaattgcttacagtcttgtctatgtcttcttgaatcacttgatgctgctggcactgatgcggatgctgtcagtaagatcgagaggtttctgattcagcccagagtggaggatgcagttcttgggcggcgtagagctgacaaagcgatcgcttggcggacagtgctaacatcagcagggtttgcacctcaaccactcagcaaccttgcggaggcacaggctgactgcctcttgaagcgggtgcaggtccgaggcttccatgtggagaagcgtggagcaggccttgcactctattggcagcgtggcgagcttgtatccgtctcagcatggcgatgctgatcacacctgcctcgaccatcatgattcctacaccatttgcaggcatgtttaactccagtaatatgaattttgtcttgcaatttaaacattgcaaagaaattattatcatggttgttgcacactctgttgtttattaggtaggcctaatggatttggcaatcttggtatgagtgtctctgtagtgtgtgaccagtggctatggcctctagggtcttaccactatgttgttgctctccgctcaattggccacttcatgttcttggaaacatttcgttgtgaatagataagataatttggcatgttgaatgtccttatgacaagcattagtgtgtatacggtgctgtttttagttcttttggtgatgtttggtagattagttgttgattcactcagcctctgatatctacacgcacgaggcattgcatagcttagcctgtcattttaatagtaggaggggctaggctgtcataatatccaaacggagtgcattatcaaattgcttgatccaatgattgctaatttgatgtatggatctgtctaaactcaaatatgcattacacttacatgctggaataaccataactgaatattacaatagcaaattttattgttttacacaaataatatagcttgggatattattgattattgtcacactagacgattttgctgaaaaaaaggtatatgccatgattttgaaacaaaatgcacgccggtgtaaaggttttctgtttagtggaaacaaagaatggttagggtgtccagggatgggtgcaatggttagtttgttctgctaaacatctgaggtttgcagcattagcaattcctgtgtacaatagaccaaattggaaaattcctgtgtacatctgaggtatgcaacattagtaatatatagcatgatgaattaatttgttttaagttctaatcagtgaagtgtatgtttgaatggtttatactactgaaaataaaaggagggcatggatgataagtagttgtgacaagaagaggtgaatcggatagaatcagattttattttggtccttttatacttgctagcttttgttgaagattcaagaatagttgcctgcaattggaggacaaggaatcgatgtatacactgattctacggcggagattatgttatacttttcctcgcaaaaaaaaaagattatgttatacttttatgtttttaaggcctatactcactaatacttcatagacttcatattcctcagagtttgcaaatgcagacgatgcacatatttgtgttctgctaattgtatatagggatttgtattttggtcttgaatagctcaaaattggcgatttttgtgattcatctgtgcttttgccagtgtagtttgaaattcctggctgtttctttttgttcatccgaaaccttggagataaaaacggccatctggattatctctatagtttgcttttgaaaaaatatagctctaaacatgtcctcacagtcacactagagagcagcagaattgcacagcagctcagacttttcattcagctaccattactacacagctcagactaatgtcgaaagcaacgtgcgaatttccttggttgcatatggttactgtattctgcttttgctcagaacacaaatctattagtactactacagtatttagtactcttcctgtcctactagagtactaatctctccgtcccacgatataagtaatttgtttttgtttgccacgtttgactactcgtcttatttaaattttttttgcaaatataaaaagcgaaaagttgtacttaaaatacggtagataataaagtaagtcacaaataaaataaataataattctaattttttttaaataagacgagtggtcaaacgttgcaagtaaaaactcaaaattccttatattatgggacggagggaatagtacatagtagtaaagtgtttttgccttgtcatcgattacccaaatttcatcatcgctgcgtgtaggcacagctggtaatcacctttaaaattgctcgtcacccgcgcaatagagacttgatgttgtttgctctcatccgtttcatatgcaccaaatgtacttctgacccatctcatgtgctatgcatgccccactcgtgctgtttccttattaatcgtgctcgttcagctgtagtgtctgctatactatttgcaaatctacagacctgacttgtggaccatttgggacagtggcaccgcaaccgaacatcggagatcgagtggctgatgcacggccaccggtcgcccgtcgaccacccccaccacccattgcgtgtggtccctcagtgttcatccatatccatgcttttcatttgcaacgtaagtacagaggccagttgttgattagtaaaattgatcaatggtggacagacacagtacaacggtcctttatttccagggcttatttaatcccttgacctctcacttggcctgtgtccccctccagcgtgctgcaaagccctatttgggcattctttgccttcatgatctcctgtcccttgattggcccctttctgcttagaaaaaaaaaagggaacgctttgagcgccagcttaaacaactcagaagccggttgtttctcttgaagcttgcaaacaaatcttggatttgaaaaagtgttacaggtgtgatggcctgatggatgagttagttccatgtctgcttacgaatttctttaagctacgacactaaacaaactgcatgagaacgtgctatccgatcatgagactgacagctcccttttcttaagcgatcgacgcaagcgatggcaagtctctcgtgtagcccgtactgtatttgtttatgctgccatgtacctttccctgccaatgcttttgcaccttgtttgcatgtgtactactagtactgcatttgcatcaacggatcaacctctcctcgctgccctgctggctgctgcagcctgcaggacaccaaagctggggtccgtaggggttaaagttgccttcctattgctgctgacttttcttaagccagggggttatgtactgaccaacacttgtgcttattcttttaaagctctcgctctgcacaactggcctgatgctgatatgagggggtgcaccggaggtaagtaaccggacaagctgtccgtcctcctctgaacgcgagtcagcagcaggagcagcaaacaacagcagcagcacaagaggttgatggtaacagttcgacaagtgcttttgaaatcgcttgtttacctctctgaacaaaacgtaggagtaagctatcaggtcaatgtagtgcctattaacctccctaaacatatcaggtcaatgtagtgcctattaacctccctaaacatcgtaatgtcttttctttcacaacaaactattcaatttccgcgagaggcacgaaaaattctcgcttccggagcggcaccaggcaccaaaaacgggattgcacgatcagagtaacagatgcagtgttgtaatgaccgtcagattcatcaaccaacgcgcttccgctacacccggggatcggccacacggcgcagcatgcgacgccgagtcgtgcaccacaccacactcggggtctcgggcgcctcccctccccggcccccgcaatgtgtgggggtccaaactccaaacccaaagcgtgacagggaccaccacatctgcgcgccactgttgcgcacgcacaggcacaggcacagcgcggcttcacctcgcctcacctgtcacctcccaccgcttcaatgcaactcgtctcgactcatcgtcggtcatcgccgatcaatccacccgtcaaccccggcaaatgtgccgtgtgccgtcctctcgcccggtgaaacagtgaaattgccgggcgcggtgcagctgtgcggggggaggtgcagggggaggtgcaggggaccgtggcttttcggggggaaaggagggaggccggcgctgcgcggcagttcggatggacggggccaaggaccgcacgaaacgagtaaacgacccaattccgaacatgatttgcgcgcttgtcatcttgttccggcggttggattgggatgggttggtcatccggtcttgcgcctgttctctcggctcaatcatactcaagttcaattccaagtggccttttgcactcgatggctgcatgcagcgtgacacagagtagcgtagatgcaggtcaggacaggtagcccggttggagagccgctctgcgtgcgtgcgtgcatggcagcagtagggacgcgagctctgcgggcgcacgggacggttagtctaaactctcgaacatattatgatcgctccggctatggcagggacctgctggtcactgtagaatcttgttcctcgatcctcatgcagtcatgtactccgtccgtataaaaaaacaaatcttgatttccgtgtccaacgtttaaccgtccgtcttatttgaaaaaattataaaaaaaattaaaaagacaagtcacttataaaatattaatcatattttatcatctaacaacaatgaaaatataaattataaaaaaaattcatataaaacggatagttaaagttggatacagtgtttgtctttttttttgagacggagggagtagtcgtgagctcaaccatggatgattggatacaatatgctgatgctcgaacagaactttactccatctcatatgttgtttttgcttgcagcacagggtagctttctgccttgctggtacttgctggcgtgtacattgtgcccagtgcccctttcctgggctgtcggcaatgcacacgttttaggagatgagtgactcggtggagaaatgatctattactagcaggcattgtgcgatactagattttctctgtatccgtcgtgccgatttatggtgtgcgtgtccagtacatacagggacagatcccagaatgggattaaagagaagactcattttcttctcccacattcaacctccatattgttccatcttcccctctcctttctctttccttctctccttctatcaaaagtgatcagtgggatagggggacttgagttccctcaacacctacgctagatccaccccctcagtaggataaggggacttgagttcccccagcatccacgctagatccacctccttgaggccatgtttagtttccctctattcccaactttccatcatatcatatcacattaaaaactttcctacacatataaatttttaactttttttaagctcttaactttctttaaacttttaacttttttcaggaactaagcacaccctgagtacatgatgtgcatgatgttgagtgatggatcgctgagaggaagacaatgcatacgggctagattgacgctggaatggttgaagctgagaactataggttcctagcttctactctcttcttttttatacacacattttccgaattggtaaacggtattttttaagaaaaaacttttatagcaatggagaaaagagttttttttgtcgttctcaactgaaatactacgtgcgtgcttttggcattttggtcatatattcgatctacatagaggaaaaatgtgataataaactgaaagatactccctccgtttcacaatgtaagtcattctagcatttcccacatttatattaagaggtctgctatacaatgggatcccgttgcaacgggataatttcaatgactctttcctaatacttgtaccttggttaccgggctggtacctggtaccttgggtagtgactagtacttgatacctgataccctagtaccgacaagtacaagtacctagtaccctagtaccggctaatacccggtacctggtaccttggttactgggctagtacctggtacctggtaccttgggtagcgactggtacctagtacctagtaccctggtactggcaggtaccaatacctggtaccctagtaccgggtaatacatggtacctggtacactgggctagtaccttgtacctgtaccctggtatcggtaggtaacagtacctggtaccctggtacgggctatactttgacaactggtaccctaggtatcgagctggtatctagatatcaaaccttggtacatgataacagcgtgataccccaagagagaggaggaggagcagttgcggagtccgggaggtcgagcagcgggacgagctcgtcgcctgggggccgctgccgaggatgagaaggcgacagatctggtgcctaccttgtaccatgcctccacagcctcctcaaccggctgtggacgacgacgtgctcggcgcacccctgccgccggccatgaaggtcttcatcaccgatgctgtagcagatccacttgttgccggccatggaggatgccgccgcaaccgcaccccgttccggctccaccgcgccccgctcccgccgccgagctcctcgccatcgccaccttccccgcggcggcggccgccggctccggcgagcggtgggtgacggcgacggggagggctgcagtgccgcctgatttgggggaggagagtgaggtaggaggaggtgacggggagggctgcagtgtcgtgtgatttgggggaggagagtgaggtaggaggaggggatccggatgatttgggggaagaggagtgaggtaggaggaggggatcccgtctccacgggatgccgtggtgtaggttttctgttatattaatgttaatgaatctaaacatatatatctatctagatttattaacatcaatatgaatgtggaaaatgttagaatgacttacattgtgaaatggaggaagtatctaagatggtcagcgggatcatgtatgcactatgcaatacaacattcttcttctaacaccggttgatattactggttcatatatatctactgttgatataattccatatactccctccgtccctgtcgaggagtgatcctctctagcgggaaatcgtgagatcccctttttgtgagttcggctgggggaaagagctcgcctccagagatcgtgtatccgccctgaatgctactaagtcacatatgggtgacgagattatacaggttcgggatgctatggagcgtaataccctactcctgtgtgtgggactaaggttgagtgttacaagggctcctaaactctggagagggctctcgctcttcttttcctagagtccaggcttgctgagagtcgtcccttttctcggtgggcaaggtcctccttttatagctcaaggggataccacatgcaccgcctctacctaacttttcatgggagggggacccacttcaccttgtccgggccacgatccgtgccttcgcccggaagctaagcagcagcccgtccttgagcgcgacccagcgccgccccccgcctgacacgggggacaaccctgtcatccccttataaatgggtgaagacttgtggtggtcctcctctcgtggagggagctccgaatgacgctccgatgggacgggtcatacctatctccactccgccggatacagaggcgacgtgggggcacggccgcttgtccaatcggtcttgaccggcgatgggcccgtcacagacttggtcagtcctgactaacgtgcgtcagtcgggcggcaccgcacgtctgcccctaccgcattaaatgcggtgaggggcagttggggcgcctcgcattgatagcgtttagcctgggtcccctctccgctcgctccccctgccacatgcagttgggcgaggcctcggggcaaggcagcacgagggcccgaggggcatgacatg

SEQ ID NO: 36495 - DNA, 12880 bp, Oryza sativa
cccccccccccccccccccgccgtttctgcgatttgcaaggtgcgggggtagggccaggatgtagggccacgtggctggatgggaaggtaaattcccctcactttgcatacccccaggcccatatctccgacagtccctaaatatttgacgccattgactttttttaaacatgtttgactgttcgtcttattaaaaaatttaggtaattattaattcttttcctatcatttgattcattattaaatatatttttatgtatacatatagttttacatatttcacaaaagtttttgaataagacgaacagtcaaacatgtttaaaaaagtcaatgacgtaaaatatttagggacggagggagtatcttttttttcacaaaattttatatatcttgtgaacggtgctatacttttgaaatccataaccaaatatctcttctattttactatgggtagcgtataaatgctgactgaatctatgcggtttaacactaattaataataagacagagttagggtttgtcacatcactttatatttattttttatttgttaaacaaacttatggttgtgtatcttatagcagaagataaagatgtgaattatttttcattatctaaaaaatattatcttggactttcatttcttaagtgatacaataataacacaagctctctcaatggaaaaacaaaaagtacagttaaagggatagagctaaaaaaaaaagggcaagatgcatgtatgtactatatagttgaagtggtatatattatgagtgatttactgtttttaggaggtaatacgaggtatcagaaattttctggtgtaattttataattctcagtactggtgcatccctataacaataaaatttcccgtaatatggtccatatatgcatgcatacgggattatagagatcaggcatgaagctactacacatgtatatgtatctctcttcgagcctaagctacgtatctcctagctaggagaacaggattccgaataagactaaagttacactgaacaatgctgatcgatcgatccactggacacgatcatcatgatgagcagacattcaccggccagtacatcctttttcctgatcaatcggtgagaaaaggaggaaaaggaggaagaaaaagaataaaggaaacgtgatcatgggctacaatattgtactgcaggtctcagatatttgcatatagcagtgttgtagtactgtgtttagtgtgtagtgatgcacacatgaatatgcttttggaggtggcaagcgctagcgtgcggcagtcaacaagccgagctcgagcgagtttggttacgtaggtttgagcttgatatgaacttgagctaagctcgagccgagcctggatactgatcgagcttgggagtgagctcgagttcgagctcgatcgagcttcgaacctactcgagcttgacagcttgatttgttgaaactctaaagaacttacactcttgtataagagatattaatgtaaattatcagtagtcaaaattaatgggtgctacttgtcttgaatgaaacctctgcagcttttctcatgaattcatggctttgaaacgttgcaattaacaaaagctagccactatatctaatagaaatagtagtactattactagcagccgaataattgctttattgagaagcattgatgaggtcttgagacttgaacaagtcaagcacggtgacaagtatacattgacccatcaaaaatatctttctacatgtaatacatcttatgctaatcaagccatgccgagctattcgagctcgagcttgcgacttgcgagcctcagcctaggcttgagcttggcttgtctagtattcgagccgagcttgaatcaaacctgtaacgaatcaagctggagcagcttgcgagctccgagcttttttgacagccctagtatatatacacaactacacacactcccggtcctgaagatattgggcctgggcctgttttctggtccgcgacggtggcacaactggcaccagcagtaccacgcgcacgcagcgcagccgcctccgtcgcatcaggcttgtcgaactagcccattagctaatattattaggccactgtataagtatattttagtaaaagcaattttacagtatttgaagagataaggtaagatgcaatattttttaatgtaaaatttgttaactttcaatatcttaagtaccatggcgtatgagaagcatggcgaaggatcctctcctctcatttactcctcttggtatctcttaatggctgttggaataaaatccaacaagcatggcaataactctccctctatgggagggaactagcttgaacatatggagaaccaaatgagataagttgaggagtggatgagagtgagatagcagtgaagatggagataaatgaatggaattgaacgagatcgccatctttgccctttaagaatccttttaatttatatggaatgggaaattacaatactatctttccttttaacacaggagtagcattccaggtgtggggtctattccccaacaatgaccgtgaaatttcttacaataatgtgtgtgaatttcatcactcatatatgcatgcttgcagcttgaggattgctgcatcaatgacgagtgccacaaataaaacagcagagaaaattagcatgttacgctgaacgtaatctatatgcatcacataggccacaaataaatgggccttagaatatgagggctaaagactagtgcatgtctctgtgggcaacaaagatttgctaaccagcttgcatctccgttctaaaagcgttttggacttgctttcagaggcaagtgctaaaaccccaatgtcatacatgtgtttcgttgtatgtggaagttcacaagcaaaagaggctaagtgatgttgacaaaagaatgggaagaaaaggatcgaaaaataaaagtagaatgaacttggaatggtcgaccttggattagataagcaggggaaaagcctacctggtgccaaaaggaaattaaagaaaggggaaaactttgcatgggttgtaatcacacatagtacttttgagatgcttctctgaaaacgaactacaccctgttctgcgttgttttttccccagcttttcaaacttcagaaaccatacaaggtacttcctccgtcccataatatttgtctttctaggattcaaaagttatcttaaaatagttgtcactttagagtactatttatcacatcaaccactttcaattcaaatttcttcccattctacccctaaccaccatcttatatccaaccatacattatttttaaggggtattatagtatttttctcctgaccttaatatacatgcttaatatacatgctaaataacctggaacgacaagtttgatgagacggaggaagtagaaacaaaacagatcacacaatcagtacatcattgtacgtgatcaacggccgcacataatgtactaagtacaaatccatgaattgaatctaaggaattatttatgattagacagccacgatgcaatcgatcggatgcaagcacaatctatctagctcagctaaaataatttcttcgcgtgattgtgcccgtacaaccgacgctttcttcttctttttttttcaaaaaatctttcacgtagcacaatccaaaaagaatgcactgatgctcatcggaaagatatatataataacgtgcaggagagcgaggagggggggggggggggggcagtgcaacctccctatctgtcactctgcacttgtatgaaacatagcgcgccgggcgcctctctcgatcaactcctgtcacactcgcctcatgtggtcctcttgcaatcagttgtttatttgtagccaagtgcagcagtattgactagaaattagcgcaggtagaaaagctagtaggagaattttgtatcagtgagatgtataaactaaaggatgccccgtacgttgctgcgggacttgattaacattaatttgttagatagtaggtacaatcattaatttgttagataggaggtacaacctcaagaagaaacaaatatgtttcttggagaaattctttttagcagccctatctaaaatttgtagataatttaggtagcaaattctttttagcagccctatccagaatttgtagataatttaggtagcacatatcaactgaaggtcctatccaaaatttgtagataatttatatagcacatatcaactgaatgggcgttcagccataaagcgctggatacatgtagatgtgtgtggagatcacagtagaaaaaatcggaccggaccggcggttcaactcaactgaaggggcgttcagccataaagcgctggatacatgtagatgtgtgtggagatcacagggaccggaccggcggttcaactcaactaaaggggcgttcatccataaagcgttggatacatgtagatgtgtgtggagatcacagtagaaaaaaccggaccggaccggcggttcaaccggaaaaaacctaaactagggacctcgccggttcggtgtgtttcaaggactgttcatgcagttgacccagtgtgaaccgactgaaccggacggttttcaggaaaaaccactgaagcggggactcctaaaaccggctggcccagttttcaggaaaaaccactaaagcggggactcctaaaaccgaccggctcatacgagctgggccaccgtacagcatcttccttaatgggaagcccaagtcctaaggcccagttttattttattgttcaaaaatcgggtgaagcatgggaatcgaacccaggtttgctagatggagcgttaagttccccaccactacaccacactgaccattgtggtgtgcaataaacaataaattttaacaccgcggttgaaccggtgaaccgaggcctcaccaattcgacgtccggtccgagtttttatactatggtgcagatgggtcaatatattcatgtgggctacatttgacactgagaaggcgaagagactgactcggtgactaatgggttgggctctatgctgtattccatccaacgtctgaaaagcgatctaatgcattcatccaacggttaacaatttgatgatgatgtggaagcacgaggtttgagcttttggccttaactttatagaaagaatggataacacatcttagtgtcgatttcaccgcgtacacgcataaagaagatatctgctatatatatacacacacatacacacacagacacaagtaaaatatactgttatagtagagcgaggctccaagaaactaacgtactgaaaataagcgtttagtatatactgcataaataataaacgagtcaaccttggcctaacgtttataatgtaatggcaaattattcaattaagcactatctctacttcacagaagcagctttcatgcatggcgcttttgcttgcgatggctactactgttgttctgcttgtgccacaatcaaccggtccgagtcatgcatgtacatgtcttacctttcttcaggtcaaaacaatgaaacaatgcatgcaatgcacaccgctcagccctcaattcggccagctcaaaatcagtcataaatcgtcgagaaaccatggacatctacagcgactcccacgtgcgtggacttgctgcgtcgtcttcagttaataatctgttgctagggctcattgcccttgtgatccgtgcttagccgctcatccttttcggtgccttgcatccatcgatcgattttgctctcgccatcgatggatcgatcgatctcagcttttgccatgggcggtttggattacgtatgggataagggcgtctgcaagtggcgcggcttgctagctatacctgccgcgtcttgagatctgtggagccacgtaagtcttcagttagccacgacttggagatgagatgaggatcgaggagctgatgatgaaggagcgtgatggcgagagacagggagctcagggccccttaattaatttggatgtatagcactatacgatgtagtactagattaatctttaagagtggcttgatttcttcccatgtttagtcatcgtctcatcgatcatccagtgcaaacgaagacgatgtagagtactaagttacaaatatacatatgtgcatgcaggggccactgaggctgtagacggtagttatctgttactacaatcctactatactaccttagtacgggcgttcatgttcttatacgggagtagcaatcagcaataatctgcgtggcaacaaaacgaaggtttgctggatagaagttgaacctgcttcttatcaacaatgcagatgcatgttggcagttttgtttgcatccgtggtggcagtgaagacataagactgctaaatttgcagtccctattcaaactgcataggatcccaattcatttctaggactagcagggcgaattgagatccagtgcaatttctaacaatctcagccctctatttattgatccaatggttcaaattgtgagctacaataaaactagagctgtactttttccaagtaaaaaacgctaccgtactttgctacagtactgaggcatctgggccatccgttttaaatccaatgatagctcttgtgactgcttaacttacagtcacagtggccactgcactggaaccgaatcctagcagggcacgcgctcccaatgcttttgctctgcaaggctgcaactgcgaaagctataatccgagttgtttggacaagtagcagcggcaggtcggtaggcacgcccctgcagcgacgactagctgatgtgtgtccctgtgtggcagcctggcaatggcagggcgaggccgacggccgacctgcatctgcatggccggcaccgttttcggcccatctcagtctttccctctgccggccggcgagccctgatctgtttaaagggagaaaaatactgaagtttttgtttggaaaaacaaaattcaggacctcgtgcattgcaatagtgaattgcattcagaatgattagccatagacaaaatagtttcagggtagcttcagaaacgtcgtcagagattacgcaaaccgacaggcgacagagaaactacacactggtcatcatgtacagaaaacgggaggccgtttcgagcactggcaccggaaaacgcagcctatttctgaacactgaacaattaacgtagtattaccaacacgcgcgacagctaatctcgatcggtagctttcgctggcattaagataagattcacgcgaaccgcaaccggtggtcaagggaagaggagatcaaatagcacgccaacacgcagaaaagatgatacgctaatgcgtatccagctagattataacgtgctttgccgatggcaaatcagaaggggaagggatcggattcttgcatccttcattaacaaggctgctggtttgtcttggcttccaaaaaaaaaaaaatctccgagtccaacaagacgccaaggtcgattccttgtttgggctagataaacaatatgggcttacttgtgaccaaagtattaggcccactatatgcttgaatgcggcagaacggcccacttaaaactccaaagcccagagcacctatgggcctcagccgacgtgatcacggtgcatctctcagaaggttcccatttccacgttggtttatcaggtgattttagatctatcctacggaaatttgatgttttcccatcgaaacctgattctagtggaccgtctagtaccacgtgtgcttcaaattgcaggtcaaaaggagattgtcccctcttcgaattacacctccagtctcctctccagctgtttcaccggtgaatcagcaagattacattagcatctgataggaaccaacacttctgctgcattctcgcacaagctttaagagcccgattataactcgctatacagaaatccggaaaacctcccgcattccacacgcgcgcctttgtcaacagctagagttgacaatcatcacttcatacggtaggagttccatatacacatcacaagcaacagaaatcgctcatagccaagatgcaatcctggggctggagagagcaccttgctcctcaggtgtaaaaaaaaaagggaatttgtgaggggtttgctcttcctgccacacctctcaagtctccattttcaggctttttcgcttgtaaaatttctcagcatttcaccagggacacaatttccaaagtgtctaatggagcctaagattgttccatggaggacactggcagatcactagcagcagcgtcaggcctccgggactccatcttcgcggagatctccgccatgaccagcctcgacaggagcagccccgcgacgaaagcggacgccatgagcatcgtgaacacgccgctccagctcttggcagagatgtaccccgtcagcagcgggccgaccgcggcgccgatcgaccccgtcccgtcgatgatcgccgtgacggtggcgagcgccctggagttgccgttcagggagctgtgcgtgccgaggtcggcggagacggcggtggtgatgagggcgtacggcccgttgacgagcatcccggtgacgaacatgagggcgatgttcgagtacagcgagaagctgccgtatatgcggtagaagaagagcgccgggatcgccgagaacgtgaagctcgccgccgtcagcgcccgtgcgtcgaggcggtcggagatgtggccggcaaggatgccgccgacaacgccacccacgtcgaacagagttgacagtacaccggctgcggtgtctgacaagtacactccaccgattgctgaaaaatggaaacatattggcattgtcaggtacattatcattcttagtgctaatacacatcagattacgccagaaacaaagtgcagttcatactagtacatgacagaatggtttggttcaaaatcatgaggtaaaagattaatttggtatgaggaaaaaaaatcagtatgatattgaaattgcacacaagactaggggaaccttttctcggaaaaaggagggacgaacctgtgtggctgatataaaacggaagccaatacaggaatgtgtaagccacaagcttgcagaagaaaaggcagagagcaaatggcgctacaccaggaattctccaagcctgaatgaacccgactgccttttcttttgatgccgatcgttcttccaacagaggtgcactcatgtcatccttctcagcatccttctcatggatatcctcctcgattccaatcatctccggaccgacaggcaagaacagaaacactgcaagcccaacgactgcgatcatcactccagggactgcaaacgaccatgaccatccaaacttcaacattgcagctgcaattaaggaaccagatatgtttcccacagatgtatgagcattccagattcccattatcagccctcttttgctctttccaaaccaattaccaacaactgcaaccacagatggccagccggatgactgaaacaggccagccatcatctgaacacccagaaagtagtagaagttgtgtatgttgagccagttgccggcaccaaaggcagcagtgaaaaatccagtgcctatcattccgatggtcagaagtatcctgagatccacccgatcacccaaatggccagcgaagaacatgccgattgcatatactccgagaaatgccaagtcgatctccccgagcaatgcagtaccatcgtcggcattaaacggagcccagccgctatagagagccgtcatgttgccctgtgcatctcttaaatcctgaagatacagatggctcggccaatgcaacatacttaggttttctgtcttaggatcaagaacactcttgacaatgcttgtagtcttcctagtggcatgatagctagcataggataagaacgtcagtatcaatacaagagcctggcatgatctgaaggagataggactcccccgggcacactcatatagctgaatccccaatggcttcatccgacgtgttttgcttggggaacccatgaatgaagctgaatttggtttttccgctgaggcggctgcaaccaggaagaagtattatactgtctgcaaaaggccaaaagagaaatcatcaggagttgtccacaggaccacaaaatttaacagcttgacacaaatggaatagggaacttctggttcacaattgttcggcagcaaatggacacggtgaaagctatagagcttattctgcaaggaacacgcaagcatctgacgaaatgaacaatattttgccaaattattggggcgacgactgcacgtagtttaatgtggacgataagttaagttggtcataatttaaaaattgtataaagacgaattgcataaactaccttgcacttcgctattcgtgcgattaggtaggatgttacgatattcagaaccgacactttcttttcttgcccaagtgggatttcccgtttcatcacgagcaaaaggaaaatacaggagttgacgaccagttccgattagttgatatgcgttgaacgagcaaaaggccctatgaattgacaatacacagcgacctgaagtttaactgtgaaggccctatgttttaatgctacaaaatcaagaaccgccgtttggtcaggttcctatcttggcaagaagttctgaaggcatcattccattgtctaaatcttttttactacccattgtctaaaattacaaataatcaagttcaaggaccaagaggaaaacggaagaagagaactataattcaatcaactcaacaattggagggacaagaaacaaaaatctccttcaaccatagcatcatcttacttccgattcagaaaccgaaagaagaatcgattcagaaacgggaagaacagaaggcaactggagagaaaacaaatactccacactaatacctgtgccctatggatcccttgttaactcaacagcaagaatgcaaggagaaagcaagacgggtcctgctcttgcaagcaagcgaataaaacagacgcaaccagaggatcgcactctctggaagcaagcagaagaacaggggtccatagaaagagagttaaatcaggcccctcaaatttgcaaggcaaataaataaggcagacgaggcgatcccgtttggccgaccagaatctagtttttttctagacggatggaagatcaataaaaagagaggagatttatcctagaaaatgggaaatttaagccaggagaggaggcgaagagatttgatcagatggagcatgcaaattacctgcagtcttgcagatagaggttcagaagttggctgttccaggaatcgtcctagaaacagcgtggttcttcttcttcctggctgctttggcgccgtgaggaggcgagcggaccgcggaggggaagctttctggagtcgcctcgaccgtggcttccgaggaattactggtcttatagatgtttacgcgagtctttttggcttttgtcgtggtgaccgttccacgggccacgggcgctgttgggtcaggtctttctccggtgaggttacactaccccgtggttttcctgtggcgttcaagtcgcaacgattacagccttacagaatattacagggtcatagtagctgctgtttaacaacttcgatattcgctgcttctattccttttctcatctctgaactttcctctcgttttgaacctgaaatttacaagttagcctataaacagatttctatatgatatgatggcatacttggactaaagagttcaaaacttcaaatcatgtaataccgatctattaattagaagtacacacgcatatacatacggtaaatgtgcatgtttctgcacttctagaccgtttatttctccaatattatcaagtgtttggaaacctatacacgtgtagtgtataagtatgataaatgctcattcaaacgtactcagttaaaagtaacagaagaatttcgctggttgatgatcaaattagaatgctgcttgttcataccgggaggtgaaggcatacacctacctttgccggttaggtggattttgctaatggccagttcaaatgccagggacagagaatggggagatatagatataggatattcttctgaacaaggatattccctgtgctctaatattatgctctctaccggatcttcttttgagccccacaactgtagggccatggcaaagactacaatcttgtggctcatgttctgcccattattttcttaatatgcaaattcgctgttgagtgcgacaagtgataaagctaaacatatgacccaattagcctaagttgtatactgttttttatggtgtaggtaagccaattaacgtcaggcgatcactaacaagcaaggacctagaagcagtcaagcagacacacctaggaatcactggatcaatgagcaaagaagagagagaacggaccttcaacctccgatcgattctccccggtctgcgatggtggttgaataagtgatgcgtgaaagtcaggtgatccggcgaggcgtggctgcacgtacggcacatgagacgaacataatctatcttggtgaaagacacagagcattatgattgcaagcttccaaaagggtgtcggtgtatatgatgcacctcgatccgtcgagggagtccaggacgtgcaggttcgccatagccatagccctagcaattccgcttagttgaattaggatgtctaaatatttacgttgtgtgttactattatccaaaactaactctatttctatccccgaaaatcgagaaatacgaggaactgccacgtcagggcttcatattttatggacttgttcactttgatgtcattttcaatcttaccaaattttagtaaagttgccaaaaatttctatatttagtttgctgtcaaattttagtaactatataaattaccaaaattttgttaactatgccaaaattttggccgatcgaatgtt

SEQ ID NO: 36496 - DNA, 4875 bp, Oryza sativa
tcatgaacattcgatcggcggtccggccccttagagcaagtttaatagtatagtctctaaatagctaatataatagtcaatttatacaatagttgcttactatactattaataactggtctcacctgtcataaacacattacgttttggagtccatgctgcagccggctacagatatgtagtccgctgctcttctctttctttatttatctttttaaaatatgtttatagttagcttatagcttggagttagtaattggctacactattaaacttgctcttatacgccagcttcgcactgcaatgatcgaccggtccacgatttgtcgatctgttgttaccgaacattgaccggacctcgcgcgatgttccggccaccgcgacacgggaaggcacacgtaaccgagcagatcgatcagcaggggaaatcacgcaccaaacccgcgcagccccggcacgttgacgcgctacgcgctcccgcggaaacccagcgctgatccgggcgggtctcgcgtgcacgcgtgcccttggagcaggaggacacctctctgcctccgcggggcgggaggcggccgggtgtgagtgcgacacggcgagacggcgagtctcgcacgtacgcgcagcgcctggccacgagtttccgaggggatagagataccacgcgcgcgcgcggacgggcaactcttggatgagaacgccgtacagcgacgttacgcttacggcgtggcagcgcgcgtatctggatcgcttggcggagtgacgaatctctagggccggtcgcgctcagttttcaccgcgcccgcgaggggatgcactcgcgcgccggttcgagcgtgacagaccgacgttcgtccgacgaaacggagcggagcaggcaagtactccgggactgtgcactggcgtggacgcgtggctactggcatgtgtggtgcagtcgtggagccgttttcttctcgtctcatcgggaggttcggttccgacctgtcctcggagtcgcggaaacaaataattcgatcgaccatagtgacgatgctgaattgatcgctgatcagcagcagctcagcatgcttcccgtcgtcccgtaggtcggaaaagaaaactccagcacttgacaaggagcaaccggataagtgtcttgacttgttttatatcagcatctcaccatcatcctcacccatgttcgggcatgtactccaacatttaagaattggccttctctctatgtattcttcacgtagtagaaattagaatagagtttataattggaaatcttctgaacaagtggagtaaagactaaacagtatgaggtggctcttaattcaccttgggtagtgcagttctattaataaaaataggtaactagaatctatgtggtttaatgttagtcaacaatgaaaaagaattagaggtttaccctatcacctatatctattttttatttgttgaacaaccaaccgttgtgtgctttatggagaagccatggatataaatcatttctattattaaaaagagtgaggtgttaaataattgtctattatattattatactataaaaataatttgaaaataaggcaccatattcactctggagactaaaaattttcaccaagctcgacatttaattcatctcctaggatgaaactctagcgccgtcaccccacgaaagatatccaaaccgctacaccatgctcttcatcctcattggtttctgacaaacacaatggcgatggccgatggcagtaggactctattatatgtttcatcctacttcccctccccctcgactgcctagggagccaaccatggatcggacgtctccagcattgatctggcactttggcacacacatggtagatgatcttctccccgtcttatgttgtgtcgtcatccgaggtgcaacagcgatagggtacagagatatcatcgggcgtcttgtgtgccaagaagttgatataggagcgtccaaatctagctagatacaagcagcatgacatcaccaaccgctgttgtgccactggcagcgtgctagttgacgacatcggcaacggggcctggcttggggcatcacgcctacatccgaccttgactgctgccacctaacgtgtacttctaaataatgttttcatcgatattcaaggtcttccacaccaacctatagattggtgctatcttggttttgattgacaatatcgcttatgtccacatcttactcgttctctagatggacactatggatttgtgagtgtgtgcctatatattggtttgctcgcagcgcgattattgtagggtatcacgtctaaacaaggttataggttatggtgtttatggtcgattggattgtgctaatactgggaggcattatggcactagctcggaacaagagaataacaatactatgagacttcgcttaggtggtgctcgtcgagtaccgtttcctcaactcctaggttatgaatatccagatatcacctagtgtttttccctttgcaggttggctttttggctgaccctgtacatatttctcttgtatttctgctcctctattaatatacgaggcaaagcttttaccctcctttcaaaaaaatgaatatctggatttagccttagctagttataccgggcaaatagcagtttcctcttccttgttgggggtgttgtctagacttttaagaattgctctctacagtgaaaacctatggtttagtctttgttgatcggatcatgacaacatatgaacatacctgtgttcttatcttaggtgctattttaggggaaccttagtcgtagtccagtgttactttggtccacgacgaggaaccttttaaaaatctgttgtatataaattacaaatatatttgcataattatagaagtcaaaagttgtatgaaaaatccaattccaattatatataacccttcctatatagccccgttcacttctcagctgggccttttttacaggtacctttcagttgggccgagcctgatacagctccaggctgaactggccgaaattttccgggacgtcagatgcgaaacgaaaggacaggatcagaactcagaagctgactccaccgaccttccctgccaatgccggtgcgtccccctctcaaaaaggttccggcccaaactcgagcagatttgggtcctccctcctccgcctcctccgccgccgccccctgtatcccaccggctcgccggagagtccgcctcgccgccgcggcctcacgggcgcgtatccagcctcgcggagagcgtgcggaaccgcgacccgtactagggcagcgcgagagagaagctgctgcgccctgcgctgcaaaggtatggctgttactgttcttccgaggggtctctaaatttccggcgattcgaagctttctaaagcatcccggatactgtatcctgtaggctgtaggtagattccgacagtggaagcgttagccgtccccttgcgctccgctgccaattggtagtctcagaatgtgtagatgcagcgtctgcttggggaatagggatgctccctatttgcgctagcctgataggacggcacttcagttgcaatctgatatcctgcttagtgcagaaaagccaaacatggcatgtgaagcgtagaaaatcagaagtaattttgtaacttctcttgctaggtctacagttggagctcttgctgctgcttggaagacttcggacaagaacctaagatcatggtgagttcataaattcacttcaggtcctgttaagtaaccatgtgcaagtttgtttactttgacattcggttctgttcaggtatgtttcttctgttctgtggtcatgtgtgatgtgttccatttttataaacagtgccattttacaggcaagccttgctgattctttcttagcggatcttgatgaactttcagacaatgaagcctatcctgtgagttggtttcagttactatgataatacagattttacaatgatttatttattgagaatttgttaactaatcatcaaatttcaggaggaagaaaatgctgaggcagtgggcacggaagagattggtgatgatgatatgcctgacctcgagtctcttaattatgatgaccttgatagtgtttcaaagcttcagaaaacacaacgttacaatgacattatgcaagtatgtgatcaagctcaaaatctcctttttcttgaagatggttttgtcctcttgttttaattggattgttgtttgacttctttcttctagttttctgattttgaagccctgtactgtcctattgtcacaagaaggctatttgcagtcaaacattaatgggtgtgttttagagtccaagacatgtttaactatatactcaatgttacaaatgctttgcgcaaaaagtacaatccttctaaatttgattctaaaggggactgtcatttgtatttttaggtaacaaagccttttgtttccatacatggcaacttacagaatcactctttgtttgcagaaagttgaaaatgcacttcagaaaggtacagatttttccaatcaaaggtcgatcctggaggaagatccagaataccagctgattgttgattgcaatgctctatcagtagatattgagaatgagatcattataatccataatttcatacgtgacaagtataggctgaagtttcctgaactagaatcccttgttcatcatccgatcgattatgctcgtgttgtccagaagattggaaatgagatggatttaacgcttgtagatctggaagggcttttaccttctgcaattataatggtaatttcagtgacagcatcatcgacaagtgggaagccgctttccgaggagaacttggtaaaaactattgaagcatgtgagagagcccttactcttgatgctgcaaagaa

SEQ ID NO: 36497 - DNA, 1234 bp, Oryza sativa
atgtattccagagtaccccaccagctctgaggactcgtgcttgcagacttatagctgcaaagtcaactctagcagcaaggattgattcgatcagaggtgatccaacaggaaaagctgggcgtaacttgttagaagaaatccgtaagaagattgagaagtggcaagaaccgcctcctgcaaagcttccaaaaccacttcctgttccagactttgagcctaaaaagaagagagggggtcggcggcttcgaaaaatgaaagaaaggcaggccatctttaacctcctctttttttttctcaagcgaaaaacaaacaataaacattctcttatttaattgtgtgttctactaatcattcatatttctattggcctattggtgcaaacttggttcatcaaatgcacagttttgtatcttgtcgtaaagttggaacttgattctgcagatatgcacaaactgatatgatgaagcttgctaaccgaatgcagtttggtgtaccagaagagagctcattgggtcagtattggcatccccatttgaatgatgttttattgttttgtttcacaataaattatcatggagacttagatttattttcttaacataatcaaatattggtgtcatcaggtgatggtttaggggaaggttatggcatgcttggacaggcaggaagtggaaagctacgcgtgtcaactgcaccaagcaaactttctgcaaaaattaccaagaagtacgcaattttgcttctctttgttacctgtcatcttgttttagaatataaaacaaacacttcaagaacatgaaatacattcagtgtgattgcatgatagaagttgcagtaacccataggcactgttagtgttacgcctgctaccataatgcctctaattctctttacgtaatctgccaaaataccaatattttgaatattatccccttgattctgtattgctgtctgatatcagattcaaggagaagagctatggtagcagtggtgcaacatcggggctgacttctagtttggcgtttacaccagttcaggtaaattaaagattttttagctgtctcgtttgcttcaaagataaataaacggtatgcttaatctttagttgttttgacttgggtcatggaaaaggtagtacatgtaatttttgtttatcaatagcttcaccagtagaactcttctaaattaggtgtattctgctatgctgctggttattgcacagcttcgtggattt

SEQ ID NO: 36498 - DNA, 2583 bp, Oryza sativa
  unsure (1)..(2583): unsure at all n locations
cctcctgatttctgtaaggttgctcacactaggactgcgtggtgttgtcggagttgttggtggaggctcaggggcatttttcttatgtaaggagcctgcctgatgaatcctccagagtataactgtggtatctcgagaccctgttacaaggtagttgctatcatgagaaagtgcaaggcaggtaacaggagcaagatgtccagtagcagtttcaatagtcttcgctccatctggggagatcaacttcacagaaccatcagcatgcccacctattattgagtaaaatggtattagaaagcagacgaaacttcataaaaaaaatcattaaataatggaagctgcctaccataacacttcattaaaatccagaagtttctatttgagaaaaaaaatccagaagtttttattcgagaaaaaaatccagaagtttcagatcaagctgtttgcttgactttatctagcgcaacaggtgttcagtattttaatttaaatccaatatatgcaagatataaagggcaaatttgcatctttggattcgaagtgttgtcacaactcacaaggcaatcttaaactacattgcttacatgcgcgtgactttttacattacaatatgaatccacaactccatgctgtgttccatttaatgcctttcttgtacgttagtgaatgtctagcacatatgaacttcattggctcatgataacgaatctgtctggtaagaaaatgattatgaatctataaactccccccaaatctagcaggtaggatgtctcatcctccactagtaagcagagaattccccagaaaatggaaagaaaatgatggatgaagaggaaagatcatctaaatgaacaaaaaaaatccatatagaagctaaagcataaacagtcaaaagaaacaattaccagtgataatctctttgtcacatgtgacagcaacaactgctgaactacggatgccagaagcagcaaatgctatagctcttgggaagtcataatcttctccagaactagcagatcctttaaaaatgcgcatcagtgcaccaccggttgaatttgcagcatttctaccatgatgaaatagaaagggtgtcccttggccatctggagtatttggttgccaatggtgaagtgccacatgagcagcaggcacatttacatctacaactacaatagagtcattggatacaaacatggtactggccggaacattgcagcgatctggatttggaagtaaatatgatttaagttcacttggattccggaatatagtctgcacagcaaataaaagggtcagtccatgtaaaaaacagtgaggcaggccgcaagtaatgtctactcttgaacatggaataccagctccaccatgtgaaaactagttagctacacaacccaaacttaattaaattgccagctaatgcttttgggttcaatttgaactactttccagtgttccacaccaggtaacttgaatctgtttacttgacttctatttgacaatactcctcatccaaggtggaataatttggttctgttcaaagaaatgctttgaatcgtttgctttgggggttgttctcaatagccagggtttaatatagattacctgtagatgtaaaacttctgccaatggctttctcctcatgtggggaatagttagcaattgagatggtgtttgtccaaagtaagcaatttgatcttgcatggcttgccgttgcaccttcagcattttcagttttaaaaaaatatgagcagatagatgacaacacgggaaaccaagcactagcttgagcgcatactagtacttactggatctgtgattttgtcaatgtccacagttccttcatatgtaatgtagaagaacacattgttggccattactgcttctttacccctctgtttaaatctgcaaaagaaatattcctaggtaaatggtgatacgcgacgagaaaaaaaatagaattggcttcttaaaaatactaaacagaagtcctatatcaacctacatcattcataaatgtaattttcaataattcattgatatgatgatccacaggaccattctccttaaaatctagcagagaacattttcaaactcaagaatcttttctgttcatgtggggcctaacttattgaactttgtcattgttgaaagtcttgnttggtcttcttacaaaacacatctttttattcagatgcagaacttgtaacaggatgctccatcagatggctacagttttttagaaggatctaccattatcttagaggagcacactttcggaatgataacttgcagtaatggcttataatataagtacctattacaagtatcttgaatagcaagtgattataagaaagggcaaagggaaggtgaattacaaacttatttatacctaccccaaattatagagtgattgcataatataagcattcaaattaaaaaaaaaaaaggaaagtgagggtacccaaatattaaatcaatccactcatgcaaatgagcagaaacatgctcacttcaagagccttccggtgtttatggacaaaatcaacagggtcctcagcccaaggaggcaaatttacagaatct

SEQ ID NO: 36499 - DNA, 1974 bp, Oryza sativa
  unsure (1)..(1974): unsure at all n locations
cgctcttggaatttttctagtcgctcagggtttagtgcaccaatcggctgcatcaaataatactcacaacggttagcatcctagataggcaaaaatatagaaacaactgtcagaccaacctttgaaagatcccgatatgtacatgggtcatccagattaagaatttggatcggtaatcagcaattatccaaggaaaaacaggatactgcacatgcatgtaaattgttagaatgataagttaccttgttttagagaagaaatacaagtgcagtaaactgacctgagttatgtcattgtaacttcgtccagccagtgtgttcagtttcatcaagtactcaaaatggctaatctgaagaaattgaatatactgagattcaaagctaccaacaacagcatagaaaaattatatgttgtgttcatgtacctcccagttagcccagcgctccgtcaactgagttcttttgaagaattgctcagctctctgaatcaagtataatatattactgacaaacgtcattgcagattgatcatactagagattagnaanatggggtttcacacgaacctgggtagctagaanaatgtcattcaaatgggaggcttgctgtgaacnattgcncgataagcatttttgcgtgcttccatatcctagatcaagtgcaagacacaagtataataaaattatccggttgcatcatctgtatctcagactacagagagtagagtttcataaagagtgtaccccaaaatcaaaaaagaaatttgacctatctaccataaacaattccaaagcacttcgccgcaacaaatatctgcaagaagtcattgaaaataaccaagtaagtgaatagaaataaaaattatgtggttaatgtcattgatgctgcatgcatttgcttcacaagtattgaatgcctatttttaatctcagcagacaagaatatccgcattgcgacttgataagagtacatcagaaaacaaattctaaacatggcatctgatcagaaaataatctttaccgtctgctatatatctgatgcagagaggagatcaaccaactcctatctttatcctgttgatcacattggccgctagtggacgcatgatcatccatgttactctcgcttgcactctcatcaattataaagttaatcctcttagatgttacctacaaaaaaaaaaaaacagggcgaaatgatatcaattaacagctaaagtgggagttgaagaagcagaataggatcatgagtagcaactaaatctttgtaattccaactgtgtagctttatatagcagaaaaatatagtaaagtgcatatagaattgaaataatacagattttgaacagatccaggactataacataatataaacacgatagaaggatagatgattctttaaagaaaatatattggatcaaagaaataggatgcatagtcattactaactaaattaggtaacacggtttttttagtattatccatctcaaacaaggtgtcaatggtttagccacaaggaaaaataactgtctatgtatttgcagcaaattggacgccctatgttttacttaggggtttagccagaaaacaaattatagtgctaatcttagcatcccctagaatttgatgaacataaggtacttcattgcaatagtttagatcaaacctttcagtatataagcaaataaaataaaatgctgcagtacagatagcatattatgacaaaaaaaaaactaacactgcatatatccgagtacgtacttgacttattttgcattttcagctaaaagaaatgtttttagttaatttggaaccatcagaacattctgttcgatctacgcagcaccccattaataataattaacatgtgcacactgaaatataacgcaagttgtagtggctaaaatccaattccaccatagtaactgagaagtgttataactaatacaccacacatcggtccacaattgcaactt

SEQ ID NO: 36500 - DNA, 1785 bp, Oryza sativa
aagcctaagttcaaaacagctcaaaatcctaagagcatgtttggatcacttgtcaatctctccatggcctatgtgcaaaacaaattgtgcccaatatttatggatggaatactagatcatttgtcaatctctcattggtctatgtgcaaaacaaaatgtgcccaatatttatggatgaagtactagtacttaacaaataacaaatcactttataaggatttttcactgaaaataaatgcatgccatattcataccctattgaccaaaagaaatattgtgtggatttatcttcaattcttcataatcttcacaaaaccacaaaacaacaaggcaaagattggtgttttttctgtaacaaatactactccacaattatcacaaggtaaaaaaagccaaaccacgcatagcatataccataagaaactaccatcgacatgacagcacaaatcctggaaagtttatggcaagaagatgaaaaccaacctgtatagcacgagattggaatgaccttgatgcatatggaagcgaacggagcaagactagcaacagttgaatatgttcaaaacggtggccacaatcatataggtttagattttcatcaactgaagaaacattgatctgcattcaagatcataacaacatcaaaagtagaaacttcgaattgtaaacagttgggtaataattaaatggaagaaacagtaatctgcattcaagataatattagagtctagagcctataatactaatcaaacttgaaacactgtggtgcttatgccattccaaatggaatggacaaaaaaaaactaagtaaaggatataactgcaaagtccgccaaaactgacatggactcgtgacactcgactgggcagagaaaatctagcgttcatgcttatttttacttgaaataccataaagcacaatccaagagattttgttgatagaaacttagagatcagtttttcatgtggcctgagttgagaaaaaggtcaggtgataaggtaaccaacaggcaactaagtaatttactcttaagttaattaatcataggaaatcgatttcgtggaagtcaaaaacatatacaattatctagacagcacataaacaacataccgcagcagaaattaaagccatatagacatttacagcataagcctccttggggctgcttgaaatgctttctgcaaagcaaacagtaacagtgacactctatcttctgacatggtatttccttcttcatgaactgtcgtcagaaggccaccaggtaaatttggatttgcagcccttgaggcaaactttaggtgacctgatgcaactagagcacccaaaatgtgaatgattccaacaacaatgccatcacctttgtcaacattgtaaacattattccggacattgtcagcagtaattgagaagttgatgccacccaaattctttagcagctgattttcagaactggacaacttccttcctatacttgatcccaaaatctcacaaggcacatcatttgtgcttgtagatcccagctcagtatgttcttcatgaaggatggattcgtgctgttcaagttcaactgattgaatttgatcatcctggctctttgcttcaccactagcagcttttgtgtctgaatcatcattccttaaaaaatcattttcacttaaaagtgcatcagaattgtccaaaatactgttgttaccagctttagcttccctctggaaaagaacgagaagtgcatccacaccaccacaagatatgaatgactgagcaaacatgttggctctagaaat

SEQ ID NO: 36501 - DNA, 5054 bp, Oryza sativa
  unsure (1)..(5054): unsure at all n locations
tgaccgaacgtgtcaaagtgccactatgaggaagcttgggaattttttgacattcggttagcccagtacatatcaaaaatcaataatctgacatcatttcagcaacaaggaacatgatatatcaattactttgcacactgaaaagggtatagatgactcaagagagtgtcatcacaaagatttatcaacaattgacagaaactactggcattgaagatatgattcacctgtgagtaaatacaatttcttggtagaaactacagttagcagcttgctctcaagagctcccacctcatttttgagaactcttatgttttgctatgggaaaagccctattttggtcattcgactttaggatacagtttgtgttcagactgaattttttttcaaggatgctattatggaaacaaattgagaaaattgctggacaaccaaaactttttaaagatactatttacagaccattaaatgaaagtttctgaaccaaagcgggccattgaaaagttaaaggtcctaagagaaatcagagccctttttttattggtcaaaggcacattagttatatgactttgagcataacaatttgttttgtccagagcaagaatttaaataatgtgttcaggagtttgagtaacataacatttctgtatctatacctatttcactaaaactggaaccaacaaggatgtgtaaattggacctaaaacatataagttgatgttaatgtgggaaaaggggtaaactactccgtcaacaaaaggggggggggacaaacctgctgagccagaaggggaagcatctggacataatcgtccattcagaagactaggatgataaagaagatgtaagcatcctcctatctgttggttcaatgtaaaactctcttcggccatgttcttaacatggtcattggttgctctccaaggcaaacctgcaccatttccaaaactagggagtacatctcctccacgggatgccagacgacccatcctttctggcccaattggctccctaaaaatgtatataggtcccatttctgcaaacaatggacattgtcgcctccgcctctgcaggcctgcaatagttggtggaggattcgttccaatgcagcaaaatgctagtggttttgagatgcgtgggaactcaaaaggacgactctcatgcaagcttccatcaacgtacaaccgcaattcactgtcgccctttccaagcaaaccatgcttgtttgtgtgctccaacccaacgaagtaccatcgctgaggtttaaacgcataagtgaagtgcagagaagccttcttacccctcccacccccactttccaccaccaagaactgtccatggaagtaagcctccacaccctgattatctgaagagagaaagctaaaaagtctaggcatgtgtgttgttccttctcctgcaagagcgctggctgcagcagctgctgacattgctgatgattttccagatgttgctgcggctgcagcagcaatggcagctgcagctgttgctgtactaagtgtatctgagaatgattctatgtaaatccaagtagcaaacccgtagccattagagaagggccacctgctgtcaccagggccaagcaagccagagctctccccgtcaaactcaaatgtcgcagcaggacctcttgcttcctcactccccatggctttctcaagtgccagcatcagtggtgttgcccagcttgtaccaagcgccttcttaaccaaaccaagccacgaatgcaagtccttcacgctaagcgagtgcccacccaatagctggatgcaatggagcagtggtgttccgtcccagctacttgcccgacccattccaatgagtagcttctcagcagaatcgaggaggacgggtagaaggcccgatgaagagcacatggcacgattgcgtgtgcaggcgcagagcgtggcgtgaatgcccacggccatacgagtgcgcggagatggctcatcgccgcaggggaggtaaggcaggagctccgcggcaacaacggcggctctcgagttgaacatgatgcttgggggagcgccggtgccggtcttgtcttctacctcgtcgaggccatcggcgccgcccatggtgccaagcagcacgtccacgacggtgtgcggcaactcgccctgttcctcggagaccatctcgtggaggcggttcaccccggccgccgccgcggccccgcctccgaccatgatcgcgtcgtcgaccgcccgcacaacctcctgcggggcgtccggcggcacgcccagcggccgaggccttctcctcctcggcggcggcggcgacggctccgaccgcgccggcgtgaccgccaccgacgtgcccgcgctcgtatccggatccagctcgctcccctctgcacgcacctcgtcggcgagcgggaccgccgagaactgctcgtcggagtcctgccccgggggcggcggctccggcgaggaatccaacgactcgcggggttcctccgccattgctagggctttacgacatcaacaccaaacaccgaacaaggtctcgggaataaaaatgcgggcggaatcggtcaacgacagtgaaaaccgcgagcgattcgagagagagagcgggggtggagtggaagggggcaggtgagcagcgcgcaatgcggaggcgcgcagatctggtggcgttcgggggtgggattggccttgcggcgcaccggcggagaggttggggatcagcggcggtgcatggcgagatccgcgaggcggagaggatgggtggggatatcagatggacgaactggacgagaagaagagcaggaagggggagaggtagtagacgacgtggcgcggccggcgggttcacggtcacgggtcgcggccgctttccagtgtcgcagcctcgcacccagtcgcaggcgtttggactttggtgccgcggtttgggccttcgcggcgcattgcgcccgttaaggaagctgactaacaagttgggcctggtggcccatgtgacagagacagacaacgaacaccaattcaacgagcaggaatatacacttgttgtacgtgatgaaatttttttatgaatctggcaaatacagttttggagttttgatctaagcacaaccctagatggaagttgaatccaacatgatttcatttcaagagaagttcaactcattcaagatcaacagcacatgcagggccaggcatgatggaggagctgctgagctgcatcgatgcaggaccaacaataaaaaggagcaacgtactactcctattgcttcaatgcttgcagacaaaggaaaggtatggcacaaccgatggtcgttcacacgattgcgatttgcaaactgaatgttacggagtacttacgatcgaagtaggatgcggcctactcccatggacgtaaacacgtttaagacagtatacatgcatgaactgaatagcagaaaggggcattttctcgtccatgtactattactgctagttattccaatctcgcaatgctcgattagtgacctatatgtgcaagtgattacaatttaattacaaagaactttgacgagtaccacatggactgattaaaaaatctcagttaattctctccgcgaactactgtgacgttcaaaaagtgattagtaggtgagctcgcctgacagtctgacacgactcagaaagattgattagtccagatcttcgcgaggtcatgtgcaaagttgaaagcagcagtgcagcattatactcgttgagtcggtgcaactttgaagacacgctacacagccaagcatctagttagtgttttagactttcagtcacgcagtgctgcagaagccggacgcgatgaacttgtatcccttctggcttgaggcaatgccatacacagctaaatgcttgcctgaattgtgcaggctgacttttgcaatcttgctggaactgtggttattgtcttttcttattctggattttgaatttccatttgcatgctttccaagctctccgtgcatttcgtgcaaagaaaacaaatattatacaaaattcctgaaacatttttaaagaaactttccaacttcatattagtttaactcattcatttatatcctcagacaactacataaaaaccagattatgcataatttaatcaatttcaattatcttaaacgggatgtgtgtgttagttttgcagggtgtaggagcactgctatgcatacaactcatgcatatgactagcgtgcgactcaccttatgagactaatcagtttgctcggattcttttcatgctcaagtctttcacagcttagtcatagtcgtacatgggtcgtatgcaaagtgattcggagggcgtagtacgagtacaagtacaagtaccccaagggaaatctttttcggatttccgtagactacctaaatcgctaccatgacttatgaccaaaatgtactgagggagttcacagtggacttgtgtagcgttcagcatcgtcctcccatgtctgcaaaggagaaagtcacatgccacgttttcttccagacccaccaaaataaagttcttgtgtccaaagtttaccaccgggttcttggagagaaactactcgtttgggtggataaaagctaagagtactagtactcatttggatgggaagaaaaaggagagagatgaaaagtaaaaagtttgtcactggtgggaccccctactagtacttgcactgtggagtatgaagcttataaggttcttcgtctacgtggcatacgaggaacagcaaaaatcggcgatgcactgtgaacgccctgaagatgcctcacttcaggcggagcctctccgcttggatgatagaccgattatttgagcctctccacttggatgatagaccgactatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36502 - DNA, 1133 bp, Oryza sativa
cgtgctctgttcaccgtcgccgttcgtcgttgcgcgtgtcggaggagccggctcaatcaaggacgcggaaggggactccgggcgcgccctccccctcctcttcctcggcccgaggccgaaacgatcacgtttcgcgccgtcggctctcatcactgcgcccgcccgcacggtagtgcctccctccgttcttcctcctcgttccacctcctccccttagactcgggtagtagcacgagtagcctccccgtagctagccggcgccgccccgaccgttgccgccgcggaccggggaacgtaccgggtgtacggtttcccgctcttgcacctaaggaccgtttccttggaatttcatgtgggtaaagtgtaccccctctgcagaggttaacaaactgttcgaacagccgtgcccacggtcatgggtggatgtgaggtgattcctagcgtagttttgtttgactactgcttgggaaattactgttgtggaaaggggatcgatgtttggaaaatctgcagctgatgggatcagctaggcccgggtggccgtttgaaagttgttggcccgggtggccgtttgaaagttgttggccgggtgccaatcttgatcaattctaaagactgatacatttgcacatactccgaccggacgagacgcactgtctcatccgtgtcgtttgagaagcactcacttagtcgttttcagaaaagagttcaaataaaatcaattgcaaaaacaacagcctttccttgaagcctgcattaaacacttatttcccatggcttgctgagtactcccgtactcacccttgctctatataaataactacccccccagttgctgaagaagatgaagcggatcccgctgacgaggagttcttccaggagcaagccggctacgttgagttttagggtttccgcctagttcccaagtcgcgcctgtgttgtttggtccaagtcttggcttccgcttcccttttgtaatgcagttgtgagctcgggatctgtccgcagcccaacatgactgtactccttctctatattaaagaaacctctgttgctgtgatattctgtcttcttgtgatactaccactgtttcctgggactggtatcgattaacaggttaatttggagcgtca

SEQ ID NO: 36503 - DNA, 6149 bp, Oryza sativa
gctgaagaagatgaagcggatcccgctgacgaggagttcttccaggagcaagccgagtacgttgagtttttttttgaaaaaaagagggggggggtttttttttttccccccccgcatagttcccaagtcgcgcctgtgttgtttggtccaagtcttggcttccgcttcccttttgtaatgcagttgtgagctcgggatctgtccgcagcccaacatgactgtactccttctctatattaaagagacctctgttgctgtgatattctgtcttcttgtgatactagcactgtttcctgggactggtatcgattaacaggttaatttggagcgtcacgggctagttctggtcgggactagttcggggcgtgacactaagcatggctaagaaattcctagtccaacatctaatcatgttacaacccaagctaacaaaggaacaaggaaataattagtatggctaagacagtaggtaaacatcccatggtatcattgtaaaacaatgcagtatttaaaggaaaataatagagcatttgcaatataggatcaacatgtttaagtgacaagcatgacttgccttgctctgcagctggagggacctcggcgactatctcaaagtacaccggagcgtcgggagagccggaatctaagcgacatacaaagcaaacaatacaaaaaggctataagactactaaaacagagaacaaaaccatttttaatggattctttgcatttttcttaatttactgagacttgaatgggcttaaacggagctcggatgaattttctatgaattttagaagatccacagtgtttttactataaatagaaaagtccttaattgatttattgcgccattattaaaccctagagagagagagggggcgcgccgacatgcgggccccacatggcagtggctcaagggcacaattcaaatttatgtgatcaattaacttctcattaactgtaatttttttcccctcgacatgagtcaaccatactaataggttgtgaaattgtgcttttttttcttcttccgatagtttcttccgatagggaaactgatgtttggcataaactcagataaatcttaattcatcaaatgtttcactttgcagtaccaagaagcctgagatggtggacacctccgtcaccgacagcctcgcccgcacgagattcggcccctccgcgccacaagacttattccatcattctccccctaagtcttgggcgttctttttttcctagggtcacgtggagcgatgatgacacacttatgttatatcagtattgtgtggaagaagtcgaggcttctggtgagctgtcggaagagtcttatcggttgatccaacagaagatgtgtgatcagggagcaacctacggtatcaagaatataaaagaaaagatcaacttacgatgtcaagaatataaaaagaaaagatcagaaacaccataaaattgtgggctaaaatggtaatattactttcacttttgtttaaattctttacgaacaaacatttactattctcttatgagtatttattgtgcagagatcgagagattctcaggattacaatttgaggtgtcgacatcatctggatttgcttgacagattatttgaccaggtaaaaccttttaaatctaacatttcatttctcaagttttgtgcctttcgattaattaatagctgctgcttgtcctgaacaaaatgtttttgtttacatgtaacttatgcataaccacactgtcattgtatgagtttgcttaaatgggacatgtgccgtagaaaaacataagtgctcacttaaaaaatcttaaaacatatcaaatccaaacatatatacaacagatatagtatgtatcaatatagtgctttcagaaatatgcaaacagtgaaccatctcattccatacgccccaaaaattacatctctaattatactgcttatcaagatattcttaagtaaaaggtctcaaatcgagcttcaaacaagctgactagcaagcatattcaatccacataacagtaaattgttttaggtccctaaataaactctcaaagaaacgttgcaaaaatccttggtctacttgttcgtatgttcttacatgcactctattacattctattacatgcacatgcagtaggaccagcaaacttgaaacaaaaatgaaatctagaacaaatgtggagtattgtattatggagttttttccgcaaatacattagctgcactaattgcagtaattagatattgaatcaattagagcacagaagcatacatcaagggcagggcagtacttcttgtcatggcataatatgctaatatacaaacaagaccacataggcagtctcttgccaaatctctaacaaaccgactcaatatccactcaaaacatatttctatttctacataataaaatgcgactcaatatccactcaaaacatatttctatttctacataataaaatgtagataataatgtggtgctcgaacaatctagggttggttggaagaaatttagtattgttttaattagaattattctatggataaagtcaatccttatgaaaaaaggacaagaaactcatttataacaccaatgttatatatagaaaaaacagaacatataaataacctaaagtatacttaaagcctcttataatttagctctatttagtgtatgtgagaatgaaggatgggaggagtatttatatgtggaggtgccttgggaggatagagtttcttcaagcatccaatgagtatcttcatcctcctagtgccaagtgtccattttatgacggtttcctttcaaaaccttaaaccctaaccccaaccctaaaccctaaaatcaaagtagtcaaactacatttttttataaaataagtcaaattaaaaatagtttgactttgactaaagtcgaaacgtcttataacatgaaacggaaagggtataaattaagcaaggtaggtttcaactactgaatttttgcttttgctttttgcccagtttatcattatggtttttttaaaaaaaaattgatcaagtgaaactgcaactatgagaaaaaactaaaacttatattgcactgaaaattgaagcttctatatgcactaccagtagattttgagcttgttcctttatttgtatacaaaattatgtctcttcatttaaatcaaaatgtcaagtgcatacatgcgcaaagagtcagtttccattccatgttgtgaatctatctggccttaatcctgcataagcttgtaagatcctggtagaatttctgctgtcattatctatccacattatcaactattatttctttgccattctagccgttgctactctgatttgtaccactttgctaacttatctttgtgtgctgtccatgaataatttgactgatcatgtccatgtccatgtctattgcgatgaccttagttgtaacatcccggcccagggcttaataggattaatagaatactcatatcaacaagttacaactttttttctagaagccgatctctaaagaactataaggttaagcgtgcttggcttggagcaatttagggatgggtggccgatcgggaaattcttcctaactgcgcacgagtgaggagacgttacacaaaaacatgcatgaaattcttcccgagtgcgcacgagtgatcttgtattggtctatgagggaagtctatgacctatgaagtgcgcacgagtgaggagacgttagacaaaaacatgcatgaaattcgaaattcttcccgggtgcgcacgagtgaggagacgttagacaaaaacatgtatgaaattcttcctgagtgcgcacgagtgatcttgtgttagtgagagcagtctatgacctatgaaagctaccagatgtaagtgggcctagcctaggagagctgggacgttacacaaaaacttaatgtgcagaaaaaacttgtgttggtctgtgaggatagtctatgacctatgaaagctaccagatgtaagtgggcccagcctaggagaggcgggacgttaaacaaaaacatgcatggaaaagtaagcccctgtttgattcagcttaggaatattataatctagattattagtagtaagctgaaacaaacaagtagattattatgctggattattataatctataagccagatagtataatctaataatctcctctaaaggagcttttttcatattattgagtggctaaaggcccactacaattagatgcctcaaataatccagagaaacaaacaactcgcagcttattttatgtcagcttattataatccaccttagagtaatctgatttaataatctagattacagtaatctactaatcttaagctgaaacaaacagggccacggtcatccagctaactatatattgtacgccatcgtgcaaggccaccaccaccacctgccctatgccaatgcattattgggcctggcctaggagaggcaggacgttacacaaaaacatgcatggaaaagtaagaacggtcatccaactaactatatattgtacgccatcctgcaaggccaccaccaccacctgccctatgccaatgcattattgcttccgtcatgattcttgctaccagcacctaggattgcatagcctgacctctgaatattagagcattgctgcattccacaaactccaattggtcagagaataaccaatatgaatgcatttctatctccttatgctagatttattgctgcattccacaaactccaattggtcagagaataacaatatgaatgcatttctatctccttatgctagatttgtctagctatgcaaagttagtcaccatgcggtgcgactaaatagtcttcggtggaaggtgtcttggccgctacaataaccaaaactccagaggactttgaaccgtgtttcctaggtcaaaacacaagtaatcaacatgtggttgagcagttttggtagtgttaacaatagaatttggcatcagattcagaaaaggaggaagaagatcgaagcggatttggtgtgaaatcgagttgatctgcgagtcagactgcacatcggcggaatgtcgtatcggctgaaaacagagtatgaagttgatcaaagttaatgaagccgatggccgatatagccgatataacatgacttgggctcggcatgggcctaaattgggataactgccattgccaattagagatagagcttgattaagacaattgtatctattaattagaatattgagtcggtttgttagagatttggcaagagactgcctatgtggtcttgtttatatcttaactttagaaaggtttgagtcgtgtctataatggactaagtttgtactcgggatataatatgagccctatataggggtggacaggaagctcgtggctcgttagctcgctcggctcgtgacaggttcggctcgtttgaattttctaacgagccgagctggcatttcagctcgttagagataacgagccagctcgagctggctcgcgagccgctcgcgagccttaacgagccaaagcaaatgaggcccaggcgcccagcccagcccaacagcccatccccttctcaaaaccctagtgagtgaatccccttctggcttgtccccatccctaatccccacccaagccgccgccaggcgccagccctcaacgctaccgctcctccccggtgccgacaccaccgcccgtgcctctcctccccggcgctgatgcggccagccgccgacgccgccgcccgcgccgctcctccccgatgtcgacgctgccgcccgcgcctctcctccccggcgccgacaccaccgcccgcgcctctcctccccggcgccgatgccgccgtggacgccgtcacccgcgccgctcctccctggcactgacgcggccagccgtggacgctgccgcccgcgccgctcctcctaacgacggccgctcctcccgacgacggccgctcctcccggcgcccctcctcggctcctccccttgtttgctttctctcatccccaaagcccacgagctaaacgagctagctcgagcttgctgacgagccgagccgagcttggtttctagctcgttaggataacgagccgagccgagctagctcgttatcctaacgagccagaccgagccgagccgagccagctcgacatccag

SEQ ID NO: 36504 - DNA, 12207 bp, Oryza sativa
atctaccatcgtgaaaagtgtctaattgcttgattgtgtacactgcatgtttctttttatattttgagatgcatcatacctaggcatgcttagaaccgtgcaatctagcctgcaattaagcataataaggatagtatcggggtttcggccgatcttacctaatatgcatgtttcactctccttgtttcatgtatattcgccacttatatagatagatcttttgtataagcatatcaagttttagtcagtgtcggttagattcctacgccttcatgcttgatttatgtttgatatgtttatatggatcaatctgcctatataagtttgtactaaagtattaactagtacgttatctctcttgctctaaatactgtcacattggctactttcataataccgttttaaatcaatctgttaaactctatagatagtattacaggcgattgggagtgtttagggtttattattctttgacatatccagtccatagccgatttggtctaactatatcggctgagaccatcaacgatatgctatcggcctatcggcagatcggctatcggtcaattgattctgcttttattctttcttgctgattgcaagatcaagggcttgtttggttggtgacctgactgacttgcctgagaaaaatccatgcctgtgtggtagaaaagctgtgttttattgtgcctgattaggcatgtgtgatgttttgttgtttggttgaaaacctacgcctgagtgaatatattatatataaacattttgtttacttgagtaagatgttgacaagtgttgatagcagtcatatcaatgaagaatcaatgggggaggattagacacatacccacgcctgactcaggcgttcatttttggtggcctgagtccggcacccttgcctgagcatggacaccattcagggaagcaaccaaacactactacttactgctctggctagctccaggccaggcaaatactcgccagggcagcaaccaaacacgcccaaaatcagctggcatgtccttgagacactcgaggctagccttggacctgcactggagttaaacagatctcccagacagccgtgttttcacacaatgcacacgtcgcatagttggaaagtctgtgactttgtaatctttccgaatttcagacccggttgtgaagcatcaccaaatgaacaacctgcatttgttgggccccctttctagcattccttcgtaccaaacacgtaaatagaaaatcctatggagagagtaagcagaaaaatttgcatcaccagatcatttccactagaacattagaaacactagtgacttgtccgtgctaacgctacgataattttaaataatctttcatgtatagcgtatgttatgaattaaatttaacatttgcaagaatcctatatacctatacaagtcatccccactaagtgcaattaaaactaatttcctgtgctgtggttgttccacgtcatcccaattaaatctggccttaggatcgagcttgaacgtgctagatcagtcgatggaagcacagcccatgttcctttctttcctggcccatctattcatcgacccattaattccagcccagcgagtctcctgtcacacgttccccattctcattagcaagcatgagcgccgccggtagcaacatcaattgaccaccgcctttccacatcccctttttctgacgctgcgtttccccttcctgcaaccatcgatggacttcctgaactgtgtctagaatctgattcgaccgcatggcaagccatccacacactgacgttgtgacatgaggaaccgataggagatggccatgctacgcttcgcttggtggtttagtttcatttgtgagtcatagatcccctaatgcatggatcactgtatggttatataggatttgatccctaactcacccggccaaattacttttatcttttgtgaagatgcttttcgtttgatcacttaaatcttctttcagatgttagtttattttgattgcttcgagtaatcaacgttgcaccggctaattgattttttttctctaattgctttgctttgtaggccatatccccaattcatggatccgactaccattcacaatttttgttttcttatcctgcagggttgattggatgggttcatttgactctagatgagacaatcaggtatttgtgttttagtaagcaattgatgcaaatatcaaaatgatctacttcgcatccacttagtcttgcttatgttccttttcttacatgttaatattatgtgcatgaaatgcaccttttgttgtttctgaatttcctggcctccatgtgcaccttcaatcgaattttattcagttgctatatatatgcaggtcacttcgcaatcctgcaaatacttaacgattggttggagaaaggtacaacccacattaataggagtgcaacaaggaagtgcttccataagtgctcctattatcctccaatcttgataagctccttttctgcaaatgttcctcggactttgtaagcagaaaaggtggattttttttctttggttaggctgttcgggatggagctgaaatacatgagaagaactaagagataaaacagaaaatgtagatgcgggaacaagaacaggtaggtgatgccttaattattgtcttattattcatttcagacggtgtatgcaattgtcaaacttgcgtctacctgcagctatactaatccatatccctttcatgaacatttcttctttgatcctttgattatctgtgttctttatatgtcaatttctaaatatcttggtaggttgctaaattttaatcctaatgggatcatgttttggctgcttggtgtctaaccacatccatctgttatttatgtcgctgagcagcgtgcccaggatggctatacacaagtcgacttcaagaaaatgtgaagggctaagaatgaggtatttttcttatccatttagtccgttgaatatgtttgtggtaggtcctctccatactaataaagacaaacatccttatctgatacgtactccctccatttcaaaatatttgataccgttgactttttagtatatgtttgaccattcatcttatttaaaaaatttaagtaattatttattttttccatatcattcgattaattgttaaatatacttttatatacacatatagttttacatatttcacaagtttttttaataagacaaatggtcaaacatatgctaaaaagtcaatggtgtcaaacattttaaaacggagagagtatattgtttgatttgatttaatttatagcacctgcatccatccaatctaaacggacaactaaaattttcgacgagtagtatatagatattttcacctgtatgtatttagcagtttttagaatatccgttgcagtgcaagaccacggattagtcttaattggaggtttagtttttactgtggctaatattttgcactgttgatcgactgtctgttcctccacatatacgagcttagataatagtagaattattggttttaacttctacattttctctcatgaactttctatttgatttttatttgactttccaattaaccgataaatttttactgccaacactaacatcaattttgtgtataagtactacagtgttttgtgatctaaaatcatgtagagaaccacagatagtatatatatttaaaagttatactccctcctttcctaaatgtttgacgttgttgactattttaaacatgtttgatcattcgtcttattcaaaaacttttgtgaaatatgtaaaactatatgcatacataaaagtatatttaacaatgaatcaaatgataggaaaagaattaataattacttaaattttttaaataagatagacggtcaaatatgtttaaaaaagtcaacggcgtcaaacatttaaggatggagggagtacaaatcatagttataattcatattatttctttatctgtgtttcatatattgtgatgcatcttatttttcgctcatatataccgcagcaacgcacggggtattatctagtttgattatcttttgaagaatcaatgcctagactttgaagttcctaaaaaaaggataatacatagaatccagacgaccgaaattctagtattagatagacgagtttctgatttattgtttacattgccaccttaaggacactattgtcaggttaaggtatgtcagaatatgagacaataggatcactgtatctagaatttctaccatcatatgtgaacaacataacagtacaatagttataattctttttttacaaaatcaaaacataaaaattattatagtaaagacttattagccataaagctcatgtcattcatcaccgtacatctacaatactcaacaagtctaaaattacaagaagctctttacaccaaacttacactttcttctatcaaatgaccacccaatccaccaccataaaaatacgagaacttcttttagtcttgaatgcccagtagaatttctatagaaaaacgcgcatctgctgcttgtcacagtagattggatttgacaaacaactaacaattctatccgacaacacacatttgctaaagcacaatacatgttaagacaactcatcattgatcaaataaatttgttcaagtgtcattgcacctggtaagagctgccagcctactccatacatgcatattttcttgcttgtagaactgaaaatagaatcgttcattattacatgccagaggttgttactatggttgcaaacctttataaataattttaccagttaattaacaaacaactttaatttggctcctagaactaattgtaattatacatgttctaattttactacacttcagctttctaaataacaatagcaaggaaattttactcacaaaatacacaccagtgaggaaatacaatctaactgtgatccttgtaagtgctatctactgtccacaaatcgtatagagaaatgcaccttttctgcaatatatatgatatatgagatcaggtattcaggtgaagaggcaagaataacaaaggagacctgcaccttactgtacattatattgtgcatgctgaagtatcaccgaagcacattatattgtgcaatatcagatcaaaggcaaagaagctcaccctcgacaaaagaacctaaaattcagaccataagttcagaaggatcaccatagtaaacaatatgtaaaatccaaaaccgatgttagcaaccatgtttgctggtcagacccaaggcaaacaggccactgaagacagactcaacgttaccatattcataaataaattttgccctttataaccttgagggtacagtgcatgtgaatattacgttaaagagcaaacgctatcaggtaatggtgggaagggaatataagcaagccatgcatcagcttgcctgcaatacatgaataaactgaatgcaggagctcggatgcatgttagtatggcaagtcagtcttatgaagctgagatgatgaatggagcttttaagtctaaaccacaccattcactttgacaaatgtgcagtattactcatgacctgcaattaacctaaacgacaatatgtggttagaactactcaaaatacagagttccttacaacctaagtgaaatgctgcatacaaacaaacaaattttctcaaacaaaattgtaataatgaacctaaaagaatttgaaagagctagcacacttatgctcctgaacctttttttttttgcaaaaagtgcagaacacaatgggtcgcaattatgctcggaatagcaagattaaacacagcatttccaatcgcatgcatagttattcaaatttatccagtacaaatgaaggcaaatgcaggggggaaaaattagcagaaattccctccgctgacctcagaaatggccttctgctgcagcctgcataacacatttcagcagcagagaatcacaagttcataactatacatctagcctaagagtctatcaatgatgaataaaaattgatgtggttgatagaaagaaccacccaagtacaaatagaaaattgcatcaactgctcattaattacagcgaaacctaaatctacgggaaatagcacccttgatctgggagcttaggctagtaaaatgcatacaagattatgggttaaaggtatatggtagcttttgtgccttgttaatgaaccagctatatacataaaatcagcgctgccaagctaatcatcaatgaaaagtgaaataaaagggagaagacatacatgcttgatgcttcataggacatcacatttatggtcatattagggatggggatcagctagaaggtggatgggtggtggagtagggtttttgtacctcttggcgttcaaggcggaggcggtggcagcatgccgatgcaggagtccgcgactcatcagcgtcgcagatcggcgaggcaagggatggagtcctggcggtgcgtcggtggagcggatcggcgaggcttgtcgatggagttatggcggcgcggacgagatcagcgaggcggacacctaggcaatgacgcagatgcagtccctagcgagctacacctcaccgactataccctgaatttaagaaaaatggagaactgaacacaactggatcaaatagcttgttctaatatgcaagatgaaacacataaatattttgtcaaatatcgattcttttaaaacagtcgtaagaaatttcattaggagaaattttatgtatctgccaatgttcatgcttatgctctaccaactgcatattagaagtcctgacccgaactgacggcaaactcaaagttcagtagacaaagcaaaccagttcatcctttaatttctccaaagctgcaagccaagaaaagccccaaattcctacctttcttgacatgctcaaggcaacagcaaacacacctttcttgcattgcatgagacctataaacctaaactctacatagcttcatggacaatgcaaacaacttggatctttgcatttctaatcgagcttatcaccccaaaggcagccatgtccggaatgggatcgagcaatgctttaccttgtccgcagcggtacagaaggcggcgcaagatagtttggtggtggtggtgtctaaggcgaaggcgactcgcgacgcggtcggcgggaggcgctcgctggagaggggcgcgggcgttggaggcttgtcgtgacgcggtcagcggggaggggagtcggaatcgacggcggcggcggcggcggttggcgtgagagggatggcgcgaacaacgcgcgcggcgcttgagacggcacgacaaggttgtggcagggaagagagaaggaggtggcggcgtgctctgtaggttgggcgaggaatctgggaaccgaaaatcacgcacgcagcgatgagcggttgaaggtacgttgcggtgattttcagtcggtgtggactgccgccgtcgcacgcattcctccccgtccacccccacagccgacgccgcacccagtaccgcggcgcccattcccccctccatccttccccctagctgttcgccgtcacgcacaccaccggctgcccccagcacccgccgacgggccgcctcgcattcgttcgcggccgtccatggaggccgccctcggactcctccgtgcgcgccaccggtcgccggctctccctcttcgccacccggcgccgcggcggacgtccaggaagcctcaggagtcaggacctccagaggggagaggcgtgcgtgattttcggtgtgcacggtctcatactgggtgaccccgcgtgcgtgccctgtcgtcggatctaatgcgctgaatgatcgtggaccgttggatatgtgacatgatgaattatgaatgagtaaaacaacttgttgaattatagagcagcaaaagaatagatagattatagggtagactagtgtatcttcctcatcatcattaatactttctccgtctcaaaatataaatccttatattccttatattttggaatgaagagagtagcatatattgaatcgccgtaccgcccggataggaatttgatccttataggtcctctaagaatttgtttttgcttaaaatcatccttgggccacttaatatgccatatagctatttatagtcaacaattctgttagaaaatatctcttttgcccttaatttgtatacaactatacactagtaaagagaaaaccaagatacataaacaacatttgtacttcccattatttcaacatgtgcaaaagaaacttgagtctaatggctattgtatacacttgcaagtatataatttacttttgttttacataaatttctatgcattatctataaaaaaaattcattacgcatttttttgtcttatatatgtgaatgagggggtataagtgtcattcatcaagatatttgttggttatgtgggtcccactatttttatcttatttgagtgacatatgggccccatatctttgttgtaattttttattttccaattttattttttcagatcaaactgtcacgtaagtgtcacgtcaacaccacgtaggacgaaggcttaatcaaaagatccacataagcgtcacgtcagccaaaaaaacggagtcaataacatcgagggacctcgtttccactggttttataagttgggaatgcaatgtatccggttttctagactgaggatgaaaatcggactagacgataaattgagggatctaaggtgaacttattcctaccggaaaacgcaggaggaaggccttcgggctactagccgggtgaaagggaaggattgaaccgtgtgattttgtgacctttcggtagttttctctgttaattctgattattcactgatacacaacgtactaatatatatcaaggtatctgtgtggataagaggaggaacttttgatctctacgagcctatctccacctcaccctcctctctctatctctcctctgggtctaaatgggggtcaacggcatagttattgagaccggaccagtaatcgaactggtgaggctctcggttcaatggttcgctggttcaaccgggtgaatagttggtgtaacccggttcaatactaatcaaatatattaatcattctattagaagtttagaacacaacaagcaaggtagcctggttgttgggagagagttaactccccatggggtcatgggttcgaatcccacccaagcgttttttccctcatttttcccccactagcgcgcgcttcccctttctatcccacattcccacgtgccgattcgaccggttcaaaaggcggttttatttccggtttgacagcggtttttcttcaaaaccgggcggtctgaccggttcactgccgattcgattgcatgccggtcttttacctggaccgaaccggcaagagctttggttccagttttttccggtctgaccgccggtccggtccggtcttaataactatggtcaacggcgacgcaagatagtagcaacggggtggacgacgaggcagcaaggagggagttgcggcgttctgaccggttcactgccgattcgattgcatgctggtcttttacctggaccgaaccggcaagggctttggttccagttttttccggtctgaccgccggtccggtccggtcttaataactatggtcaacggcgacgcaagatagtagcagcggggtggacgacgaggcagcaaggagggagttgcggcgttctggctgcagaggaaaggatcaaggagagggagccggtgagctgcggcgacggaggaggaaaaggagcgggtggggaaggcgacgagggatctctactacatggttttgtaagttgagagatgcgttgtatctggttttctggtctgagaatgaaaattagactgtgtgacaaatcgagggacctatggttttcctttccggcacaaccaacattggacaaggccgagttcaaaaaaaaggaataagtccactttgactcccttaaaaatgacaccaatctaatctatgacccctaaactgctaaaaccggtgtaaattgactcccttaaaaccagatattttgacccctaaattgctaaaaccggtgtaaattgactccctcggcggttttgaaaagcggttttgctgacgtggcgtctacgtggcagtgttgacctggtctgctattgacgtggcgcttaggtggcattagaattaaaaatatgcatgtgggacccatttgtcattcgcatggaagaaaattttgtggggccacatgtcagtctatcccttcctcatcctccccctttctctcccttatctctctctccctccccattcggcaagcggcaaccacagccatttatgccactggatgagcgctgccatggccgtgccttaccgcggtttcgtctcgtccttctccattcccagcaatgcaaccacaaccgtcaccgccgttgtgcggccgacctcgcgtggtttcgctacctcaaccctcagggcactgcccaccaccgcaccaccattcccgaccactccaacctccaaggtcccttttgggtgtgcagcaaatgaaaaggaaaacttgattccttttcgtgaaacgattccgccgctcacacttcttggtgtgcatcaattattccttttgggaaaacttgactttttttttttaaaaaaaaaaagaaaatcatctggctgtggagtgtgaacatcaatgttttctccttccctttcatttgctgtgaattcaatcccctcctcacgaacactcgaacaccatgaggactctctacaagactcggactccaccgccgcattctcgcatggcttagccgtattctcgtttatctctaatgggtcctccgtacacatgacctaaccaaatttttcaacgaattttttccacttttctgactagccgatgcgtccgttcttgattcttgtacgtattcctcattcgtgctgcatagtgagcagtagagattcagactttttttttgggtttgaggatcagagaattgaggggagtagagattgagatcagagaattcggcggtgacggcaggtctcagtcagatttgggcggtagcggaggagctccggcgagctctctcctaggtggccgccgtccccggcgccgtgaggtggccaccactgaggtggaggccaaagccgcggtccgccggcgcgcgccggtcgtcgttcgccaaagacaacccccgccggtcgacttcctccacgatgccgaccctatctcgccgagtgctgcctcgccattgtcgactcctccactccggggaccgccactccagctagctcctatgtcagctcccgccgccgccagccgccaccactccggcccatgcccgccgccggccgaaggggagagagagaaagaaagagagaagggaggaagaagaaagagagagatgacatgtggggcccatatgctagtaggccccataattttttatgtgtgtgaatgactaacgagtcccgcgtacatgtttttaattcaaatgccacctaagcgccacgtcaaccccatagactggtcaataccgctacgtcagcgccacgtcagcaaaaccgctctataaaaccaccaagggagtcaaattgcaccggtttcaatagttcaggggtcgagatatccggttttgcggtttagggtcatgaattagtcatttttcagggagtcaaagtggacttattgcgaaaaaaaaacaatggacaaggcccaaaagcccaaattgcagtgcgtggttgtggttggcccaaacaagtccttcccgtaatcgcgttcgtcatcatctatctcctccaccgcctgatcgcgccgccgccgtctcttttcacctacaaaaaccctaagcccaaaaatctccatcccccccgcccccagagatcccccaatccactcgattcgatccaatccggcgaggtacaggatgctgccggggtcggcggcgccggcggctgggagcggcatgttcgtgccaacgcagacggtgggcacggtgctgtgctgcatctgcggcgtggcgatgcagcccaacccggccaacatgtgcgcgcgctgcatccgcgcccgcgtcgacatcaccgagggcgtcccgcgccacgccgccgtcgtctactgccccgactgcacctcctacctccagccgccgcgctcctggctccgcgccggcccggagtcccccgagctcatgcagatcctcctccgccgcctcaaccgccccctc

SEQ ID NO: 36505 - DNA, 4622 bp, Oryza sativa
cccgctcgcacgccgcccgcctcgtcgacttcctcgccaccgtcgccgccgtccagacccagaccgccaagcagctcgtctcccacgacaccaagagcaacgtctacaactacaagcacaccttctccgtcgagatctgccccatctgccgggaggacctcatcgcccttagccctcaggtgtcccgcgatcttggaggccttggacctatcgtcctctgcatcaaggtcaccaatgccatcgctctgcttgaccccctcaccctgcgtgtgcaccacctcgaggaaaagaagtacagggtctacaacttcaaggctgctctcaccagcaagcagctcgtcgagtacatcgtgctagacatcgagcacgagtcaccagagattaccattgacggatctcgctaccagttggcttatgcccaggtcgcccgggtctccgactttgggaaaaacgacaccatgttcaccgtgcggactcatcttggccacctgctgaatcctggagaccttgcccttgggtatgatctttatggtgccaacttgaatgatgatgacatggacacagctatgatgcgccacagtctgcctgaagtcattcttgttaagaagagcttcgccaagaggccacgcacacgccgatggaagctgaagaggcttccaatggaggaagatgctgtaaataaggccaagggggagctagagaagagggctgatgagtatgaggagtttctcagggacttggagcacaactctgatattagattccagattgatctatacaaggatgaggactacaggtcggagatggcatctactattggtgatgatgttcccactgtgccgattgaggaactaattgaggacctaagtcttggtgatgatgaggaggaggatgaaggtggggaaggcaaccaacatgctgttatggtgggatgagttaatatgtttacctgtgctgtgcttctgccttctggtgatggttgctgccaaccgcagatcataggtctgaactgcatctgtttaatccgtataagttttgttctcccctttacttctataagttataagttttgttgctaaattgtttcaacttttgctgtttctcatgatagatgttgtatcaccttatcctgtatctggtgttgcagcttggcttaaattatatttctctattcttattgtctgtgatatgttgttttcttgccatagtgtggctgatcacaacatatcttaaaatagatgcattgtttgatttccaaaacatctagtttggtgtttagattgtgccagattcatatttttactatatgtttttagtccccattatgtggtttgcaagcgtggaatatgattgtggatttatgctgagtcatgactagagaattgtaggtatgacctgaaaacgtctgccatgttgagtgtcactccaataaattgattaaaaaactaataaagataagtgtagtataatatcatacccaggagccatgatgagacaataatgtgcatttttagtgattgcaattcaactgctgctgttttatcaggcacttcattcagactatgcctacatcgtgcaataagaggttagatatgtagagttgatggacagaacagatggtgctccactaataagcgatgagtactggtttggtaaaactttaataagttaagaattttacggatcttttttttctattactttcacaaggtggtgctgttctcaaacctaatgacttataatcgtaaaaaaaaaaaacttagattttattcaaacattaaacttctgtttacccttgatttctccgcacttccatttatcatgtagcatagcaggctgtggacttgtatccaacatttctgtgtgagtagtttcttatgcttcagaatttttagttctaccagccgaaaagtttacatatttgtgccattttgatatctataattatagttctacattagagtctacataagataaaagttccactgagctaaggcatagggaatgaacgtgcacttgtctattattgacatggtgaattgagtcatataaaattcaccacccatgcccctgtgcctcttgtattttggaactgtggattgtttcattcagttctctggaatgaattgacccaacagggtgcactgtatgttttttgctcctattcattgcctcttatttatttacttatggtgtagttttattagtttcaatagtaccagtagatgattcaagttggaatgaaacttgctcagcatgaaatcctatttttctgtgattgtgaaattagaaatgttgcttggtgataggtgtacatccgttccagtcgggccatattctgtatattccaagttttgtgtagtactatatattttagcgtgtaagaactagtaatgggcccttttttatgtcatgcacaaatgcatttgtttactttgagcttttgtcaataatatacatgcgtggttggtgtggtccgattaacaatcatctgtgtttgagctcaaaggtatgatctctcggaaagcagagtttacaaatatatatagagctgcgcatgcttagctttgagtttcctgccttcctgggcctgatttgttggccttgcgcgggagtggtacgtgacttggagcacacaaacaaattgaaagctttgctgcttctttcttgtgataaaattcatttttttttgtgtcaaagtttacattttggtgtggtgtggagaaacccttgccatttggcattgcgtatgactaaccctgatgtgaagagaagttttcgtttcaaaatttggaaacatgtttgttgcaagttttgatctgattactagtactagtactcgtgctttacaaaagtaggagtattggatagaccattgaattcctgtagcagagtctattctgaaatcctggaatctggacatggtgcttgccggttcatttcatgtggacgccatatcgtcctgcatccgaaaatggtttgcttcgtaggatcgttattttgcttgttagtgtgtcgtccactggctttaacgcaccttttgtgaattgtgatgattcacttttggagtacgaaaagtcccatcattcagctaatatctacatccatcattcagtttaggtactagtagtgactcgtaaacaattgtcgcagcaaaatggaaattgataccaaactaattttctcatttatgccgtcgttacattgttcttccaacaagtattaatccgtgttatatactccagtcacggacttgctacatgaacgaaaagcagcagccgggcgatgatagattacatcacggctgacgtgtactttgtccgggagacgagtagaaaaggacaagttgtatttcttcatctttctttggctcgtgccctacagtactccgcggctgcctgccaacccggtaatcgcagaggcaggtcatcgtcggatttgatcttgacggctgacccgtcccgccggcggtagctgcagccagtgcctcgccccccttccatataacaccaacctcctccgcgatcgcaatcgccaccaaccccatcgagaagcagacgccaccaccgcgattcgaatcgccgccgtctcaaactcaaaactcacaggtaagttcccctcgcattgcttcgatcttgcctgccctcgatccctcattcgatctgtcgctttgaatcaagatttttttgatcgcattttcatcagatcgatcagatcatgggggacgtggtcaaggacctggtggcgggcaccgtcgggggagcggccaacctcatcgtcggccaccccttcgacaccatcaaggtcaagctccagagccagcccacccctgcccccggccaattccccaagtacgccggcgccgtcgacgccgtcaagcagaccatcgccaccgagggccccaggggcctctacaaggggatgggtgcgccgctcgccaccgtcgccgccttcaacgccctcctcttcaccgtcaggggccagatggaggccctgctgcgctccgagcccggccagcctctcacggtcaaccagcatgtcgtcgccggtgcgggtgccggagtcgccgactcgttcttggcctgtcccactgaactcatcaagtgcaggttcgttaacttctctcctgaggaatctgtctacaagaaagaaatggtgcttgactgactaactgcaaacgtgctgcctaattaaccatcccaaattgaattagcctaacgtttccgcaattgttatgtgctagtatatatattaatgtgaaatgacaataaagtttctcatcagtcaataatattcagttttctttcagcaaacgaaacaaagagaagatattgttgagtgcatatttgttttatgaaaaattggagtgttgatttcataaaacagagtgtaatatatttaagcagagagcggaataagcattttctttttaccatgtgtactcccgtctccatgcaatgtttgcaacaggaatgatgcattcgttcatcgatgatagtttgattatttgatagaccaaaccccttaatgcttcctattagttcctagtagtgatcattactcaatatttgttatcactttttttaaaaaaaaaaatccatcattactcaatatttgaacaa

SEQ ID NO: 36506 - DNA, 8880 bp, Oryza sativa
tactcaccattgcgtgctaaattcctttcatctggtggtgactgcactgttcattttcactctgagggtgcctgagctttgcatcatcgtctgtacaatagatcaataggaatcccctggtaatgagcttctctgaaattgccctttcctgcacatatcattcttcaccatcagccatgttactgcgatacactcgttcaagtgcatttcacattttcgttactgcttgtcacttccactgcattgtggctttttttactcacgccactaaaagttaatctgtggacttattttttcctattgagaccacagcgctctagatcaaataattccagaccaagtttcccgataaaattgacctttttacctgaaacaggtctgttcagtgcagacttgcagtgctcccccccccccccccccctcccttcagcagcgagcgatacacttctgcagtgtgcatattcaaagggaataaagacccttgtgctttatatgctcttttgtaggtttcttgtgttttctgatttctacttgatagggatatatgagttttgcgcctcagttctccagagaaaatgacaccacacccttcctgttgaacaaccatatacatatgttaaatgctgtaaaatcaaatcaatgttgtgaactgccgcagtgcagtaacttatttaggttgcgagtcgtcgtaaacttgtgcagtaggctcattcaaacactgatccttgtgctttataggtttttttaagtgttcttatgttttgtgatatctccttggaagggagatgtaaaacaacaaattgaataatttaacagtcaaaaacatgccttttactcctattctatcttgtgtatgtccttgaaagggatatatgagttttgagtctcaattctctagacaaatgacatcagactgcgttttctgaacaactgtcctttttatcacaagcatacttctaaatatgttaagaaccatagatggttgctctatcaaatcaatattgtgagctgttgcaacacaatacttatttcggttacaagtcgtcatacagttgtgcagtcggcacattcaaaaaccatatcatgtgtattttatttgcttttaagtgcagctcttatgttttttgatatctcctacctgaagaattttataacagtaaaaaacatcagtttactcatattccaatttgctttacccatttgcaggttgcaggcccagagtgctttagccgaggcagctgctgcttctggcgtagccctacccaaaggaccaattgatgtggcaaagcacgtcgtcagggaagccggcatgaagggtttgttcaagggccttgtccctacaatgggccgcgaggttcctggcaatgccgtgatgtttggtgtgtatgaaggcaccaagcagtacctcgccggtggtcaggacacatcaaacctcggcaggggctctctcatcctatccggaggccttgctggggcggtgttctggctctcggtttaccctaccgacgtcgtgaagagcgtgattcaggtggatgactacaagaagccaaggtactcagggtcagtcgacgctttcaagaagattctcgcggccgatggagtgaagggcttgtacaaggggtttggacctgccatggctcgtagtgtcccggccaatgctgcgacattcctggcgtatgagattacaagatcggctctaggctgattgattgctggttccaatggccatttctatctcttatcatggttgaaacaacaaccaggctgtgcagttgagggggggaaaaagcagcagtagcagttccaatcctgttttgcaagtttatttcatctgcaacattgtgattcaaaacattgaagtatggaagatgcaacagcgagcaagatcgctggctctgcattttttgtctgcctgtatgtataataatataagcctaacatgtgtggggtgtgggtgtggagtgagtgtagctgaaagaaactcgtcgtcttgtcggaatggttggcctggagtggattggccatctgacggcgatcccatggtgaggggagtgagtgatgctgtctgtgatggcgattgggggtgcgtttggtgagtgagtgagtgagtggccctggtgttgcttgccctcttggcatccgaatcacctctcctcttcttcttggtctgaatttttttgattccctctcaactagcatctttttaattggctgctattgccacagcccttgtattttagtactgagacctggggctctagttgttttgagccagttgagctgctgcagctttgggtgaggtggaggtaggaggcggcggccgctcccatccttccttcacctccatctatctccaagctcgatcttctgctgaatagtaatttatatttcttcttccttgtataatttcagcttcatgtttatcagttgggtcgatgatgcattggcagaaatctgtgtttcatgttcttcttcagttgttatgtttgactagcaaattggactgcagatcttcagatttgtggggggtggtaattctagcttatcatctgatctgacgtagaatctgaatgcctgtgtggtggtatttctttcgctgaatcctgtaaaaaatgtcggatttttgctgaatgataaacgaaacagatgcaaagattcatgcagtggagtggagaagagaaggaataaggagaagccttgaactgacttgcaatggtgatgaactaactaattgactgcaggagaggagatgggtgacgtggccaaggacctgacggccggcacggtgggcggggcggcgcagctggtcgtggggcaccccttcgacaccatcaaggtgaagctgcagagccagccgacgccgccgccggggcagccgcccaagttcgccggcgccatggacgccgtcaagcagacgctggcggccgaggggccgaggggcctgtacaaggggatgggggcgccgctcgccaccgtcgccgccttcaacgccctcctcttcaccgtcaggggccagatggaggccgtgctgcgctccgagcccggcgcgccgctcaccgtcagccagcaggtcgttgccggcgccggcgccggagtcgccgtctcgttcctggcctgtcccactgagctcatcaagtgcaggttcgttttcttctctcctgaggaatctgtctacaagaaagaaatggtgcctgactgactaactgcaaacgtgctgcctaattaaccatcccaaattgaattagcctagcgtttccgcaattgttatgtgctagtatatatatcaatgtgaaatgacaataaagtttctcatcagtcaataatattcagttttctttcagcaaacgaaacaaagagaagatattgttgagtgcatatttgttttctgaaaaattggagtgttgacttcataaaacagagtgtaatatctttaagcagagagcggaataagcatcttctttttaccatgtctactcccgtctccatgcaatgtttgcaacaggaatgctgcattcgttcatcgatgatagtctgattatctgatagaccaaaccccttaatgcttcctactagttcctagtagtgatcattactcaatatttgttctcactttttttaaaaaaaaaaatccatcattactcaatatttgaacaaacaattgcgtcagtacattactgtacacttacagattgagctccataatctgctgttactgcattatagagtagtaccatgtatcgaatctgcatcttgtgctgccattctcaatgtacacctcttgctcttggcatcacaatgcactaaaagtgcagaaacatacgagttacgggtgaatccaatcatcttgtactgacacttagctggttggtttgttgtggtgtcaggttgcaagcccagagcgcgttggcgtccgctgctcctgccgccgccgccgctgccgcctctcccgtcggcggaggcgcggccacggcgacggcgagcgtggcggcggtgaagtacggcgggccggtggacgtggcgaagcaggtgctgaggtcggagggcggcgtgggggggctgttcaaggggctggggccgacgctggcgcgggaggtgccggggaacgcgctcatgttcggcgtgtacgaggcgatcaagcagtacctcgccggcgggcaggacacgtcgtcgctggggcgggggtcgctggtggtggccgggggcctcgccggcgcctccttctgggggtcggtgtacccgacggacgtggtgaagagcgtcatccaggtggacgactacaagaaccccaagtactccggctccatggacgccttcaggaagatcctcgccgccgacggcgtcaagggcctctacaagggcttcggcccggccatggcgcgcagtgtccccgccaacgccgcctgcttcttggcctacgaggtcactcgctctgcactaggctgaactcatgtatcattacatcctcctccttcttgacccttaattttcttcttctgattctgattctgattcttgctgtcatccatctcatctgtggatgtaagaacagtgtaattctgtacacacaaatactatctttataaaaatttcctagatcacacaaactctctggtttagtggacttgttccgttggtgaattgttgatggtgagctaagcatggtaattctgtgatgctgttcggatgaatcgaaagggaaaaggggtctgcggagccgcatgcacatatatactccctctatgtatatccagattacagtattaggttgttttcttttgaacggagggagtacataccagcggattatataaactaggcagtgccgtagtaattaaccatcgccatcgccatcgagctcgtatatatcgtcgtcactctagtacctgtattacgtactccctccatactcataaagaaagtcatttagaacaatgtttaagtcaaaccttaagaatataaatcatgaataactcttaaattgttgagtttgaaaatgtaaagattatatgagtagatttgttttgaaaaataatttcataaaagtatacatgattacatgtatcacttttcaataaatatttttatagaaacaagaagtcaaagttgtgtagttgtttaaaataactttctttacgaggaagaagggagtacgatcgatgaatggaagctaaagctcaaacaacaatttatcgtcccatgaaagactgactctctctcttttgtggactttcttttgcgttggtacttggtaaggatgccgctcacgcatgcagggccataaattgtttggagatgactaaaaaccgtggttggctagttaattcaactcttgttgatgcagttctcacgaatccaaacggaaagggacgcttaacggcttaagttgacatctcatcagaggcaggcagctggctctgctttcgtcaggtaccacttaaaagataatatatattttcatttaattaatctagcaagacaggatggggtggtggcgcagttggctagcgcgtaggtctcatagctaaagcgagtgatcctgaggtcgagagttcgagcctctctcaccccaactttttttccgcttatttttttttgcaactccttaatccttctgtgacacaaattacatttttattttccttttctccaacttcttaatccttttatgataaaaattaattccacttaatttggaaatccttctgtgacacaaattacatttttgttttccttttctgcaacttcttaatccttttctgataaaaaaatattggccagtttgagattggtattagaccattcccaatagccatgatccgaaactgaaccagaactttcaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggagaagtcgttggcgaagtcacaaggcactccacttttcattataaaaccgataaaccagaaaaagatggattattttgcgaaagaatctttggacccataaaaagcagaatttgtgcttgtggaaattctcgagcgagcggagctgaaaacgaagacgaaagattttaccaaaaatgcggagtagaatttgttgattctcggatacaaagatatcaaatgggatacatcaaactcgcatgtcccgtgactcatgtgtggtatttaaaaggtcttcctagttatatcgcgaatcttttagataaaccccttaagaaattggaggggctagtatatggcgatttctcttttgctaggcccagtgctaaaaaaccaactttcttacgattacaaggtttattcgaggatgaaatttcatcctgtaaccatagcatttccccctttttttctaccccaggctttacaacatttcgaattcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagttttttttgattagacgcatgcaattggcgaaacattttattcaaacaaatgtagaaccagaatggatggttttgtgcttattaccagttcttcctcccgaattaagagcggaacgaaaaggattttccctgagatggtaaatgaaaacgattagccccatacgaggtttgggaataagtgatgagcaaggaatatacgtctttctgctaaagaggatctattaaactcataattcattagatctttgttatcaatgtcaactaggtatcctaagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctaaatggttaaagcgcccaactcataattggtaaatttgcgggttcaattcctgctggatgcacgtgaaccggaacgttccataagtctattggaactggctctctatccatggaatctcatccatcatccatacataacgaattggtatggtatattcataccataacataagaacaataagaactcgaattcttatcgatactggaactcagagcataggagagaaagtcgatttatggatggaatcaaatacgcagtatttacagaaaaaagtcttcgtttattgggaaagaatcaatatacttttaatgtcgaatcgggattcactaagactgaaataaagcattgggtcgaactcttctttggtgttaaggtagtagctgtgaatagccatcgactgcccggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttcatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgattcaatttgactacctctacaggatagacctcaacagaaaactgttgagtaacggcagcaagtgattgagttcaggagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagacccccgggggaaaatagggatgtctcctacgttacccataatatgtagaagtatcgacgtaatttcatagagtcattcgatctgaatgctacatgaagaacataagccagatgacggaacgcggagacctagaatgtagaagatcataacatgagcgattcggcatatttggattactttcctatatatccactcatgtggtacttcatcatacgattcatataagatccatctgtctagagatcgtcatattcatctagaaagccgtatgctttggaagaagcttgtacagtttgggaaggggttttttgagagaaaagaagaatctacttcaaccgatatgcccttaggcacggccatacataacatagaaatcacacgtggaagttcgagcctctctcaccccaactttttttccgcttaatttttttgc

SEQ ID NO: 36507 - DNA, 719 bp, Oryza sativa
cactactgcagttgcctaatataaatcaccatgcctaaatgttaacaaaaaacatacttcttttgtaaatcaccatacctaatgctgctttcattgactaatgaaactgccatgagttttgatcagctgctagctgcaatgctgcattgttcattcggagtgcacatccttttttggaatctcagacaagaagttggcatcaatcgaatcgctgtgaaaagaaatgtactgttcgccattggctttgactgtagctgcggtcgcaacgcaatgttatgcgctgacgtggatgaaagcacaaggaatctggtgagagaggcgatgtatcgattcgattatgaaaggaaataagacgaatggagatgcagagattagtcttttcagtgatgccatatcgctaatgaagaagcaatgggattggttcaaaggggatccccactaatggcaagtggagcacctaaatatactttgctgctcctaagcactctctgctttccaaccaagaaatttgcctctcgaatcttttgatttttcatatgtagtaagtatcttgaactgatttgtgcgcatttttccccctccatttctctctctttctcttggaaaagtagaacaacaaacaaggaccaacttgcaagctttttctccttcattgtctgaatctttaagcatatattaacctatcgatcgatggcattacattatactactacatgata

SEQ ID NO: 36508 - DNA, 822 bp, Oryza sativa
  unsure (1)..(822): unsure at all n locations
cgacctcacctcctcccccgacgcctccaccaccaagggcggcggcagcggaaaccggaccaagcgggctcccccctcgctgctcgacatcgaactcgacgggatcgagatgtggaccccgggccagaagcgccgcctcgacgaggactgctgcatcctctccgccgacccgctctcccccgacgtcgtcgctgccaccgccgccgccgccgcgaacgatgacgtcgccgtcgtcgccgagcgcggcaaggtacgcccgctcccccgcgccccatttcgatcgactcgagtgtgagacgcgggcggtttcgatgtttgcaggtggcgtgccgtgactacccccatccgagatctgcctgcgccaagtttccattcggcactacaccccatgatgatcattgcgagcaggtaccccttgccgcgcattcgatactctcactagttcaatactacatgtaaacaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36509 - DNA, 708 bp, Oryza sativa
atcaggaagtgagacacacacacaaaggtaagtaaaaattccaagcaaaagaaatccaggaagagaagaggaggaggagaggaaaaaagaagatgaagagattattacaggcagcaccaccaggaatgagatgtattagaagctgacccttcctcctccaacttcatgagacatggagcaaattcgaagcacctccctgaatagaagtgaaattgcagagaggtccaaaaagaaaagaaaaaggctattccgccgccgccggtggaggaggaggaggagcggcggcggcggcagcggcgttggcgttggcctcggagacggacttgagcttctggaggttgagcctgatgacggtgtcggcgaagaggcgggtgtcgtcctcggtgttgccgtcggggacgtcgacgatgtaggactcgaggacgagggtgcagatctcgtcgagctgggagacggtggtgacggatcggtagttgcggaggcggtgctcgccgccggtgatggtgaagccgaagacgcggtgggcgtcgtcgaggaggtcgaggcgctcggtgctggtgctggcggggaggccggagatgacgctgacctcgcggaggcggccggggcggaggtcgctgccgttgtcgtcgtggtgggggtcgggccggaggacgcagctgcggatgaagtgcttgtacacctgggggcagtcgaagcggcggacga

SEQ ID NO: 36510 - DNA, 36097 bp, Oryza sativa
  unsure (1)..(36097): unsure at all n locations
taattacttcctctttcccgtgatttcttttctcctccactccacgcctctactttttccacccttccgctcatggttaaaaataaggtacgacagataaatcgtaatgaaatacaagtaacaaacatactccaatattttgttgtagtagataaatggtttaaaagctaatgctgtaaactaaacttaaataataaaaaaatcaaaaatcgtgagattatattttaaattaaaatcttggttttgataagctaaatagaggtcgattagacatctttaaagtagagatttttttttgttaaatttcattagaattgaactttctcatgtgaaaaatttatgtgctagtacaacaacttttagcttctgcattagccataatatgtgggtttatttgtgaatttgagcttttctaggggcctgatcatctgcttgtactgttcgtttacgtgctggattggcagtgatggagcctgcaagggattgagtgggtgctgttgcttgtcgatgtgcagtgtggaccaaccccaatttaaccattgcattgcattattatgcacaataaaactgttctgcgcttttcttgtttttttgttaaaaataagtagagaaggaagcaaactatacttgcaaaaatttggagacctctaatgctaacatactttgatacttcattatttcaatgcatatcaacatgttcatcctaatacgacaagatgagggagaatattaggtgttctcccttctaatctctatggttcctgttacaatatttcaggaaaaagcttgtccctttgtgagcttattatcaacctgcagcccattgccacatttttttttctcttgcagaacatagcttcaacctcaatatggcaaacagacttcttctatgttgtcatgttcttaatacttntaggagtaagtattaatagttctttttatgcagcaattgatatttcttcagttgaggccttgagggtttcattattaaaaaaatagagtaaattttataaaggtatatttttttatcaaattattgcaaactacatatntaagatgttgtattacaaaacgatagatttaacaccaaatttaccatattcttacatatttaaggctaagtacatcaaaacaacatatttgatattagacttatcacaaaactataaattttagggtttaaatctttagcactatgtttgagttataaacatttaagttttatgcttaaatatgcactaaagctatagtttttttttgataattttattaataaatctatagttttgcgatactccaccttaaatctataatctatgatatatttggtgttaaatctgtagttttagatacaccatcttaaatctatactcttgtgataatttgagaaaaaacatattttttgggaatttactgaaaaaaagggtatatatgccatctggattaacagatgacgaacacacgagacatttgtaaagcataaatacgagtatactaaaaaggatgtgtatacattatgtcgacaaaaccgtagtctacatgacgtatgaacatatttttatttttgttagttctcaatatattcaattccgtgtaggtacttctaactttttatttttaacatgcatgttcatgtatttactaaagcgaacgaatttaaaaaccaactcaaaaacatatatgtatttctaaaagcgaacgaacttaaaaccgactcatgcacgaataacgtatcaaataccggtaaaaacatcttaaatttttataatagtagagatatagctcttcctatataaaggaaaaaatcaataggacactagaaatgataacttctaagaagaatctatctcgacatagcattatcttccaaaataggggtgtgaaaccggtggttcacttttcggcgagttggatggtggaccatcgacgtgtattttgacaaatgttcaggtgtctcatagcaattatatcccattgttattcagaaaaacagtaacaaattaaatgattgcaggaagggtaggattaagaaaatgtgagatggtaggtggggccatatcaggcttgttcttaatgataatgagcaggtgggcccttctggttgtccagtgagcgtgccggaaatttagggttgggggctgttggctcaatcaaagaaacaaccaaaaggaaagcctcagcagaaaatgaataaatatagtagcagttactgtgagtaggtgtttgaaggaattttgtagcagggacactttgtgacttggacatccaagcacacatcacatttagatcatctccaaatcacactttggcaaccaacttggcgacggtgatgcctactttttatttgatatctccaggtattctttccttttcttttttcctttctgcaaacgcactggaaaatcactatgcctgatctgccccttcctttgttttcttattaataattactaccctcgtctataactataaagaagcgaataataaaaatggtttcttcaacgaatgcacattgtacccaaaggtacttaaattcaatatttttttaaaaaagaaattaaaccataagagaactatcaattatattttaatgaataggagtaaaaaccctaatacgcttagaaaagcctcaccaataagttcaaaagaaaaacccatgaccatcaggggcagaaaatagctatggctgaatacatgtaatctctacaactagctccgtaatccctattattatttttgaaatgctacataatttatgaaaaaagaataagctctccttagcttagctgtatgcttgaaagttttctgtctcgtcaacctcacgcaataacaccaaacaccaaccatacacagctattgcatcgttcctgtgctttgttgcaaaaacagtacgtcgtcgtttctgagctttggagtagtaccgtattttgggaatttctagtaccgcggggtggtatcgtaaagtgcaaatgtgatactccagtagatcaaggatgtgtttagtttacaccaaaattagaagtttagttaaaattagaataatctaacaaaaaagtttaaagtttacgtgtaaaaatgtttcgatgcgatagaaaagttgaaagttataacaaaacaccgcacaagtagcatcatgcgttgcattgtgtgcaggactactggcctgcatctgatactgtactgtagtataagatcaagtttaatagtatatccaactactagctctattttatttataaccaatatagtagctcattatacaatagttatatactacactattaatacatgttcctatctgtcatacacacactgcgtcttggagtccgtgctacatctggctacaaatctgtagcccgctgctcttctctcaccttatttattttcttaaaatatgtttgcagctggtttatagcatgctattgtgataaaggagaggaccactggatacacagcattgcacgcagttgaagtcgcatctggctccgtctgcttcgaatactctagaaatacatgccataccgtatagtatactctagtaccagtatatgtgtatagcctcacaaaagtaactgatgagctttgatccaagaagatcatcataacattgttattctgggcttggccggaccaatatttgttttctaaacaaaagaagaaactatacccttgtataaatgctaatacacgaagaaatattctctcctttctaaattgatcatcatataataaaattcaaaattagtcaaattgattataatataaccgcattgaaactgatttcatcataatataattaatacaacatgagagaatctgtgcatgctaaggtataattggtatagtgttttaatcgatgcatgcattgtgggagaatgtgtgcatgttgtcttgattgatgtgatttaaattatcctttgtttgtgtgattggtgttttgattgatgtgatttaaattgcatgcagcaaagagcatgcggttttaactaatttgttttttttctttttctagaaacacaacacaaacgtggacgctcataacgtgtacacacttacccttatatacacacatgcataaaccccaattataaacactcataacacggagctatctcgtaagcatctctagaaaattgggctcgcatatgttgagattcatgaagtcaccacagtgggtacatcatccaccactctagtaaccgtgtcaaatataaaacttgaatccgagtgaattgtccttaatactcctagaaggagaaagagatagcagttaacgctgtagatttattccatcatgtaaggccatgtttagttctcaaaataaatttttcacgctgtcatattgaatgtttggacacatgcatggagtgttaaatgtagaaaaaaaactacacacattacgtgtaaattgtgagacgaatcttttaagtctaattgcgatatgatttgataatgtggtgctacagtaaacattttataataatgaattaattaggcttaataaattcgtcttacggtttttcggcgtaatctgtaacttgttttgttattagactatgtttaattttcaaatgtgtatccgtaaatgcagtgtgacaacgagatccaaaaaggaaatttttggttgtcacatcggatgttggaacaggttttttacacgaatgaaaaaactaatttcataaaccgcatggaaaccgcgagacgaatttattcagcataattaagtctgtcattagtatatgtgggttgctatagcacttatggctaattatggactaattaggctcaaaagattcgtctcgcgatttccatgcaaactgtgcaattagtttttctttttatctatgtttaatgctccatacatatgtccaaatattcgatgtgacgttttttgaaaaaaaaaattaggaactaaagaaggcctaaattactctcggcccatgggctccaacaaacaaagaccttgatttcaggcagcggcccgtaaaatgcagcgggaaaggggcggaggttggtcccacatgtcagtgacggtgactgttttcaaaatggaataccaaccgctctatcctctcgcctcgtctcgccttgcccgcctccgtttcaatccccaaatcccctcttccctccctccgatccctagggtttactccctccccccgccatggccaagcccaagactagggggaggaggtcggcccccgcgccaccgcctccgcccacgcctccccctccgcccgcgccgccggcgaacgtgatcgacctcacctcctcccccgacgcctccaccaccaagggcggcggcagcggaaaccggaccaagcgggctcccccctcgctgctcgacatcgaactcgacgggatcgagatgtggaccccgggccagaagcgccgcctcgacgaggactgctgcatcctctccgccgacccgctctcccccgacgtcgtcgctgccaccgccgccgccgccgcgaacgatgacgtcgccgtcgtcgccgagcgcggcaaggtacgcccgctcccccgcgccccatttcgatcgactcgagtgtgagacgcgggcggtttcgatgtttgcaggtggcgtgccgtgactacccccatccgagatctgcctgcgccaagtttccattaggcactacaccccatgatgatcattgcgagcaggtaccccttgccgcgcattcgatactctcactagttcaatactacatgtaaacaaaccaccatatgcaaaattacagatgtgataaacaatgcatttccattacaaaatcctgcaattgatactttcatgtccatacatctagccatagaagattttccatagacaggatgggtatagaaacacacacaaaaaaaactcacaatgtggcttctacttgcaacaagttatggagtacaatcgttgctcgctcagtcgtttgttactgcttggtggttgtgaaaatttaggtccatttgccttttcaagtgttctagtattacacagattatgtacaggagagaaagcaccactgcaccacagaatgctgtcctctaacagttgttgttcactaaaattagcttactttatgtgatcatgctttgctatcaaattacctactaaaaattcaattataatgctccttactgcaaaaactaattgtttgggattttcttgttatgtatatactagtgaactgttagctagcttgatcatgtagtgcacaggacagagcactaaggagcttactttatgtatctataccaaaagtagtaggtaacagcttactttatcagtctttcaagcatccataaaccctattacagttgcactactattacataaatagtaggtaacagcatcagtttctgtatatggtgattgcttccatgttgcagtgagactgtgagagaagcacctccaatccttcgttgcgtatcatggacaatttgtccacaagaattctgagagatggcatggtttaatgaactcaatcaccatgttccctgttaaatactgaaattgaatactagtgtgcgttgtacacttgtggtagagacgagctgccttgacatgtaactaaacttgctagttttgtcgagtatacaaccacaccacttaaatcaagcacgcgtgttggcgtgtgtctttcaagcatcaaaatggtctactgtgtgttagtgaattgttggttgacatccatacaccctattacagttgcactgctattacttatctgaattgtcaccaaacgtgttcctcatgtgttgcagtgcttctgctacgtatgcgacgtgcctgccccatgttcctcatggaagggagaaaaagggcattgccatgcgtcggacaaggacaagaaatggaaggtcaagagaacggccaggcagaagcgaacacaagtagtcaagtagcgcttacttgatggagaaaattagttgatcccacgcggcgcaggcctggggctggccatttttcacttaccagtcgggttactgcagcagtaattgtacagcgttagaatatggagttaattagtactcatgttcctatatatagtatcaatgggttagcaacaataatagtatatgatataactatggagaattatcagtatccattttattgtggcgtctaattccagcatcagaagtgattcgcgtgctatgtaatgctgcgcggtcacagttcactgctcctcctgcatagctcaatcctctgttttgctgcaaaaattggaatatcgtgttccatagtagttctactaacataacgttgctcttttaacatctggattaatcatttcctgttctttaagtttttcctactactgcaattcaattgcagtctgttcgtctactttaaacccctcgagatctgaatatgtttgcatttatgatttgccgtccatctattttctcacttattgaggctcttcgttacccggtgtgcctcttgggactctgcaacttgttttaaatcaggcttgctatctggtgtatataaatgtagggatgaaaacggtcggaaacgatcggaaaacagcctcaaccatttccgtaaccatattttttcttagaaacgatatcggaaatgataaagtcggaaacgaaaacgatatcggaaatatcggaaaaccggaaaaggaacaatacaaacggaaacatgtcggtacagatcggaagccagtaacaaatacagaaatattaaactataaaaatatatatttaactttacataagtatgttatatgtatacataaattcaagcttatactatataaattataaattaactttattttagccatgtacaaaatttagagatttgattgaaagtctgtcaatctgtaagttgtaggtcaagtatagacataccctataaatatcgacatatttaaaatacggtaattaccacattataagaaacggtaatttccacaagaatacggtaaatacggaaacggtcggtataacagcaaaatcatttccgttttcatttccatattttttaccatttccatttttgtttcggttgattaccatttccatatggctcgaccggtagaaagtcgaaaacgaacgccggtcggccggtaattaccgttaccgttttcacccctatataaatgaccactttgtatggtgatcgccttcaagcaaaagtggccaagaaacctccacaagagaagggagaaatggtgaagatcgaagaggagattgatgctgagagtgacgatgactgctgcgagatagaccctgacgagttcgccaggaaagttcagctcaaagtatctgatgaagtcatcctggtagctgccaaagggcaggtagatattctttcctatgccttgttgatttgttttgttccatcttctccagaaatctgatgatcattgtaccattgtagttcagtttaggttttatctttcttttattttgttgatgcaaaacctgtgtatccatcagacaccttaggaagaattttcaaaatacaaaatatgcccccaaaatatttgtgatatgaaaccatgaaccatcggaacatttctcgtgtcataatctgtagatcaaagttgatgcgaaccaaccggagggctttggaaatttgttggatctctctgactctgacaacaacctacagccgcatcatgaatatgctgctggagatcgcatggatcatccatatgagattgatgaagataaaaccactctagaaaagctggttgatggcgaggacaagtacagagctgatgatctccaggtagacgaaggtgatcgctgccgtgaggaagtcatacctgtcaagatatcggtgaagagcgaacctgaagaacacggtgtcattggggaagaagatgcatatgatcttctcccggagatcaatggcttcagtgagcagctgttccctgatgaacgcagagtatttgatgaggaagacgacgatgacgttgttgtcatcgggagagattctctgtaaacgggttccgtttctatgtaattatctatgtttcttcttcaaatgagaataccatcttgcgaaaataaattttgtggtactgtttaatttttatgttgtttactacacaaatacaagggcatgaatgagcctctgataccttctcttatctacaatgatgaacatgtaggtggcactgagagacttccctcatccaagacacttgtgtgcaaaattccccttcgataagacttctcatgagagcagctgcagaaaggtaattcgattttatccgtgcaacttctcattttttcacctcatctatctgcagacataatactagttgtgtcgtgtgcttgcatattgcagtgctattgctctgtgtgtgaagttcctgtttccagttgtctcaagtggaaaggatcagaagggcactgccatgcaaccaaactaacctagctatctcagaatcctccactttacgattgatctatgcatgatcagactgtactaagttcactagtttttcctcatgggtataattctgcctatcaagaaaacaaggttcatatcgatttatgcatgatcaggattgtactatgttcttgtttttcctgttgatataattctgcttatcaagcaaacaaggttcagatcacaagtaatagctcagtgcatggtactatgcatatttgtgatgtgctgaaaaagacatgtgattattttgggtaacaaagcagcttgaatcaattcatgccatcattttttgggcaccggaagcccataatttttgcaagatacataactaattcaccactgtttgtccaggcggcataatttaggggatatgctgtcatagcttcccctttctttcgaatgaaaatgatggcatatcaatgagcggcaaggggtggagttttccaaacaaattctcaccccaggtgctcccagataaattataaagtcattttagatgatgcaatacagatgattcaatggcctggtttgaagccattaattataggtgccccgttaatttctggtgcagctcctctgttcttcttgacgtaggcagcgtattcaccatagtgcatagtgtacaaggtactctggtagcgggtgacacggagtttcttcctcaaagagtcggttatggtaccattgtaacctgccttcctcatcagtgagtcaatggtctctagatgtgtccatcctgccaggtatcaggcttcatgttatgcatagtttcatagaaatgaagaatgagacttatcactagggtgatccaggaaaaactagatgaacaccatcaccttcttttttttgttctatcatgcttctgaatttgtattttcatcacaatgtatgcaaaaggtgaaatatcaagtgaggcaactagataactcagcatgggaaaatgttgaacggtttaactgggaagataacaggatccattcaggtagttttttcatgcaacgcagatcgaacatgctatagacaaaaaacgaaattattccccacatgaatttaactttgtaactgagaagaacaattattaaagtgcttttagtgtttccttgtggtagttgcaataactaataacttagtgacaacatgtgtagaaggtgaaaatgcagcattcagcagcaatatatagatgcaagtaagttttcaccttcatgggcagcaacctcaggtaaataagttgcactgcgcctcatgttatagtctggatcagtgaattcaataattaacccatgcttacccacctgcagtaccacaagattattagaagagagtgaaagaacgactaaaaccaatgtgtagttgcatacctcccagtcaaggtggttaagtgcagtttcatattcggtcagtatagatactgtacactccaaatacggcagttctttcgactgtataggaggaaagcggcggtccctcaatgcactgcgagagagtatatttatctttttgtctgtcttgatataacacaaggagtcaacattacctaggttctgttatgtgtagcaccccaaaaaaaattcctccaattgtattgacaatgagaccatgtttcagtaagaacttataaatgggcagcagtggttattcagtagttaccttgtgagcgcatactccttgaagccagtgacaatctgacgagcctccaaggttccaatgcatcctcgaaggcgtggttctgaaccattggtagccttcttccaggtgacaaacaatgggctgaagtttacaaaaaaaagtagtcccattgagttcagaatttggttgctctagctagaatattgtaacaagaaatcacaatacaaaagctagacatccttaacatgtatcacaatggtagaaaagcatctcaaattgaaggcaggctaaacttaaaaaaaacacaccagaaaaccgaaggcattctatgcacccctcctaagtatggtcaaaagggggaagatactgtgtttgtgacgatttctaacactaacaattcttcctcaagataatctcaacaacagcaacaaaattcccccctctgctttcagagagaatgagacgaagcaatccctctgctgaaaggcaaaggatacaaccctcttgtgaaatgtggctgctttgctttctctctgcaagaatatactaatactaacagtaggccataggaaggccatacaccaaaatcggcttaagccaacaagtaatcgatctgcgtcgcagatgacgatgatgataaatcaaagcgaacaacaccctccagaaaccgcgaaaccaaaatcaaacaagaggccaaaggcggcacctttccccccaatctaccacaccaattgacccccaaaccgcacgggaatcgctcgccgcaaaaccccccaagctccccttcatcggggaaggcggacgacgagacacacgcgcgatcgcggcgggagcgagaggaggagggagggggtgcttactggatgccctcctcgaaggcgggcggcggcggctggtcgccgctgtagtgggagacgagggcgtcgaagcagtagaccgccatttcctccgtggccaccaccatcctgtcctggcaaggggcggcgactcggcggtggagctcgtcggagaaggcgaggcagccgccgctatctggaggaggatacggaggagaagcgatggatgcgcgtcgcgttgggtttgaggtcaagtcgttaacgcgacgagctccttttttttatttggatggtctcttttgccccttggattttgtggcatttacgtgttttttatggctataggtggggacgggaggggtagatacgggatttccagtagatttatctgtagctagagtacacaaatctgcaaaactgagaacaaacgaccagcgtgtttccttttaaacaaaaatttagcaaacaaaaacaacgcacatgtgagtgccaaacttatctggattctggacccgacacgtctacgtttttggcagatgcagtagcatttagaatgaaatagtaaggtcgagttttgttccaaactttcttttaaaactttcaatttttttatcatattaaaactttcctacacacataaatttttaatttatctgttacatcgtttcaatttcaaacaaactttcaattttgacgttaacgcaccctaacccaactgcacaacagaacaccaaatctgaattcaaaatgatttgtgtttactttaatctggaggggaggggtagttgagttttaaccatttcattatcttcttcttcttcttcttcttccatggcttgcttccacctcttgccaacgttgacatggatgtaggatagtactatcagcgtttccctatcactctcccccaaaatgcaagcctgatgctgacatttttgctaatccacctctggggccaggcaaggcaaagcatgcgtattatgcaagcagcatccattttggagaaaaatagtgtgagctagaaaaatcaaagttttaacatttgatgcagaacaagcatgctactactacttgtatactagtagcacaatgaaaaaaagaatctatcttgttcttaggtgcggctttaggtaggccacttattctttctgacttaatgctccagatatcacagtacagtaccacatcaacctttcacagatgagagcgactcttgacccaacaggatcgaatcccatccaacaaagtaggattcatatctagtacatatgcaccatcctgcaacttggcactaacaacattttctcttcatttcaatgcgatttcagtggaccacattctaaacagaccaagattatatgtcatgtctctcattatctataaaaaatatgtcatgtatcttgagtgtacacaagaaccaatgaaagcacatgaactattgccactgccttatctaggagtaatatcttcagttcaatatgaaatccatgaagtatgtagcatccttttctggaaccaaatttaaggaatgaaattgtaacaaacgtctgaaaggactgacaagctgggtagctcagctgtactgaacaatgagctagctaggcctaaaagtaaacagatgctatatacaaatggaagtcctacgactttcagctaaaacgatcagaagtttgaaacatggtctgtttcaatatctgaacaaaactccaggttatctaggtgaagtgtgaatgattcggccaatctgtcggcgtcctgaacccgtaagcgtgtaccttgctgcgcaacgacaatagcagctactcgcgaagcgagcaggccaatgctcttcaaatccgaagagccccgaagaatgccatatagaatccctgaagcgtatgcatcaccagccccacatgtatctataggtacacatggtggtggagggatgtatatcgcttcccctttcactccaatgtatgaaccgtgcacaccatctgtcacggatactagaggaacagaatggcttaagtatcttgccgctgacatggggctatctgttgagcttagctcgcagaatgccctcgcttcattggcattggcgaataatatgtccgcatagtttgttacaatatccctgaaaaatcgttggtttatggtcagtacagtacagtatagttcagagatgagatagtggctcactccataatatagagaaagcatacaattaataccataaaaaatatttttggtttaccatcagtacaataaggttcagagatgaggtagtggtacactagcataatatagagaaaataatacagtcaacaccccaaaaaacgtgatgctagcaggagatagtttgcaaggagactagtctcaccaaaaatcattgtagcaacgcttgatgcatgacacatctgatgctgtaactgcaataagtgagccattcttatgagcatcttcacatgcttgcttgatggcttcgatcgtgtgaggtagctcaaataggtagccttccacaattactacatttgacttggacactagactggccaaatctgaatcataactcaaagttgacgatgttccctggaaatacacacacgcaaaaagggaacagtaaggtcatactcctatattagtgccagcaacacttctatatagttgtccagtaagtaaattatacacggtgaatgttcaatgagtcaaaaagtacagctaacaagtaataagacctgtcaagtaaagttgatatctgatggtggttctcattgatacattcatactaaaagcagacctggttaaactactcatcttcaaaaattaaaatttagtctgatattgcaacagaagtccctagaagggggaataacaaccctgaagtacaaacatatcaactgacctgatatgcaagcatagttcgttgtgcatctggagttgttagaacaatcacagttccagtagtcccatctttgaccggcttagacaagaaatgcaaattagcacggcgcaattttgccctaatagaacaattcaaccaacagtgtgatgtcagccaacactctgaagcttctagtgcagcaattaagacatcagtacgtgcaaaaatatgttgtcaaactagtgaactacctgtaaaaactaccaagtgggtcgctgcccacactgccagccatcgcgattctaagctcggggtagttagtggagcggctactaccaagccttgatagcgcgacaagcgagttggacagtgagcctccagcggcagccttgtagctgcaaccatccatggcgcgcaagacacgccctctctcctcgtggttgacaacctttctggtacccttttgtatgcccaatctgtgaaggaactcgtcgtccaccatccctgagaaatcaacctgtttgcaggccaaaatcccagccacaaattagcattgatcacaacagctcaacaacctattgaaacagaaagaacaacatcatagtgataattatttccaacacaaacacataggaagaaagaagccgtctttttattaagcgttcatgcaggttgcacgcacacgagtagtgagtggatacagtggcgacagttgagccaaattagccgtttcgaattcgacatttctaccataggagaagtaattttcttgtatgcgagtactggttccttgcaaatgttcatcgatcaggaacacgaagtaattaatgaatgaatcaataatatagatttatcttatttagagtagaattgaagaagatgggggcgtaccatggcctggccgaggccgaggacgtcccagcgctcggggccggagggaggcgcgtggaggtcgaggttgacgtcgtcagcgtcgagcgggcgcaggacgccatgggcatcctcctcctcctcgtcgtcactctcagccgcatcggcatcctggaatcctcctccgaggagagctctcggcagcagcagcaccaccgccgccgcccggtgctcccaccgcacggcgaagcggctgtggccgcgtggcctgggtacccgtcgccggcagggtcgcggcagagaggaggaggagaagcggtggaggaggcgggaggaggaggcgagcgccattgttgcggaggagaggatggcgatcgatgccgtggagctcccgcggccgcccaccccaacctctcgtctcttctctatctatcgccacgcatcccgacctcgccggtagcgtgggccccacctctcagtgactctgtaatgggtaggcgtggcggtggacccacgtaatgggctacgctgcctgtaaatattcgagaaaggaaaaaaaaagaagaaacgggtaattcggaacgggattgtcactaagtccggcccatgggccatgagtaagtctaactgggcccattttaatagagagatccgtgtcactaagagtgggagtaagtttgctttaggtccatctttgaattatgtcttccaaccgcaatatgagatgtagtgtgtttctcaatttgcaaaactgatttacccgaaaatctagggcactagggggacagtatagtgtctaattttggctgtcgtggtgagtttcccccacatgttgacggcagagagacacagggtgggtggagctgtggaggtgatgctggaccggcaggtcgccaacgacatattctcctatgatgcagaggtggtgagggagtgtccgcacagcaggcgcgacacatcatcgacgagacacctaatgctcatccccaaccatcccctccactaggctatccacgaatggcgcctccgtcacgccatacaaaacaagtggcctcttggtggctgcttgccaccctccagtcgcacacccctcgcaccataggccgtcgcccttctccctaccactcatcacctcttgtcactgctcggagacctagtgataactggggaagatgggggagacaggaggaggaagaacatcgcctacaaatctaccacacttccaatcaatcgtaaccatcagccccctccaagttggtagccatccttctccccaccactcatcaccctctcgtcactgcttgaagaaatggtgacaaatagggaagatgggggagagagaggaggaagaacgtcgcctaccacccttccaatccatcacgaccatcgccccctcctccaagtcagcaccccgcatgcctttctccgctcaccaccttcttgtcggccacctccccctttttcctcccgcttgctgctctcccatcggctgccgcttaaaagtttggtgagaatctgagagatagggagtgggaggagaatagttggcagtatgcttatttaaatacatacttatttacttgattcaaacatattattatatatttcttttttgccatgaaaatgcttggccaccatattggcagtgtttagttccattcaaacttttaaaaactccatcacatcaaatgtttggacacatatatggaacattaaatgtggacgaaaaaaattacacagtttacatgtaaattgcgagacgaatcttttgagtctaattacgccatgatttgacaatatgatgctatagtaaacatttgctaatgatggattaattaggcttaatacattcgtctcgtaatttacagacggaatctgtaatttgttttgttattagcctacatttaatacttcaaatatatgtatgtatatttaaaaagaaaattaacacacgaactaaacacggccattacgctgaatgcatatatgcagccagccagcagtcagtcagcagttggaaccgtattgattatgttgctgctccatggatggattgcatttactactgtagtgtaaccttgcctatagccagttgtctgcctgctcacgcagcatattcattcatcgctaattaactcatcgagaaggggagtataggtagctggtttacttcccaactttttcctttaaaattttaatttttctatcacatcaaacttttctacacacgtaaactttcaacttttctattacattgtttcaatttcaatcaaacttactaaacacacccttagtataaatctggagaaggcgaggcaagtgaatacagtacgagtgtacgacttttcatctactatcagagaatccagaatatcaccggttcatcataagatcccaaatctcatgggggaaattctcaacagaatatctagcccagtttagttcacaccaaattttctcaaactctcaacttttcatcacatcacatctaaaacttttctactcacataaactcttaacttttttttctaaactaccaattttccccaatttcaaaaactaaatacagccataatcacgttcgttcgttcgaaatcctcaacaacagaagaggccggccgggtacgaaaaaggtcaaaagagtgaggagacgacacttgacagctgcatgcatatgagagcgagatgtcctcctatgaaatactatgatgtcatcgtcgttgtgtgccatactttccgttgtgttggttgcgtcaggcctcagccggcgaccaacacatgcatgcatggcatgcgcgttgactttttattttgtgtgtgtgtgtgttggttggcggtcaatgcgaaagaggcgacacatgtgagttgggccaaccaatggccatgcatcatctgatcactcgaatgaatctcagtgcaactagcactgtgtggttacggatcggttatctgacaacatatatatggacccccaaccctcttgatctggttgtacatttgtaggccatgcatcgtcctctattggagtactagggtccgtttaaaagacctataactattaaatttaacttagaagttagatatagagtgtagctgtggagaatcataaactcatttccatatctttagcgttttgttggagcgctgcacccagtttcactcctattttagttggagttgaaactgtttggttaagctctaactacagaagaaatagagttgaagctaaagttatgccagaaaggtccctagtatactcttgcatgaccgagatcatttaagctacgactatattactcatgaacaaagaaaaaaactgaaagtaatttataaataaaagttttatacttatatttgttattaataaaaaaagactacaacggaaaaaaaaagctaacataaactctcaaagatattcttttttaaaaaaatatttttttttactactcatgttatctagtagtatgattctataacaaattaaaaagcagatgaattgaacattataaaccttcatctttgaaataataatatatatatccataatataaatttgcacatttgtctgctggatcgggtggacagttcggcccacccgggatgtggtcgggcccgggccctgcctccgtgtttctcaggcccaccaccgcccatgcacagggaccaaccaaacaccagcagctgaccctcgcagcgggtcccacatgcagggacaggtggcagccctcggaaatcgcagcaagaggtcgcaggcggtgggtcccacagtagtatattttatcggtctcgggacggatgagatggtcacgtgatgggcctggaatcctggcccggggccccaccaccagcctcaccacctctgactcacctccgtgttcacacccgctcccggctgcgtcgctgccatgtgggccccacactggccgcctgccgaatagcctcgctggtacgtgtccgtccaaagtaggcaggctgcagcaggcgccacttttttttctctctcttttgtaatttcttttttcccgcgagattattatatttaaaaaaattgggaagggtagacgtcgtggaaaagaggcgagatggcgcgagtgagaaagccgagacggacagagcaaaggataaacaagaagcaaaaagaaaatcaatttgaactggctgattgattcctcctgcaagcacgcccaaaaagacaagcccttttttaaattattgtaatcacagtggtaggagtactagtcccaagccatcaatactcgaccactttactttatcccaatttcctgcattttttactagtaggaggagtacttgttactggtactactgtagtaccaccattatatacttgtactactagtagtactatatgggtcagttattgaattttttttttttgaattttgaattgaatgggggcggctgggttttaaaatgagtaaatagcaaatacttaaacaggaggaaactgaaagctcttttgaattttctattgttagcggtggtgggatggagtaaaaagttgggaaaggaaagccagtgatggtttttatgacttgcatcttcacgaactccgagccaaaaatgctttccccccccccccccccacctcctctcctcccctttttatttattgctgcagtagccgtgtatgtgtgtgagagagagagtgaatgctggtgtgtacgcataacaaatttcctttctccacccctttcttcattactactactacagctactatacgtagcagttgctttacctttaataattcctttcctttccagtaatttccctggtattttcttctcctctctgccttgctttgcttcttcctcctcctcctccacctttgccctcctgcattttgcttgcaaaggataggagttgcagtactagtattgctctctcattgcatgtgaagctagcaagcaagcaagcaagagagagattctaggtgagtggtgtttggtgtgaagggaaggagcatggtgatggtggcatggctgatctgctgctaatagcaaggagtagtagtaataataatactactagtcactcatcatccttctccctcccttgagcttagctataggtaggtagtaacactactgctctactacatcctactcctaactcccacctaataataataatctctctctcacacatcacatttctgtttaaaaaaaagtcagcatggctatccatcagggggagtagtttaattagggagcgttttttcttgcttaattcgcagttaatcttgcaagtggtctttgctcttgcagagtggagaagaaagaaaggagagtagtcaaagcgactctttctttgttttcttgcgcttcctcctcggctgagctcagcagcaagcaaacctgctcctgctacagcagcgagcgagcgctagatctgaccaaatggaggccaaggacgtctcgccgctcgtcaccgtcccgcccgcgcccgccgccgccgcgccgccacctgcggcagcgcccgcgccgccgccgtcccagccgccgccgccgccgctgccgttcgcgcagcaggcgccgccgccggccgccaaccccgcggcggcgcccatgcggctgtcgttcgaccagatggcagggaaggcgcccgggggggagcagcagcaccaccaccacccggggcccatgctgtacgcggcggcgcccgcgggcggcgccgcgccgccgccgcagggcggcaatgtgatgggcatgggcgagctgatgcgcaagaagcgcggccgcccgcgcaagtacgcgcccgacgggagcatggcgctcgcgctcgcccccatctcctccgcctccggcggcgccgcgccgccgcctccgccgccagggcaccagccgcacggcttctccatcagcagcccggcgtcggatccgaacgccaagcgccgcggccggccacccggctccggcaagaagaagcagttcgaagccctaggtagtaccattttcctcggagaaaaacaaaagcgccttttcttcccccgtggattccggctgaatctaatcccaaactgacgcttttgccttcaaatcttgcaggctcatggggcatcgccttcactcctcacatcctcaccgtcaaggccggcgaggtaaacccagatctcaaaacaaaacgattatcttttcttccttccttcctcctcgatccatccgtgcagccagccattgcagagtctgctgctgctgtacagcaagtggtgatggatctatgtctgcttttcctgcggagtggatttggtgcacgtactaactccactccactccactccagccatgaccatgaccatcactggttaggttggaaaggaaccaaccaaggttgcgagacgaggacgagctgcggtgtccgtcagattcccagcatggctgtcagttgaccggccccggccccacggtcagcggcacagatagtgggcgatgcacctacgttgtcgtggactacgtgtagtagtactcctatcatcaagtacaacaagccttctctggctggctgtgtagtagtacgctgtccaacagcaagtagtagtagtagccacacctgtggactgtgactgtccacaactccacacctgcactgtcttgttcatagtcggatacaattgcctctactgataggaactaggagcactcgcctgcaggagtctcctgttgtggtgtgcttagagttccatgtttactgcgcatctgaaaaaaatgtcatcttcagttgtgttatcttgcactgctgaattttctgttatacctgcaactgactgaattaaagcacacttgatcatacgattttcttaatatgtttagcaacctttttgaacttgtcataaagtaaaatttttatatttgtatccagatgaatttgctgaaggaattactttagccaagtatgaaaagacctgtttttttccccgtgtaactctcctaaattagatagaagtggatgcaatgggctgattgttcatacaaatttaaatggatttgcttttcctgaaagtatctgaatttgtatgagctgtcaggcataacaattcaattgcaatttcaagctattcaggattcttagatacagatacttcaattatatcacaacttgggtttttttcttctgatatcttcaattctgcatcttcttttttttgggggttttggtgcagttatatactttccttagtgcttactaggtgtctcttttgaatgcaatgtgagttgtgattatagtacctttgtgttgcaactagactctttcttcatgtttaatctagtgattaacccacttggcaatgttggttatagtaaaaacttgatttccatcattaactgtctactgtcttcgctgacaggatgttgcttcaaaaattatggccttctcacagcaaggccctcgcacagtttgcattctctcagcgaatggtgcaataagcaatgtaacacttcggcagccagctacatctggtggacttgtgacttatgaggtatttgtcttgtgacttatctttggtgcactttaagaattgggcttaatacttctcatttatgtgatcacaagtgggtgtggttctgtgggggttattgttgcacctgtatcttagaaataaaagggggcttctcaatgatgtatagactgtagaatacatcagttttgttttgttttgttttttttgtttctaacagtggtatggctatagtagagaaagaccaggttctggaggaaactaattgtgcctttttgttaactagaacacccagtcttgttctgttggaagtttcaggaaatctgttgataatagccactagtgtagcactatggattcatctaacttcaagttcttttgtcgtgattaaaccaatgaatgtgaaaaagaaaatcaataatgctactactttgacagtacacaattattcatgtacctggaggaattagctctgtgaattgtgcatgctttagttatttcctattagcaaaagtaactactgtatcatgttctgatgaatgcgtattattttgtgcagggccgatttgagatcatctctctatcaggttctttcctgcttgcagaggatggcgacactcgcagcaggactggtggcctgagtgtcgcacttgcaggatctgatggccgagttcttggtggatgtgtagctggaatgctgatggccgcaacccctgtccaggttcgatttcgttctgtataacgagtgtcacaactaacgcatctgttccaacttcttaatgcttaccgggcatttctgccatcatgtcatatggctaccaggttgtcgtggctagcttcatcgcggaaggtaagaaatcgaagccagtcgagacaaggaaggtcgaaccgatgtcagcgcctccacagatggcaacctacgtgccagctccggtggcgagcccgccatcggagggcacatccagtggatcgtccgatgactcgggcagcccgatcaaccacagcgggatgccgtacaaccactccgggcagcagcagcaacaccagcagcaccagcacatgccccctgcttacgcatccggtggctggtcgctctcagctcatcatcagaacaggcacgactctgacatgaagatgatgtcgaactaacactctgctcggcctcgaggcgccccatttgtttggttgggctgaagaaggagctgatgatggatggtggatcgtgttcgtacccccctctgctagctaagagatttaggaccatggtgatgaatgatctcagagagatgtgttgttgctgttgtttttccttggagtaagattaatttaggcgctgttgtaacgctgtagctgtcataattaagccgcctctaacgcaagagtttattatgtgttgtactaccggtggatatgccttctgcttgtctgtcttgctgagatcttcacctccttagtaggctagtagtagtctacatacagacttgtatgaatttacctgaatgctttgatttcaattcgagaacttttactaggttgtttctttttcttgttctgatccgctgtgtttgggagatgaatgtttgtgttgctgtgctggtaacactgtttacggtgaaattcatgggctgtttttgtcacggcgataagggatccacgccagggagtatgcctcaacttcaactcaagcataatatgttttcagctgcttcgtcggaatattaccgtgcaatatttgttcggcgtctctaaacgtagttttattgaattatttttcttcttctaaattatttatatccctttttctatactggtcgatatttgttaaatttatttataaaaatatttgatatatatctataatcataatcatatgtagatagataactataattatttcaaaatgggtcactataagaatccgatcgatggtttgtctcgaactgaaacctctcggtcacaaacatcagacctactcccttcgtccaaagaaaatatctatggacaatttcaaactgtcaaattgatttttttatgtgatggctttgaatctacatacagatttaaattcagaagttttttttttctggtgctgtgagaatattagagccccttggttgccctaataagtcgaagccaaagccagagccaaaatttgaatttttaaatttaattttaaagttaatttgaagatatttccaatatagtttatttttaaaattaattttaaaatcgctaagaacacatatatgaatgttttatctatgcattgatttttttaaaaaaataaatcgtttagcttgttatgaatacgagcaaccgatgagtaacttaagctttatcttcttatcttggcccatctcttttatccaggctgagtttggcccggatgagaagatacacacaaagttatttggttggttgtattggtttagcatgactagtatgggatgttgtttggttgcttgcataaaagatatggtttgaaagaaattttgtttggttggatgtatggattgggtgcagatacctctttatttagttgggtgaggttacctcttcaatgttatatgaaaaaaaaattacctctcaaatgttatatgaaatattctgagtaaattgtactacctctatcctctaatataagggatattcactattttcatataacgtttgaccactcgtcttattcgaagaatttatgcaaatataaaaaacgaaaaattatgcttaaaatactttggataataaagtaagtcacaaataaataatgattttaatttttttcgagtggtcaaacagtgcaaacaaaatatcaaaatctcttatattaggggacggatggattactttgcatcatgttgcctccaaattaatttcacttatctagatgtaaacaattgatcaggacgattagggttcaaaatcgtgaaaagaaaattattttgacccaatatgaccgatgtatggtaactaacctgaaccccacgagtatatatccagtccaaactccaaacgcacttgacttcctcctcgtcatcgctgattgcattcgctccgagatggccacgccgcctcccaccgactccgaccaggttcgtccgctgcttcctcctccttcgccgttcactcccgcgttcgattcctgcttcttttgcgctccgcctcgttgggctcacggatccaagcccaatcaaccatcccgcgaattagctgctgctttccctcattcgattcgctcatactcagattgattgatccagttaggttgttttaacatgctcgattgcgtctgtagcagcaatttgatcgattccgctaggtttgcttctcccctctaatttgattgctgatgcgactgtgtacaactgtaatagacaatcgcccatgggtggctttttcttaatcaccaccatgaatgttttattagtccttaatcaccgtggcgattataggcgcatacatggtcatatttcattcattgctaatttctatactcttgtcgtagttcacaggcaattcagaaattcgactagtttactgcaaacagattatgctaattacttgttacatctgggtaggtcagttttatctcggggttcaacttcaaaccattctgccgtagaatttctacagataaaaaataatagcactgtcttgtgtttgacgaccaggattgtttccgtatcctctgttcgtctcaactggcctcaacaacacaactattttaaggaatatataagcagcatggagagtttaaactccattctaatttggttcggttttgtctgttgtgcgtgtaattaggcatttaaatttcctatttcatgttcgttgccaaacggccaaatggctacactctggtattcgatgtaacaattttatcatatcgggaactgttgttatgatctgtatcttcttcgtgtgctgtctactacaagtcttctctgtacaatgtcatactttttatgattggttctacctgctactgagaataccttctgctatttctctgtttgccaggttttggtagaggcaaatggtgtaacacggacattgcttatgaataggccaaagcagttgaatgccctctcctctgcaatggtatgacttctaaagaaaaaaagtgacaatgagtcaataagtaatggagcatatatggtattcgtggctacatatagggtgcaggaacactgatacgagaaatttatttttgctttcattttctagataacaggatttttgaggtgcttcactgcttatgaggaagatgaaggagttaaactattgattgtgaaggtaatgatcgtgtttgagtcctacaataatgaaatatctgatgtggtccatatttaaacaatgtattttgaggtttatctttgattaaaaaaaagaataacgaggtactagctaacatcaaacatgaattacccgattaaatttccaaaatcgagcattcaaagtttcatccgcttattgaagtttgaatcatgtacaaccaagttgtagtaacgtaaaacaccaatgctgtccatgctttttgttgcatgctaactgtccttttgccatttgtaaatgtaattgattttctgttgctgatatatgagtcttgacttattgggataattccaactttactacctcctgctgttacctttactgctgctgtttgtgctcagcttgatttctataactccctaccattcttgtcatcacttgttttttcctttgtcaggggaaaggaagagcattttgtgctggtggagatgttgctgcagttgtccggtctataaataatggtaaataaaacatatcatgcatccatgagaccctgatgtcaaatatcttgagcttccatgctgtttttctttaacttccattgcctttccatttgctatatgctaattcactgttaacatgcaatatatagagaattttgttcttgacatttgattagttctactatgcatttcttatatcagatagctggaaatatagtgctcattttttccgaaatgaatttctgttgaactatatcattgcaacatataacaaacctcaggtgagctatcgctattgctttgaaactgcttgtccacataattgttattgtcattattgctcaatgcttaccactgaatgctacaacactcttatctaggtttcacttctcactggaattgtcatgggtggaggtgccggtgtttctatacatggaaggttccgagttgtcacagagagcacggtatatattacggaacaaactctatatgaagcttccatttttacttaaatattttcaaaaaggatgtagcaggggtgcagaaaaaagcttgcttgattcttttcatgggataaacagcttaccagcatatgcctagagtttgactctgtatttttactactatctatgcaggtttttgctatgccagaaacagcattgggtctctttccagatattggggcctcatattttctatctcgacttcctgggttctatgtggtgaactattttcctatctcatatctcctttattcaactgaactttcacacatgatcatatgaattctctttgcaatgtctaaaactgattattaatactgaaagccccatgtgctatgcatccttgagtgcttatcatattattacatgactttaaaatgtgtgggtgtggaaatatatgtggccactctgtttctcccatcatcttaataaattttgaccaaacctccatcatgacctggtaaaaagaaagaaatgtatgtggccagattttttattgcctgtccactaggattcatctgttgaattttgatataattgtaaattagttataattttacaccatataagttataggttgatgggagactatctttggagatcgttttcactgatttgttgttatgtctttctcaggagagtatgttggtcttactggtgtaaggttggatgctcctgaaatgctttcttgtggcctggcctcattttgtaccttcagatgaaaaaaaaaacccaaagtcagctaagagtaaaacttgttttgtgaagaaaatagttaagagtaagatgaaaattgtatagagttttgtaaacataacgtttttttttatttttgaaagtattactaaataggaatttctcccttggccaactagaaaaggggtggggcgccttttttgtcttttcctacagtcgtatggctctgataccagctctgtggacccccgtttttataacaggaatcaatcgtgtgaacagtaccatttccctggatcaagtagtctggtacacacgagttcatagctgaaataccaaatgcacatacacgaaagtctagtgcggattattacatcataagcccgcaggcatagtcttagatcatcagaccgagcggtccggaatacattccaaaagcagagtagataaggcagcggagtttaggcagcggcacgccattgccacaggcaacgaccgtaactaagacctattgggcgccatcgtcttcatcaccctcctggtagtacgcgtagggatcctccgaagcttcgtctccggcctctgattaagtttatatattgcaagagtgagtaccaaccgtactcagcaagccatcacagcaacaatgcacatgataggggtattcaaaggatggccatggttctttgcgcaaagccagttttgtaattcttttcacaagcctaagacccagcattgactgatcaaattttagtaccagtgttcacagttaaacaacgacggttctgtctaccatccattgtgatcccaaggatagcttcccgccattgagtcgtcatggttttctgaggacgtccaccttccagcctctcaggaagtggctccaacagcataaaaatcatcatgcaatatcccatcccacacaagtcaagaattttgagtctagccgagtgtaagacacgtcccggtgctcaataaccgcgagcacggctattagaatagatttggtttactcacactgcagtggatgtacactttacccgcactccgtgactgcccaacacatgagcctcgtcccaacacataagacgcgtcacgacaaaggttttcgataaccccgcattggcagtacccgctccatgaacttaaatcctcatgcactctaggcgtccatgtttctagcagtgagaggagttctggcgctcccgggaaagagaagtctcacacacatattaaattatggttcaagttaaattctctctctcatacactcatggcagtcctaccaatggcgacaccgatgtagggcacgcctctcggccctacctcaacgcctgtcccaccgtagcgcacctgcctcactcaggggtgaaccatctatgcagggatattgcctccgctcggctatctaatccgctaggtctatacccatacgagaagtacggttgtacgggggtcgtttcatgcttaacttcatggctcagtccttaattgaccggggacggtactagccttttccagataccacccaaatcctccgtccgccccagtcgaaaacaattgtttaattttgtttctcctttcacaaatcatgtcatcaacatcatggcaatgtggcgctcatgtctccacatgccgcatctcaattacctgcccaagcatatagcatttgataaatatgagtatgcatgattctagaatagcatttttaagcaattgtcatacttgactagggactcatacgtaatcatggttacaaggattttaagggtaaacaataatcaaggcatggcataataacaagtaggatgtttatcattgcatgcaattttatttgtaaacaaaacaatttcgcaattgggatcaatatgttcaaggaatagtgatgacttgccttgctcgtagtcctgcgggtcttgaccctcgttcggatccgcaactccctcgggttctaaaattacgtgcgaggaaatgatttgaattcaattagaattcaattaaaatctaaataactcaaaaggtcgaatgtgaatcgatctttttatattgactacaaagtttgcgaaaccactttattcgaattgttggatcttttaacctaagtcattttgtgatttagaagtacattcctaagaattcaacataattatttagctcttaataaatctaaactcctaccgcgaattgattacttatagagattaccaaaaataatctataattatattaaattttgcaattctacgactataattaatctataattaaactctaattattttaaattttctaaacctccttattctctctctaattttctatttatttttccttttcttttcctcccttctttctttctcttttccctccctttcttctttatcttttttctcttttttttctttctttttcctctcttcttttctctctctccctcccggcttctttctccccgggcggcgacggcggcggaacgagggaaggggcggcggcttaccgacggcggtggcggcgacggcggcgcaaggcgaggcgacgcctggcgcggcacacggtgcggcgcggcggcaccgagggcagcggcgcggcggcaataaggcggcggcgcggcggcacgaggaccacgctgcggtggagaggaaaaaggggaggaatagggaaatggagtggggaataatggagaggggtgaaggtatttatagggaagatgggaaagaaagagagagaaggaagggggtgatgcgaccgcggcgcctggcgcgaggcggcgaggagatgggcgcgcggcgactagacgggcgacgcgacggcagggcggtgcctcgaggcggcaaggagacgggcgcgcagcgacgggacgggcgacgcgaccgcggggcggggctcgaggcgacggcggcacgcgcggcgcggcagcgggatggcgacggcgacggcgcagcggcggcggcgcgcggctcggagcgacgacgggacgcgacggcgacggtgcgcggtggcatggggcgcgaggcgacgcgacgggcggcagcggcgcggggcgcgaggcgatgggacggtggcgcggcgacgggatggcgacggtgacggcgcggcagcggcggtgacggcgcgcggcagcgacggaagcgacggcgacggcggcgcggggctcggggcggccgggcgcgcgcaacagagatgggttagggctagggactgtaattgaacccctggcggcagatgaatagtgacttttcctattttatccccattttagcttatttcttatataaatttgattctatgaatcctaaattttgcataaatgaagtttactccatatttgtattattccacccaatggatccactctagattaattttactcatattttatttttatatcatttacttgattttaattagagttaatccttattccatcgcgtttaaatctaattgatacgaatatggccgagataatattttatttatttctatcttcacataatctttatttttagattataatttaattatttctttaacccatctagttttagggtttattcctaattaattcttctttattcgcgatctatgaactccgaaatcaaaatccaataaaatcatcgaacaaaatcggcatgatgcaatttattcaaaaagtttttgaagacccatatttttggagttttgatttttgttggtcaaattttcagggtgttacacttggcttgttccaagtatgattataggtaaccagagtattgctggttttctaattcctagtatgctcactcttgcagaggctggctttgttagaagaatcacttaaaaaggttgatacatctgatccctttgctatatgtggaattatcgatcaatattcgcaacaaccatctctgaaagaaaaaagtgctctgaataggtaagcgtgcaattgtccagacattatctattcatgcatgtcgagcttattctgcttcctttgtgtaccctgtaaaaatgaggtatccttgacaggtgggatattctggttcacaccaagttatcctgtcgtataaattcttttggcatgttaaacttagattgattaatctacaatttttaagttactaatagctgcataaagttccatagttataacatccatataaagttcatgcaggaaactctcctcaatttggggcgtgtttgacctatttatcttctccaaacaactttcttttgggtcctctctaccacaagccctagatagatagactagtccttttgaaataatattagcttgtaatggagggcaggtggagaaatgtaaggaattggaatggggaaatgtagggaagcaacagcatgcacttcccacatcttgtgtctcctttcaatagatggatgggcttcaacttataaaaaagcttggtaacggttgtctggcctggctttaaataagccgttccctatgccctaacctgttacttgtgtgttttctatattctcctcatctttatggtcagtggcttccctatgccacaatctcgttacctttagatcatttgaactcattttatgtattgcttttcttaatctggtttgaaggccaagaaggcttatctttatgcattgtaacttggaaggacttattttagtttgtcaaggagattccatttgttcctattttattgcaaggttttgttttctcatttcattctcagatcaacttttattgcctaatccatgtctgctacttccatcattttgattccaggctggaaatcatcaacaaatgcttttccaaaagaacagtagaagaaatcatagcctctcttgtgagttatgctaagtctttgctttctatagactcaccagttctgttgtgctaaatttgatgtgtatcatgttaggaacaagaggctccaaatgttgctgatgaatgggttgcttctgcaatccagtccctgaggaaggcttctcctactagtctgaaaatatccctgagatcggtatcctctcaaacatttccaaagcatatgtctttatgttactcgagtcattctatcttggtgccttcttatgcaaattattgtagtgtaaggcattactatttatttagacccatcaatcctttatatggtttcatatgaccagtatttatctttctcaagtgcatacttcatatggctttatgaactgaaccctactcctttgtgttggcacaacagatctgccctatagctaaaaaaaacaaaccttctaggcttagagcttttgcatagtcaaattgcaagtatgggcataccagttctaaaagctttggaaatgtctttggaactagtcgtcggagggaaaacaaggattgttcactccacagaagagtacgtgtactagaaaaggcagccacttaaaaacgccaactactttttttaagccttatttagtttggttgcctacgcttgatctctggcgtgctatggcaacaccccctgcttgcttctttctgctcgacatggagcttgcagcctccccacccttgcttacaacctattcttaatagaaccgatctgattttcactacaagaggaatttcgtgcttctgccggatcctccctatctcctgatcgagcttgtgtatgtaaatattgcttagtagggcccatagtagtacactgtttgggacagagtcagtgcccttctcacatccctacgagtcgtccagcagaaactgtttgtttagttgtatgtacaactagcagaacaaagcagttagatggttcactttgtataaccactacaattttgacataaattagtgttatggttaatttctagccttttaaaatcttgtgacctatcctttgggagttccgatctttttcgccaggccgacggcgaaggaagccccaaccaattttattaagatcaagaggagtaacgtactatttacaacaaacatggctgtttagggattaccctaacacaggaacacaagtactgtttacaacaaacatggttgtttagggatcaccctaacacaggaacacaatttaaaagctcagggcaggccctgagtcagggagagacacagaactggttgctggcacaacagggcagccctctatcagcgccaaggcacatcacacgcttcagtgatcaacattcctcccaaacctgcatcacgctaagtccattcttctatgatgcagccgacttacctcagaggctgatttgctgacaccgtcaaacacccgagcgttctgttctttccacatcatccaagagattagagttaccactatgtcaaatgggagttccaatctcaccatgagcttcgaggtgtcaaacctccagctatcactacctactaaagtggagcttagtctctaggaaaagtttgttttgcccctaacattcagtaggaaaggtctttgttttactgcagtatacgtagtttgtgagacgctagccatctgtgcccatttatgttcttagctttctttgggggttttaaaattattattaaaccccctttttggatttgggttcaataagagaagggtaacacaaactgttggtgaatgcttacgtcgagaatataggatggtttgccatgtgatgcgtggtgacttcagtagagacttctttgaggtaaatatctatctacatctcccaatgacatgttcactcaagatgaacatactttgaactattcaattcctgttgcaaggatgcagggctatattgttggataaagatcgaaacccaaaggtcagcttgttaatcttgtttgtcagaaaattcgttctccacatgttgtctaatctggcatgggcatagcattaaatctaatcctgacatctttgctaattgcagtggatgcctccaaggttggaagaggtgcacgacgaggtggtggaaaaatatttttccaaagtcgatgatccagagtgggaagatttggacctacctcctagacgttcccatggaaggaggcttgttccnnnnnnnnnnnnnnnnnnnnnnnnnnnnnnnnnnnnnnnnnnnn

SEQ ID NO: 36511 - DNA, 1660 bp, Oryza sativa
caaaacgacgacaggaggtgacgccggcgagaggaggaaaaagaagaaaggaagagggaaagggggcttgcctccttgccgctttgggaaaaggaggaggaagcgggggggtgacgcggcagagggaggaggagctctgcctcctcttcttggaagctagcgcgtggaggggcggggccgagtcgatgacgacggcgatgacggtggggcggtttggagcggggcgacgacacgggcggcaggcgcgggcaggcgcggcagaggctaacggcggcggcgaccaggcggtcggccaccacggcacgcgcacgcggaaagcaacgggcggcgctgcggtttgagcggcgcggctcgggcacgagtgctgacccgcggggccgagcggctgcgcggctacaggcgcggcatggcagcggggccgggcggcgcagacggcacatgcgcggcacgggcggcgaccacgcggggagctcgctagggatggaggcggggagagggagagcgagggggggagggcgctcgacgcggcttacgcgcacgcgcgcgtggcgcgagggcagagcgagggagacagggagagagagagagagagagagagccggggagggaggggaagatgggccgagagagattcggcccatcgaacccgagggaggcaaaatagacttttgcggaggaattgatttgggaaggatttggattcgggattgaactcgacgatagatcggggatttgagatctgagaaggcacggacactagacaacaagcaaagaaacagatttcgcaaataggatttttaagagataatttttcccgctaggcgccacgacggaacgggcgctacagaccaacccccctaacaagaatctcgaccccgagattcagcacctaagggagcagctccgggaactcggcgcggagaagatcttcttgctcccaggttgcctcatcttcagaatggttgctccattggactttgtagaacttgatggtcttccttcgagtctgacgttctgcctcttcaagaaccttgatcggtctttccttgtaggtcagattcttttccagctcgatattacccagggggacttgctcttctggaactcgaagacatttctttaactgggatacgtggaacacgttgtgcacatctgcgagaccttcaggtaactcaagatgataagccacttcgccacgtctggcggttatgaggtaggggccgatgtagcggggtgctaacttgccggacatcccaaacctccttataccacggagaggcgatacccgcaggtacacatgatctcctttttcgaactcaaggtcacgcctccgattgtcaacgtaattcttctgacggttctgcgctgcctttaaacgttctcggatcagcttaacttgttcttctgctgccttgagtatgtcaggaccgaataccagcgcttcgcccacctcattccagcacaagggagtgcggcactttcttccgaacatttcctcattcgatgacatctgaatgctggcctgataactgttgttgtatgagaactccgcatacggcaaacaacgatcccaagtgccttcgaaatccagggcacacgcacgtagcatgtcttctaggatttggtttaccctttctgtctgaccatcggtctgcggatg

SEQ ID NO: 36512 - DNA, 19717 bp, Oryza sativa
gtgaagtgagtgcctcggtctgacacaatcttcttgggacagccaaatctacacacgacatgggtcatgtagagttctgctagtttctttccatcaaaggtggttttcattggcacgaaatgagctgatttcgtgagtcggtccacgattacccagatggagtcgtacccgctaggggttcttggcaaaccggtgatgaaatccattccgatctcttcccatttccactcggggatcggtaggggttgcagcagaccagctggcctctgatgttctgccttgactctttggcaaatgtcacacaaggctacgtattctgcgacatctcgcttcattccagcccaccaaaagtatgccttgatgtcttggtacatcttcgtacttcctggatgaatggagtaggcggactcatgagcttcctttaggatgagatctcttaactccttcttggccggtacacagatgcgtggaccataccaaactgtgccttgatcgtctatggagaaatcggtgtctttcttctcctgtattctttttattaactcttttatcccttcgtcgtctttctgagctttccggatttgcgattctagggtaggctgtactgtcaagctggcagcgacacctgactgtactacggtcagccttaacttttccagatctctgcacaggcgatcttggtcgggccgtatttgatctacattacaataggtcttgcgacttagcgcatcagcgaccacattagccttaccggggtggtaatggattccaagatcgtaatccttgattagttccaaccatcttctctgcctcatatttaactcggtctgtgtgaagatatacttaagacttttgtgatcggtgtatacttcacatctgttcccgattaaatagtgcctccagatcttaagagcatgaaccacggctgccaactcgagatcatgggtgggatagttgacttcatgaggcctgagctgcctggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgtagaccattgaaatttcttttctttctttaacagctcggtcataggtctggctagcttagagaatccttcaatgaatcttcgataatatccagctaagccaaggaagctgcgaatctctgacacattcttgggcgggttccaagcaagtacagcctcaaccttgctgggatctacttcgacaccgttgggggagatcacgtgtccaagaaatgctactcggtctaaccagaattcgtatttcgagaatttagcgaatagttgatgatccctgagcttttccattatcagcctcaggtgttcagcatgttcttcctcattcttggagtatatcaggatgtcattgatgaacaccacgacaaactggtccaggtattccatgaagattttgttcattaagttcatgaagaatgctggagcattggtgagtccgaaggacatcactgtgaactcatatagaccataacgcgttgagaaagcggtcttcgggatatcttctgatctgattttcaattggtggtaacctgatctcaagtcaatttttgagaaaactcttgctcctttaagttgatcgaacaaatcgtcaatccgtggcaacgggtacttgttctttatagttacttcattcagggctctatagtcgattaccattctctcagagccatcctttttcttaaccaggagcactggggctccccaaggggatgagctaggtcgcacataacctttactctccaattcttcgatttgtcttttaacttctgctaactcattagctgccattcggtagggtctttttgcaattggtgcggtgcctggtgccagttctatggcgaactcaatctctcggtctggtggcatactcgttaattcttctggaaatacgttgggatattcacagactatgggcaccgactccaaggaggtgacttgtaaacaggttaggatagaccgactcgcggtaggggtgttagaggtaaagcggacttgctttcctccaggtccttgcaaggtgatggacttttcggcacaatctatctgccctttgtgcttagccaaccaatccatccctaggatgatgtccaagctttgcgagtctaggactatcggtttggctaggaagtcaacttcctcaattctaaggttaacttccgggcatatttgagttgcccttatattcctcccagggaaatgtactatcattggtacacgtaaattttgggttttccaaccatttcttttcacaaaagcttgtgatatgaaagaatgggaagctcctgaatcaaacagaactattgcgggtacggagttgacagagaacatacccatcacaacgtctggagcatcctgagcggtctcagcttgaatgtggttcacccggcctcgaccaaagttgttggaaacacgagaaccttgtccacttgcctgagagctaggacgagactgagctgccgctggagtaggagttctggcagtgctgccattagcatgccctgagttggtgttggtaggattctgagggcactgtcgggcatagtggcccatctggttgcaccggaaacactgaactgctgacggtcctagcgatgacttgaaagaggtaacattgtttggcgcagtattgccactaggggcacgctgctgtggctgaggtgcctgacggttcatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgatccctttcaagaacttcctgatcttctacttgtctgtgtccacttcctcaggggcgtaccgagccaacttgttgaacagacttaggtactcattgacactattattgccttgcttaagtttgttgaattcctctttcttcatatcaatggcgctttcaggcacatgagctgcacggaaagccgtagcaaactcagcccaagcaatgttagtgggttcagggtgtgcattgcagtaattctcccaccaatctgcagcaggtcctcttagctggtgagaggcgtagagcgtcttctcaacaggagtacactgcactaagttgagttttctatcaacatctttcagccaatcgtcagcctcgacgggctcgacggtctgagagaactctggcggacgagacctcagaaagtctgtcagcttggatctattgttgcccatgtgagggtggccatttccatgcgcactatgctgaaaaccggctatggctgcggctaatccttgcaagatttgtgtctgaactgccattaagtgctgcatgttgttttccacatgaggtggggaagggaggcgttcttctccagaattgtgactagcagtgcggtgagagcggtgagactgttccatctctgcattacgggaagctgtgtgatgcgagcggttgctgcggcggggttgctcaacttctgcgttgcgggaagcagtacggtgcgaacggttgctgtggtgagaccgctcattagctgactcatgattttcttctggctcaactctaccttcttcaaaaccgaagcgggctggcgcacgagcagcacggcgggggcggctagccatctaaactcccagaagagggcggggtaagaatcagataagcacttaggagggcaaggagcaaagtaaatagcaactcagatagcacacactaggcataagctggatttttcaatcataaaaacacctaatacaacgggtgtggacaagtcacagagctacgccgagcttgactgtacgcacaccacctaggagaaccagactaccaaacaacacccacaacaaacacacgcacgcactacctcgccacgactccaaaagagttggcggcgaaacaaaagggcctaacacacggacggctgctgaagactgcctcctctactcctcgtccgtctggctgcctcctgtagtcggctcctcagtcgaagaaacgtcaatcggctgacgcgaagggaccggcggaacctgtcgagggccgatagcagcacgggccgctggcggtgggggagctgggtagtcgaatcggaacacggtggaagaaccaacaacacgcttccgcgcagtgcggataaagtgtgggccacggtgggaggaagcaactggggtgtgtccgggggtgtaggaggggctaactgggtgtgggtagggggagtacactggtgagtacggcgcacgtgagctgggggagcgcgggccactaggagtgcgagcagagccgcgggagctgtgggaggacaggtggctggcgtggcagaggcggcctgagtcccaagagacagtgtcaactgaggtgacaccctcctcggccagacgggcctccagagcggcgtagcggcgggcaagggagcggtaagtctcaaggagtaggtagtgctgagtggcctgagcctccgaaagctcaaccatgcgagtcagcactggctaagactcgctgtacggacaagggtacctggcgtctgcatggccagaaggaaggcgtggaagctgccggaaggcagagcccccgagacggtggctgtagtcgtgggccaagcgacgaagcgcagtccaggagaggtcctggtacgcgatctggagagtgggcctggccacagtaaagtggtgtgggcgaaggccggctccgtgtatacctccacgagggtaaaggtacacagagagctcacagcgagggggaacacggtccacggagtaccccgtgtactcgggacacgagaagccaaggaagcgggcgaggtcacgaagctgagcgacgtggtgaccctcaccaaaaccgtgggaactgaagctggcgttcactgccatctacaattttgaaagagggagaaaagatcagtaaccattttagaaacaaactattaaaaataaggaaaccaaaagaagccttagcttttcgcaagtagttttgaacttagtatccttagggtcgtcctaaacgtcgggtttcgccctagggccaagcctgtgctctgataccatcccttgtcacgccccgaactagtcccgaccggaactagcccgtgacgctccaaattaacctgttaatcgataccagtcccaggaaacagtgctggtatcacaggaagacagaatatcacagcaacagaggtctctttaatatagagaaggagtacagtcatgttgggctgcggacagatcccgagctcacaactgcattacaaaagggaagcggaagccaagacttggaccaaacaacacagacgcgacttgggaactaggccgaaaccctaaaactcaacgtagccggcttgctcctggaagaactcctcgtcagcgggatccgcttcatcttcttcagcaactggggggtagttatttatatagagcaagggtgagtacgggagtactcagcaagccatgggaaataagtgtttaatgcaggcttcaaggaaaggctgttgtttttgcaattgattttatttgaactcttttctgaaaacaactaagtgagtgcttctcaaacgacacggatgagacagtgcgtctcgtccggtcggagtatgtgcaaatatatcattctttagaattgatcaagattggcacccggccaacaactttcaaacagccacccgggcctagctgatcccatcagctgcagattttccaaacatcgatcccctttccacaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcacctagcccgtggggatcagccacgtcgggagacctccaagctttcatgataaggcatttccaaagccgacacaggtttaccatatgccgacgagaggggtcccagaccaacaacaggttaggtcccagaccatactgtgccaggaagcccaggggtcctccccgacaccaccccgatgaattcacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaattcatttagttcgcaagcaccgacccaggtgtcgggttttccaagtcttttataaaacccaagttttacccaagatgtttttcagattttaagtttgaaggcggccgtcgatactcgtgcagagtgcatgatttccgaggcgcaactgggtggttacaagggaacatggtataacaattaacaaaggaaggatcaaatgcaacaaattaggtaggtccgtcaatctgccttgcagacgggacaagcagattaagtgcgatcctatcaatgcataataatctttcaagcaacataattaagttgaaatataggctcaagatattcaaaggtggcttgccttgctcgagatctagagcttgatcctcgaaatcctcgcactgcgggtcttcgggctccgaaactatacgcaaaacgggacaactcaacaaacggcgaaaataaagccctattaatgacctctaagcgtgccattaaatagatctcgagatttgaggaattttggaagttgaatggagtcaaatggacttacggttgggaagatattgaatttctaagattattggatttttggtctaaaggaaaaggatttacttaaatcctttttttgaaaaagaaaagaaaagaaaaggagggggaaaattagacttccctcgggaggctagggcgcggcccgagagaaaaggggcggctcggccgagctaaatgggtcggtcggcccaacaaggcggcccagagcgcgcgcgcgggcggggaggagagagggagccggtggaccgggctcacctcgcgtggtcctgagtgggacccgcttgtcggtgacacggttcaccgtgcggaacgcgcacgcggcgcgcgctagggtttgggggagggacgcggtgcacgcgcgcggttcgcggaggacgcggatgcggcgggcccacgcgcagcctcacggctcgcggtggaccgcgcccgcgagcggggccgaggggagcggctgaccggggtcggctcgacccggtcttggccgagctggcgccgacgtggcgcctacgtggctgccacgcaggccggcgggaggtagacgacgacgccggccggaacggacggcggacgacagcggcgagcggcgagcggcggagcgaaccgcggcgatacaggcgaaaacgagcacaccgggtggttgcacgggacgaggggagtcgagccaacggctcggattcgccggagggagctcgacggcggcggattgcggcggcggcaaccggcggagagaaaaggggaaaacggcgacgaggtcacgaggggccgattcccggcggcgagagcatctacgcggctacgggaatccgtcccttgcgccggattaggaggaaacgcatcgagggaggccggcgacgagaggcgcttccgagctcgggcggcgacggcggcgagcacacggcgagcggcggcaacggtcggggcggcgccggctagctacggggaggctactcgtgctactacccgagtctaaggggaggaggtggaacgaggaggaagaacggagggaggcactaccgtgcgggcgggcgcagtgacgagagccgacggcgcgaaacgtgatcgtttcggcctcgggccgaggaagaggagggggagggcgcgcccggagtccccttccgcgtccttgctcgtgccggctcctccgacacacgcaacgactaacggcgacggcgaatagagcacgggaggcggcgacaatggcgtggcggcgagagacgaaaacgagggagattggaggagggaggtgcttgggtttataggggcgacaatgtcggtttaggagaggggaaccgacattggacggtcaagccggcgagctagcgcccggctagcggccaaaacgacgacaggaggtgacgccggcgagaggaggaaaaagaagaaaggaagagggaaagggggcttgcctccttgccgctttgggaaaaggaggagggagcggggggctgacgcggcagagggaggaggagctctgcctcctctccttggaagctagcgcgtggaggggcggggccgagtcgatgacaacggcgatgacggtggggcggtttggagcggggcgacgacatgggcggcaggcacgggcaggcgcggcagaggctgacggcggcggcgaccaggcggtcggccaccaccgcacgcgcgcgcggaaagcaacgggcggcgcggcggtttgagcggcacggctcgggcacgcgtgctgactcgcggggccgagcggctgcgcggctacaggcgcggcagggcatcggggccgggcggcgcatacggcgcaggcgcggcacgggcggcgaccacgcgggcgcgcgcacgcgagcaacggcacgcgggggccgattttggggcagggagctcgctagggatggaggcggggagagggagagcgaggggggagggcgctcggcgcggcttacgcgcacgcgcgcgtggcgcgcgggcagagcgagggagagagggagagagagagagagagagagagagccggggagggaggggaagatgggccgagagagattcggcccatcgaacccgagggaggaaaaatagacttttgcggaggaattgatttgggaaggatttggattcgggattgaactcgacgatagatcggggatttgagatctgagaaggcactgacactagacaacaagcaaagaaacagatttcgcaaataggatttttaagagataatttttcccgataggcgccacgacggaacgtgcgctacacttagctcaactagtatacaatgggggaaatcacattaatgcatagacttcaggttctagtgttgttgttggttcaatgccaccgctctggtgatgattaattaaaatatattaaatggtgggctgtgggtgcatggtttggatggtcgcgcccatggcatttaaggaccggttcgcgggaaacccgtacttaccacaagctagcgtgggcaacggctgggcttgtagtgtagctttcctctagctgacgcatccaggcaagggtgagcgtgatggagttcggatgggccctgcgacggcctatgcgacttttggattcacctaggcacgagaggggactgcccactgccttgcgatgagtgggggtaaaacctgaggtgtggtatgtttggttagaggtggttatgcgaagggtcctgacacggcctctttccggtatgtcgtggtggcatatcggcacacgggaacgtgttgtggggctgtgtcttgtgggtacaattgtacacctctgatcagagtaaaactattcgaatagctgtgcccgcggttatgggcgatcgaccagattcaccgtgattagtctcaccctagtttagtctaatggaattgattagttcagatggatgtttgggcctgttgcaacgtggtgtagcattggacagtggatagttaatattgattaattactataaccgttttactgctttcaactactgtttataaatgccagcttgatgcaaaggatcccctttagccttcctttggttatattgcatcataccctccgttccggtatgacttgctgagtacagtgggaagtactcagtcttgctctatctcccaatcctcagagttcgagtatgcgtccgatggtggtttctccgaggagtaggcttcgtccgtgccatcaaggatgcctgtggagtggtgttcccgctgcaatccaagtcaagacttagctccagttatcttttatatttccgctgcatttatataagacttttataatgtttgtaagacgtggatctgtatgtcaactttgtcgtttgtgtaccctggccggtcctggacatggattttaatgcacattctgcttggaattctattcgggaatttctgggcgtgacacccttgatggctacaaggtaacatttacttgtcgctgtgctttgagaagtgcaagagcacaactccactataggaagtacaaatgttgtttatatatcttggttttctcttttctagtgcatagttgtatacaaattaagggcaaaagagacattttctaaccgaattattgactataaatagccatatggcatattaagtgggcccaaggataattttaagcaaaaacaaattcttagaggacctatatggacaaaatgaaacttgaaggattaaattgagctttcgatgaaacttaaaggactaaattagctatttactctaaacttatacttatcagctaaaatctaaattttcaaccttaaatttaattcaagagctgattttgaggttttatcatcgaagtttatttttcagcctttacttttagatcgcaaagaacacgtatataaaggttttgttcataaattacttttcgtttataaacatgccgtttcgcttacgcgtgctccgtaaatagggtactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccctttgtgggttttgcgccgcgtatatgtggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctaacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacgacaaccatacaagtctccgtctgttgatgaaaagataggataagtccccacaaaaaagagagagatggtgcatgtggtatccccttgaggtataaaaggaggacattgcccacttagaagggggatttttcggatccagaacgatcagagagggagagagtaagagctctctggttctccagctcttttgtagcttcttcatacatagatccaccaaaacacaggagtagggtatgacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctcccggtgaggagcctcacgctccgtcaggtacactagccggttttgacaagtcttagcttagatcaccgcaataatctttaagggatgactccctatgttaaccgatcccgcctcagatccgcgctcgtcaccaccggcacaacattcatatccggccgatatggcgatttaatatatgctactatcttccttccaaaatataaggaatataaggagttatattttgagatggagaaagtactagtgatgatgaggaagatacactagtgcttgaaggcttagttgttttgttctttttcccaactcacctatctcgtttttcacatgcacacttttcaaactaataaaggtatgtttttttttacaaaattttattaattcatttttttaaaaaaataactgtaaattaattaatcatgcgctaactggtagtatgtttcattttgctaaattaattaaaattcccaaccctgcaggagccaaacacagcctaagtaaataaagggattaaaattgaaagcgtatctaacagccacagctactagtggcttggtggattacgagtcacgtcagtaggcgatccccggcgtgtgcgatgcgaggttagcttaattagctggtctgtccatgtcgtgccgtcgcggcgtcgccttcttcgccttggcaacggcatgcatgcctccgatcatccgtaaacctcacggcggccaccataccacacgtgcgtacgtacgtccacaccacgcccaacaccgacgacgtcgatcgagctccaatccatccacccccacccatggccgcgcgcttctcttagctggagtaattaaattaagtcgatctccccagcgcgcccccatgcaccaatggccgctcccacgcgccgcctcctcctcctcaaccacgaacccaccaccacccccgcttcgtcttcttcgagttcgaggcaatccttccccacgctgctccccgtttttatcctcttcgtcctcctcctctgcttcctctccatcttcctcgtccgcgacctcctccacttcctctccctctgcctccgccgccgccgcctcctccttcgccacggggaggatcatgactcctcctccgtctccatgcagtcctcagcctcgccgattaatgcccaggcgccgcgcaagccgccgggcttggaccccgccatcctcgcgtccttccccacgctgcgcttcaaggcctccgccgccgcgccggagtgcgccgtgtgcctctccgacttcgccgccggcgacgccctccgcctgctcaccgtctgccgccacgccttccacacgccctgcattgactcctggctccgcgcccacaccacgtgccccgtctgccgctccgacctcgacgccgcgcccgcgccggcgcctcgccacgaggaccccgccgccgttgccgtcgacgtggaatgcgaccggaggggcggcgccggctgaccggtgaacgaccgccgccgtgctggatgacatgcaggatttcctttaattttgttcgcgccaaaattgattttgatttgttttgttttgtttgtggctgcctgcattaccgtgtaaatactcaacgacttgtatcgtccttgtgcattgtactgtcagtatttccaaattgttggaaatgataatgtagagtattccaggtagaattatgagctagtcaccacagcttcagctagctgtttaattcaattgcaagtctgcaatacctgtcaagaaaataaatcaactgtatcaatgtatcagttggaagcttttgcaatgttatttttagccacagaaatgggcggttgccggttggtaccaacaagggcattctaaagtaaggatgccactaattttagagtaatctctctcggtgcatgatttgatacatgagtctatgagaaaaatgctaaccagaaagaggaaacacaatatatatatatatatatatatacaggcatataacagttttgctactaattgtcgcacacgcataccacacagggcaatatacgggtctgctttacaggatttatggaagcaagtacataaaagcaccatagcacgcctcaggtgctttgattcaaagacacaacgacgctgcttatttaataaacaacagcgtgtgagaaactgcttgcgtatcagcaagggacggtaaattatttatagaacacctcctctattcatgttctttgcttttaaagatctgtagaagcccatgaacctcacagtgaactctgaaataattagagtgtttatagttagtagttggtaagatccgttcattctcataagaaaacatagaagactatttcagttcagaactatactgaattggcaggtgaattattttctagtaccttcaatctttataaagcattggatagtttcgcgttggtcatggccctccttggcaaaaccttctatatttatgtttctgatttccaaacccgtgtcgccggattcgcactgctctttttgacgcgcgcaatctttgatctgattacgccgagaagcaagaaaaagaacaaagaataacggttagtatacagcaattagatcatgaattgaaacaactgttactgaagatgcagtagtcatgctaacatggttcaactccgatgctagttgatcaatgctattttggaactcctcatccctgtcccttttcagttcagcaaccagattctgcatttggaaggagacaaacattggtgacaaatactgaaaacaacgaaccctgtttcagagcatggaaacattaggcaaagtggagcttacagagaaaatgaagtaaggtgacacattatgttcaatcagttttctgatcttacccctaatgacatacagcctgcacaagtcgaagtaacaacatttgtatgttttctttcttgagattaaagacgctcaaatatactgaattatggggaaaaaacacatgaaagggatatcctactgttttgggcttggttcctccaagatttttttggctacattggagatttcctcttcccatcctgtcaaaatggcatggccttctaggaaggcatagctgcagttgtgaggggttatttatcgccttgagaaacccaattatagtgcttcttaacaacagaatgaacacagtaccagcaatctactacggagtaacatattctcaatacgaatgatacatgcaccttgattgagcagttatatgcattttttgtcaaaagagaacataccaattgcaattgtttctttagaaaatgaaggaggaacatttttttttttgggaatacgcgaggggcgcatctttgtattaagaaggaataaaagtatttacagagcgggccgaaaaataaaaaacacgaaggggacaagatacaggagtggggaggaggaagaaaataaaagcctaatctcccaacgaatgtggcgaccttccacccgacataggagtcaccatggccggtatcgcggctctagccaaccgccaaaggtccgcttcgcccgtgaggaacatagtatgttataaagacatttctccagtaacgaaccatctactttaaccacagtcaaaacgttgtaacatcccgatattatatttcaagaagcaggaaaggagaggagaagcaatgtttgatgttcttttatctaaaaacaagggagggatattcttatgtgcttactttgctttccaagtagcttcaaaagaacgtattgcctgtcggagattattgcctgagctcattgttattctcctagcaatatcacgaggcagatctatgctctcttgcactgcaatgtactctaggaccttgattatctaagatcaaagacatttttcagtaaactgtccagcattgcaaatgcgaagataaaatatccatataaaaagtacctcatcagatgaaggtggcttaagtgtcacaaccttgcagagatgcctgacagcctcaaggtttgaagcatcagaacagcagaacatgattttattgcatcctacatacctccccagaaaccatccaatataatgttgaagatcagatgagagtttatcagcgtcgtggacgacgatcactgcatatatatgaattttaaagtattaccttggtgtaatggtttgagatcaataaagcttcatttattataaaaatatatatgtatatgatacactagtacatcaatgtaacacatataaataccagaaaataaatgaagaacatgcagttgtgtcaagaaagatcactgtttcatcattttaacaaggtaaaatagtgtcctcatgtacctctgcagttggcatgactgcaaatggagtttggtgatgggatggattcattcaacaaagtagtaatgacatgcttctcatagccgtgtatgtcagccaaatttacctccacatgatgacttgaaatcttcactctgatatcaatgtgttttgcaatttctccctacagtgcgagaatggtcagtagtgtttcattttacactttcctctgaaggagtagtagagatttgtaatggcgacaatgtgcaaaagaataacaagtcattctcatgcaacgcgtaccttcagctcgaatctctttgtctgttcctctatctgtgaaacggcaatatgaagcaagaacaattgtgagcttaaaggtttagataattaggttggttaaaccttgtgcaaaagtgagtagcatcaaccttgagattatcagtagcaaaagcatcccatatgagtgccgacaccatgctcctctttccgacggaggtcgggccttcaaatatgatatggttgcattcttgtgcggtaacctggggggtaaaccccttatcagaatgtcaagacggtagtagtatcactcaatgtagtgaaatatttgactgtaaatgggtagtaaggagtgtgtgtgatgaccatcacctggttgtagagctcaagggcaacgtccttgttgcagatgaaatcgttgaggaaattggggcgatacttgtctgcccagatgtacttgtcctctgccgtgggtgtggattcttcagaagtctgtggcgaatccaccatggcgaccgatttgggcaaaacccggacccagatgctccctcctctcccgacggcgacggcggaggcgctgtggtcggagctctgcgtgctgtggtcgccggcggacacttgtggctcagaagcagcttcagctttggattcagccggcgtgtggtggtcgtggatgcgtttggcggcggcggcggcggcggcggcggcttcctctctctccctcaaaggcctcctctcggcgacggcggcattggctacctgcggctggggcgcctcccggcgcggcggcggttggtggggcacggagctaggggcggtgcgggggcgggtgaggggggcgccgcttctggggatgcaagcgaagcccaagcggtggagaccgagcacgagctgcgacggcggcaggaaggtacggtagcgtcgggcgtcgcggcggcggtcatggtcgagcgcgtcggagagggtggtggccgggggagccatgtgggcggcgcgcagggtagtggcagtggcagcggcatgggactgggggtggacatgagatgagagcggagatgaaaccaatgcggcgcggcggtgtggacgaggggagcgagaggaaggaggtaggcgtggcgatcaacgcggcagcggccggccaggtggtgaggtggcggtggcggtggcggtggcggtggatggtgaccggagaagcattttttgccgggatcattcccatcctgcctcctctcctggcgccggcaacgcctaccatcgccatctgatctcggcccaagctctccatttccatcctattggcccacttcgttatttgggccgcctctggttgcatattcagagaggatttaggccggccttctttcgctgttacttccactagttatttaattattttttagagaagttattttattttattttatttagaggagtttcttaattttatttttttagaagagccttttaaataaggaacttccctgtaaccttcgcattacttccactattattctactgagttgcttgatagaccgtttggtaaggaataagtttatgtctctcgctcttgattgagtcacatccctcaatcataaaactaggtataatgtcgcctctaatattaaaaaaccagtgtagataaactatttcagaggtttagaaagtgttttttcgctgacgtggcaggttgaccacaattgacttgctgagtcaaaaggagggacccacatgtcattgattgttctctctttgagagggctaatgtcgcaaaggggatccatgactaacgagtagtgacgtgaccggggaggagttccgcgatgggcggcgacgaagatgggtgttgtgactggcagcgaagactgcagcagctcgcgtgaactaggggatgacaacccatagcggaggacgataggcgataaaacagcgagacccgaaggtagaagggcggcagtgcaacaatgacggggtagcacacacatctctcgctccgacgtgaccctctgccgccgccaccagtctctacgaatgccatcctatcaggtagctctattaccctctttctttttcctatggagatggcggtgtcccaccctgtcccagcttgatggcctacctccccctgtggggcctccgatgccgccatcgatgctggaaggaagccacgtggaaggaagtggcatggaggtggagttccaggctcaaggtgagaggacaacagccaccgctaccatgagcaccactatgcgcgtgctccttgaacggacgatgacagtaactcaatctgcccccgacgatgttggccacctcggtgtcgccaagctcctaccaccgcatggggtctctacatgctccacctagcttctctgcttccatcaccctcggggagacgaccccctccccatcggccgcctccacccgtgagctcccctttccactaaaggaatcaatgccgatttttaaagttgtttggagagggtattatacatgtttttttgttgaggaaggctattcaggaagtagcaatatacgagaaagacaaacaagaggttgtgttcgggcacgcatgtattattgcaagattaattaagtattaactatttttttgaaaaatggtttaatatgattttttaaaacaacattcatatagaatattttttaaaaaaaacacaccgtttagcagtttaaaaaacgtgcgcatgaaaaacgagagatgtgagttgagaaaactgggataagaactcagcctaaaccgtttggcaatgaccggaaaatttgaagttgggcgatgattttacaggccgattaaccgagggcagtagttccctcagcagtgtccggccttggacttgtgccgcacgcacacttccatttccatttggaaaaagtacaccgaaggtccctcaacttgtaatcgggataaaaaacatcctcgaagtgcaaaaccagatatacgaggtctcttaactatacaaaaccttaactatacaaaaccagtcactcgaagttcttcgatggttttgaccccggttttagtctacgtggcggctgagtcagcgtagaacctacgggccctacatgtcaggtgtccacctcaccctatctctttccccttttctctttctctgttcatctctctctctagcggatgggagcggcggagcggcaaacttggctagcgcgcggcggtcggcggaagagcgcgcggcggccagtacacggtggtggaagcc

SEQ ID NO: 36513 - DNA, 4763 bp, Oryza sativa
gtagaacttcttggcgaggtggtagaacttgtcctgtcgctgcttccccttcatcttccccattgctgcctcctcctccgccgccgccgccgacaagccgcctcagctgggagggagagagctagggtcggcggccgcgtcgcctcgtgctccaccgccgccgcgtcgcctcgtgctcccgccgcctcaactgggaaggagagagctagggtcggcggccgcgtcaccttgtgctcccgtcgccgccgccgcgtcgcctcgccttgtgctcctgccgccgccgtgtcgccggccgcggccgcgtcgcctcgtgctcccgacgccgccgctgccgccgccgcatcgcctcgcctcgtgctcctgccgccgtcgtgtcgccggccgcggctgcgtcacctcgtgctcccgccgccgggccctggggacctcctccccacgaccccacctgccctggctttgcccgcgactagagaagtgagagagagaaaagggagagaagagggaaaagagagagtggctgacctggacaggctgacaggtggaccccaagcaggtcccacgcggactcagtagctacgtagtacaaacctggagtcgaaaccatctaaggacctcgggtcaccggttttataccgttaagggacctcgcgtatctggttttgtggttcaaggacattttttatcccgataacaagtcgagggaccttcggtgtcctttttcctttccattttggaaatctgatattgatgagagttggacgacctcagcagcaaccaattatctgctacagcatgcaggacctttgacttggactgcctccctactcctactcctactcctactcctactcctagtcaagtcaagggtaagctccaagaaatcttctacttctacttctactcctactgatgaatgtattggccggtatatacatgcttcctcatgtatcacactggtggagaaaccctttgtactcccggttcgtaaccccctttagtcccggctatctttagtccctggtgaaataaccgggactaaagagaggtatctttagtcccggttggtgaaccgggattaaagatcgatctttagtcccggttggtaactgttaccaaccgaaactaaagagagggtagcggcagtcccattaggtctccttttctttttttttattattttttagccagagtttaatccctatattttctcccaaatcgagtgggatgcatattcccaaatcaaaccccaaatcaaagtaacatcccaaaacattcacatcacaaatcttaagttacttgtacacacaaatcaaatacatcacaaatctttaaaaaattacacacaaaccaaatacatcacatattatacatctcagatccatacaacaaatcacaaaattatacatctcagtgaatcacaaattgtaaaaaaaaagaaaaaaaaagaatggatgccggaagcgccgcctgccgccgctccccgtgcgcggcctgcgtgcggccccgccggccgcctaccgcgtgtggccccgccgggcgcggccccgcctgacgcgtgcgagaagggaggagggggaggaggcggccctcgctgggcatcggatgcgaagggaggagggggaggagagggccgggatgggaggcggaaggggaggagaaggagatggatctgaggagaggagaggccggttgttgttgaggagattgaggccgattgtggggaggaggatagggaatatggattatatactacgcgtgattttagttccggtttgtaataccaaccgggagtaaagatctaggatatctttagtcccgtttagtaataccaaccggaactaaagtggtgatctttagtcccggtttgtgacaccaattgggactaaagagaattgacagaggatgaaccggtactaaagatcatctttagtctggttggtgttaccaaccaggactaaagatcgtagaatggctatggggttttaaaccaggactaaaccgggactattatggttttggggcgactgagtaaagatcagttttcgagtagtgtcaggtaagggccggagaatgcatcatgattgatgatgatcgatcggctggcagcgcttatatagtactataagtatactatctcgcaatcaaggatgataccatatctccggctaattaatcaatgaatgagggaaagccatggtatatctatatcataccgaccaaatgatcatatgtgcctgcctgtcctgatttaattatatatgacaacattatcaagctcatgcattcggtcggtagataggttggcatgtactaactactgtagtctgtacaaattttcgcactcgaccgtgcgcttgcttagagtagcaattagcaggaacattacagtacttattaagctcgcttggtgctcctcctcctcctcttccttctagaaacttcttccacgcacacgatatcacgtcaacatcgcacccgcccgctcacgcaccgcatgacgtcaccgacggctttggtggcccacgagcgcgtggggaatacgctgcccacccttccccctccgatcccaatccaacggacatcttctttcgcgggaggattaatgttcatttattgatggattttttttctttctttaaaacaattaattatttattgatgatttgtaaaacgggtcaagaaaagaaggcggcggcggcggcggaggagagagagggccccaccaatacccagtagccgccgagccaggcaacggaggccaatgggagcttaacacgtggcccatctgcgggccacagcaatgacttgatcgactgttatttgctcttgacattccactacactaccagcttcttcttcttgtgccttttggaccttctcttcaaacagcagagcacactagctgaccaaccctacaatatactcgtactaataatagagggtttttctctcctaatttcatcacaactcgtttgctccaggctgagataatcctcatctcaaggaaaatccctttctacaaatacagatacaagtcactgaaacagtgttatagtatggctttatagatgttgagaccaggttttattccatcgtttttttttagaaaaaaagaagactattagatggcttagttctctgaaacatactgtactccagtactgaagaacattgagccccaggacaagcaatagccttccaaatgaatttccatttggaacaatccatgtactgtagcagtctagcagatactacaagaagaggttttggttgcccatcccagaatgctgccaatgcaaagccttcagaaatttccatctctattctccaatccacatatgtgatatgtcttatactttccatccatccatgtatgtatgtcgacatccaccactctccattggaaaggcaaggccctcagctacctccaattgttgctcatcttttccatcacccccctcaactttctcaatgttttcttcagtattccctcaggaaagagagattcttcatgcaaagctatgaacattatttctgattatatgtaatctgtagacagcagagagactactctactgctcctaaagaatgctgcattttctttagatgcctttctaatgctgcatatattttttttgggtagtagatgccttcctttgttcttgcatttagaaccgcttcctctgctttagttaggcgtagtaggttagggtggttgcctaacatacatatgccgtctcctcttcttcatcttctcattcttcttcagtgtcaacttcatcaatgctggcattgaccctgcaaatcagaactatggagtatatatatatcacaactctttagtttaataaattcaaccgggaggataattagatgaaacaagagagcaggagcaggatttgctttgataaggctgaacatcacattcacattcacattgaaagcaaacttttagcgagtttggcaataacgtaacggcacttgctttggcagcatcagaaattctgagtcaagacacatgatactgcaaaaaactatcctctgcaattgcctcgcagctaagggtcaacacactgagaaaaaaacacacatcaaaatccatttctgatccacaagaccacattataattaagaaaaaaaggaagttactggagtaataagcaaggatcattcatgccctcttctagcatccatatttacagatgaactgaacaaagtagcactaatcctggtaccaccagttagtagcagccatcacaaaacttaagcaccaccagctacttattatcatcactgctaatccactaggagtattagctacaagtctgctcaaagacatctaaaatttgaaacatctcaaaatgaaaaaaaaaagactatatagaaggttgaacacaagagagagagggagggggtggtcactaattaaagatgtatacatatcctgtctgtatttttaatgtgttcctagtaatggtaatggagcaattagcaatggaaaagctagtgcttttgtacccttccttttcttcatcttcctcctttcctttgtgcaaagctaatggcatccacctcgagaagcaccaccaaaaggcaacaatggtaatggcaatgggcaaaggccgacgaggtggcggccgctttgcaatgcgattcccaattgcgcacgcgctggattcctgcaggtgaagttgctgttggttggcaatggctaatactcgacgatgaggctgccgaatggcgcgcggtgtggaatgcccttg

SEQ ID NO: 36514 - DNA, 4700 bp, Oryza sativa
gtacgtctgcaccccgccgatgtccatgaacatttggatgtccgacaccctgatcacgtcgtggtacgacgaccgccggatctgcaaccacaacgccgccaccgccatggttaggtaggtttggtttgggagagggagactgcaatgcattgggaacaaggaaatggttagtacctggatggtgtggtggtcgcggtggttgtgggcgaggcagagggagcagagcgcggcggcggcggcgtcggcgtcggcggcgcagtcgaggcagaacatgttgcactcgccgctccggtgcgagtcggcgtgcaccttgcactgcgagaagaagctggccgagagcagcgggttcagccaccgcggccactgctctccgtgcgccaccgcctcctcctcctccggctcaggccctcctcctccctgcaagtttcaataaaccaacgcatccgtcagtttcctttcctaaactacaactcgatattagattggatgaaaagaggcagttttgaccaagataatcccctctcctttgaacgattcatgcacgcaattcacagcgcgtttcttgattcttggaaatcacggagaagcgatttttttttaaaaaaaaacccacggatttggcggcgaaaggaatgcggggattccaacgcacagagggaagcagcaaaagcaagaacccaagaagaagaagcatcctttaatcaatctggcgccattgcccatagaaatcggccgcccaatacaacagtatccgaaacaacaacgaaggggaataaactccagaagcatctcattccttcattcattcatgtagtactacacaagaaacaaggagtaatcgaaaaagaagaagagaacggaatggcgcagcatataaacataccatgatcctcctgttcttgaggcggagctccttgaacggcgactcgtggtcgatggccatcgatcgatcaatcaatcaatcagtcctctcctctccgaatgcaactaggcaaagggtaggaagaagaagaagagagagcggaggcggcggtggatggatggaatggcagaagaagaagcaaaaggaatgaataaaaacagaagaggaggaggaggggtgggtggactcgcggcttttatcgacgagacgagaaggcgaaggcggcttgggctcggtggaaacaagaagaagaagcggatgagtcgtcgtcgtctttgtaggagtcgtccaactccttccttctttcctatccccctcgacacgcccaagtaatttcttttttctttcctttcctttttttgcctttttttttcatcctccttaaataaaccacttgtcagtgacagtaataatatttactagtaaatttatgcgatttgtggctctttcctctatctgagtaatcaatgggcatgggttgttgttgattagcactaatagggttgtttggtagggcacaaaattttaaattttactttaaaagttagatatgaaataaagttgtgaagctatctaaatccagttttaccttatttgtttattttataagagcacttcaatcagtttaattttttttttttgaagctgaagccctttttttatgaagctgaaactatttggttgtgtttcagctctaaaagagatgaagctagagttgaaccaatgccctttctattaggttattactgcttaatttaatttatttttgatgtgaccttaatctcttgtgatggtttgttttggagaacacaaggggaaagtggatgccgaaatggccaaaagcgggatggagggagggcatttgcgcgtgcgtgccgaccagacgagacaccggacgcgctacagtacactacttgtccacgcacgtgttgctctctcgctattccagattgaacaccctattgggtactactagattattagggtggattatcgatttaattattaaaacagattagatattttaactaaataaacactgctcaaaatgagtggtctaaataaaactacaacaggaatattacttaacatatattttttttactaaatcttaacatatttttaacatattttttaagtgtgaaacaaacaatccattttaataattcagtgaataagctgaaaagaacaatgccctggaatcagtttcaataacccagtaaatccgtttcatgaggaacttcagatgaaacttctccttaaaaaaacttaaatgaaaccgccttttctttgtgcagttgtattgctccttgttgctacttggcctcgtctgactgacccgtcatcccgcccaatttttctttgtaaacaaatccatccagcaaaatgatcaatggcttacaagtggcacactaatcaatcaaccatgatgcacctgttctcttcatttccaaccgttgttaatttatctgcttaatcaattatgccacttaatggagtacagcagttcgtcgctttgtttgttactgatgcttggtttgcattgcaattgcggacaggcgcaccagcaccacaaatacaaaaagaattccccagagtatccaaatatccaatccactgctactatttttcctctctttgcctaattgccttgttcgattctttcaacatactatgatcttatattattcttatctgtgaggagccagcagatagatagatagatagatagatggactagtcgttgtactggtgccaattccagtcctaccaccaataatgctgccggtctacaaatgcaaatgcattctacaaactactccaaatgcaaacattatgccattcttttcacacctttttgttcttgttcccctttgaaaaactgcaaagtttttgtttgcactctcctctgtcagtctgtatccaactcaagttcttcttgcactctttgcttgccatggaagaaaacaaagttcaagacagcaaaataatgagagaattttgaaaggtcagtgaaaggaggatttgaatttcgaaaagattctgtggctacccactcaatcaaaggggcatgctttgccggtgcacggggaccgtcggattctccatctgcggccgtgctttcagatgctgctctttcttcacatgccattgattcctcctctctagtatctctcactctctgtctctgtctcctgcttcttcaagtgttgatgattagttaaagcaagcaagcaggcaggcagtggagcccttgaccttaaagagatactcatcatcagatgttaatctaatagtactagtataatctaatctttataatacttatatctagtttagtactactacatgaatgcaatgcagatgcaggagggaacccaggaatgcaggggaggcacatgtgcttgatggattggatggctgctatctgcaacttgcaagaacttcctctcactaatctctctctctttctttcttagtagtacagtacttgtcatctgcaatgcaagccatctaatctactcctaactgcccacttagcctgcactgcatccctgtctgctgctgcttgcaatgctaggttagttggttagtagtttgtgtgtcttgcaaatgtctatgcatgctgcaacttgcacacaccaatgacacatgcattttgatttcaccacaagggaaggggagatcgagagaatgataatgcagcaatttacgtcagagaaaagtgactcctccctccaggtcggcgatgaacttgctgcatctcatggaagctgaaaaggacatgaaatgggcagatgcatgcgtgcactcacaaagctcaaacctttttttatatataacagagggaaaaagcaaagggcaaagacatgtataatttgtagagtagtatgcaatatggcaatggtgctggactgctggtgtcgctgccacttgcaacgagtagctgaaaggaagatacgccattgccatttcccattagccatcgccaacattggatgtgaactagcccccaatttgccacgagtaaaatggtgcctttcttatctctagttggtatcttgtgtggacctgaacctgtttcgcactcgccgttgtccttgtcatgtactactagtcttcagcctgcattctgaagccagataaactgaactagctctcaatgttcagacatatttcagctatttcaccggattatttgcaccacgcctcttaaaatacgtttttctcaaaaaaaaaaaactttcttctacagcattatttgttctaagctagtatttgttaagtttatttctcaaaatgtataatttagagaacttttatcccataatcaagtagataatccggtgaataatgtgtttcaaatgggcccttagattttaaaacaactgaaattctagctcattcagaacagaggataaaaaggttgtatcactcactgctccttcacatgctaggaaatgggtgaactagtctcctcaggtgtaattgcatttcgttttctgaagactagactactgggtccaagtccaaaccggcgaaacatataatacttttcacgtgtgtggtttcacctcagacaaatccaatccaatccacagaaaatggtggattccttgtctccgttccccacaatgggatgatcacaagttggagcacttctttctttttttccaagtttcacaaaaaagaaagcctttggatttttgaagttaatttaatcggttctaaccgacttctaacattgtgatgatggtagccactggaggctctctct

SEQ ID NO: 36515 - DNA, 911 bp, Oryza sativa
gatgcagatgttagttgtatcaatgatagatagattgttaggatggcacattacagaaagaaaagtattcctagtagaaaagaaaacaatggccaattccatgccaatccaatgcttgatatattgatgaatgcaaactgctttgctgattctcatttcctgcaatgccagcccaagtagcagtacattattacagttagatatctgttcacatattgattgaatggtgatccattcacatcaaaactctcccagctgcattgccgtacgatgctgggaaccatgattaagttgtgcgtgttagcctcctccttgcaattagctaagtattaattaactaggcaagtagtttcctgtggtgtctgaataattcctgtgcctttcaaattcaggcagcaaggcagagagagggacaagaatatatttgtgtgtgttgatggatggagattggagaggaggaggaggataaggaggaagaagggtatatgaaaaagcagggaatcattggtggccgtccgttggttgggctgtccaaatgtgctgacagccacgccgatagatggaatggatgccatcctcctccctctttacctaatcaaatttaagcatctgtttcaaaggaaccattaaattttaagcaagtggaggtagctctcggattggccaatggcagccaaagtaacgaaacaatcaggcaggaaatgcctgatgccgttctgttgctgggggaatcagaattcagttaaatttcaagctagtagctcacctctttaatttcaaagtgaaattttcactctgaactagaagtagtatcctttttgcaagcaatgcatcagtgcaccgatgagtgtttactgtgtctgtgcgtgtgttggacgttgatgcgacaaggattaaccgcacacactgtc

SEQ ID NO: 36516 - DNA, 727 bp, Oryza sativa
  unsure (1)..(727): unsure at all n locations
tgcttattcacttaggaccccgcctgatcttaagaaaaaggacaaggccacatctatcgcatcctcttttttttacaagataagtatcaattttggtaacaccacaccacagcaatggcagtatagcacagtaaaaatacttaccgaaaacttttggagggaaacttgagcctccttttcaaaactggcctggtctccaaaaaactgagaagatgaaattgactttgcatttgaaaacttctgtcttgcttcactactttcttcaatctggagaatactgcaattgattagttaacagacttcttggaagttggcgctgagcaaacaaatactgaaaccgccaaagcttcttatttccagcaggaacacattcacatatttcgttatgcatagttgggctacacttgcaccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36517 - DNA, 23494 bp, Oryza sativa
  unsure (1)..(23494): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattgagcaaagattggcttgattaatcagttgattgattagcttgctcttggccatggccaaaccattagatttgccgttgttgctgataccggtcatggttgttatcctcatcagcgtgtcatttgcccaaacaaatgtcacttcgggcgcctccgtgcaggccgtcgccggcgccggctggtcctcgccgtcgggccactttgtcttcggcttctacgccaccgacggcggcctcgccgtgggcgtctggctcgccaccgcgcccagcataacggtgacgtggacggcgagccgcaacgacacgccggccaccggcggcgcgctgcggctcacctacgacggccgcctgctctggaccggcgcgaacggccaggacaggaccgtcgccgcgccgccccagccggccgtcgcggcggccatgcgcgacgacggcaacttcgtgctgtacgccgcgaacgcgacggtggcgtggtcgacgttcgcggcgccgaccgacaccctgctcgccggccaggacctcgcccccggcgcacagctcttctcgagcgtctccgccacgagcagggccaccggcaagtaccggctgaccaaccagctcaacgacggcaacctcgtcatgtacccggcgggcaccatgaacgtcgccgccgccgcgtactgggacaccggcacgttccagataggcttccccctcaccttgcgcctcgatgccagcggcgtgctctacctcgtcggcaacaatggcagctacaccaagaacttgacgaaggccagtgcagctcaagccgtagagcaagctcactaccaccgcgtcacgcttgatcccgacggcgtcttgcgttcgtatcgccatggattgctgtcgagcggcgggtggaagaccgacgtcgagtggatcgggccgagcgatcggtgccatgtcaagggcgcctgcgggttcaacagctactgcgtgcttgatcgcgacgcgcagcccagctgcttgtgcccgccggggttcgatttgatcgacgccggcgacgccgcgggcgggtgcacggcgagctccggcgccggcgagtgcacggggggcagagagccgaccctggttcgtccatggcgaccatgcagaacgtgtcgtgggcggacacgccgtgcggggtgctggccgcgggcacgagcgccgccgactgccaggcggcgtgcatgtcagactgcttctgcgtcgccgcgctgctcgacaccaacgacggcacgtgcacgaagcagcagctcccacttcgatacggccgcgcgggcggcggctacacgatgttcgtcaagaccggtggagcggcgagcccggcgctcggcggcggcggcggcggcaaccaccaccaccaccgcctcaggcgagcgagcaccgtcgcgctggtctgcgtcgggctcctgacgttcgtcgcgctgtgcgccctcctcgcgtcggcgcggctgctctggctgaaccagaggatggtgcgacggcgcgtcgcgctcgccgacgccgaggccctggacgaggaggcgccgctccgctcgtacagctacgaggagctggagcacgcgacgtacagcttccgacaccccctcggccgcggcgcgttcggcacggtgttcaaggggacgctgcggcgcggcggagagaggaccgtcgccgtgaagcggctggagaagctggtggaggacggcgagcgtgagttccagagggaggtgcgcgccacgtgggcgccaaccgcctcctcgtctacgactacatgagcaacggctccctcgccgacttcctcttcaacagcggcggcggcggctacctgttgagttgtgatccaaattcaattgcacttaataaagaccagcttctaccgtagtggagcggaggcccgtcgccgggaggttggggcgaaacggatcgtcatcctttttagggttccaccatatatatatatacacatcttgtaagccgccgtgcggcgttgtaacctcaccccatatatagtggagatattttgctggctggcgcccgtggttttttctctcctgttttgggagggttttccacgttaaatctcgtgtcttctgtgattgatctattgttctttatcgtttgttcgcttatcgtttcctaacaagtggtattagagcttgttcccacattagggtttcgcgatggcgtcgatgaagtatgatctaccgctgctagactataagacgagattctcgttgtggcaagtcaagatgcgggttgttctagcacaaacttcggatcttgatgaggcgctggaaagcttcgggaagaagaaatcgactgaatggaccgctatggagaagcggaaagatcgtaaggctctgtcgctgatccaacttcatctatctaatgatattttgcaagaagtgttgtaggaaaagactgctacagaactttggctcaaactggaatcgatttgcatgtctaaagatctaaccagtaagatgcatatcaagatgaagttgttctcgcacaagttgtaggagagtggttctgtgttgaaccatatatcggtcttcaaggagatcgttgccgacctagtgtcgatggaggtacagtttgatgatgaagatttaggtcttttactgttatgctcactgcctagttcatatgcaaattttcgtgacaccatacttttaagccgtgatgaactaaccctagcggaagtttatgaggcgctccaaaatagggaaaagatgaaaggtatggttcagtctaatgcgtcgtcctctaagggcgaagcattgcaggtcagaggcagatctgagcagagaacctacaacgacaacaatgatcgtgacaagagccaaagtagaggccgttccaagtccagaggtaaaaagttctgtaagtattgcaaaaagaaaaatcacttcattgaagaatgttggaagctacagaataaggagaaaaggaaatctgatggtaaggcctctgttgttaccagtgctgaaaactctgattcaggagattgtcttgtcgtttttgctggttgtgttgctagttatgatgaatggattcttgatactgcatgttcgtttcatatctgcattaacagagattggtttagttcttacaagtctgtgcagaatagagatgttgtgcgcatgggagatgataacccacgtgagattgtgggcattggctccgtacagatcaagatacatgatggcatgacacgcacgctaaaagatgtgagacacataccagggatggcgagaaatctcatctctctcagcacacttgatgcagaaggatacaaatactctggttcaggtggagttgtaaaggtatcgaaaggttctctcgtttatatgattggtgatatgaattctacaaacttatatgtccttagaggaagtacattacatggttttgttaccgctgctgctgtttctaaagatgaacctagtaagactaacctgtggcatatgcatcttggacatatgagtgaacttggtatgacagaattgatgaagaggaacctgctggatggctgtactcagggtaacatgaagttctgtgagcactgtgtttttggtaagcacaagagggtaaaattcaatacctcagttcatcgcaccaaaggtatacttgattatgtacatgctgatttgtgggggccttctcgtaagccctctcttggtggtgctcgttatatgcttaccattattgatgattactctagaagagtgtggccttatttcctgaaacataaagatgatacatttgctgcttttaaagagtggaaagtcatgatagaaaggcaaactgaaaaggaggtaaaagtacttcgcactgacaatggtggtgaattttgttcggatgcttttgatgattactgcaggaaggaaggcatcgttaggcatcacaccatcccgtacactccacagcagaatggtgtggctgagcgcatgaacagaacaatcatctccaaggctcgttgtatgctgtccaacgttcacatgaacaagcgtttttgggcagaggctgctaacaccgcctgctacttgatcaacatgtcgccttctatcccacttaataagaaaactcctattggggtatggtctggtatgcccgctaattattcacagttgagagtttttggatgcactgcttatgctcatgttgataatggaaaattagagcctagagctattaagtgtctgtttcttggttatggttcaggagtaaaaggatataagttatggaatcctgaaactaataagacattcatgagcaggagtgttgttttcaatgaatctgttatgtttaatgacagcttgcccacagatgtcataccaggtggttctgatgaggagcagcaatatgttagcgtgcaggtggagcacgtggatgatcaggaaactgaaattgttggtaatgatgttaatgatattgttcagcactcacctcctgttttgcagccacaagatgaacctattgcacatcgcagaacaaagaggagttgtggagctccagtccgccttattgaggaatgtgatatggtttattatgcttttagttgtgctgaacaggtggagaatactcttgagccagccacatatattgaagctgttgtttctggagaccgtgagaagtggatctcagctatgcaggaggagatgcagtctcttgagaagaatggcacatgggagcttgtgcactttccaaaatagaagaagcctgttcgttgtaaatggatcttcaagagaaaggagggcttatctcctagtgagcctccgaggtttaaggcaaggttagtagcaaaaggtttcagtcaaattgctggtgttgattataatgatgtgttctctccagttgtaaagcatagttcaattcgcacattcttcagtattgttgctatgcatgatcttgagcttgagcagttagatgtgaagacaacatttttacatggagagcttgaggaggagatatacatggaccagccagaagggttcatagtacctggtaaggaggattatgtttgcaagttgaaaagatctttgtatggtttgaaacagtctcctcgtcaatggtataaaaggtttgattcatttatgttgtcacatggctttaagaggtctgaatttgatagctgtgtgtatattaaatttgttaatggatcacctatatacttgctgttatatgttgatgatatgctgattgctgccaagagcaaggaacaaatcactacattgaagaaacagttgagtagtgagtttgatatgaaggatcttggtgctgctaagaaaattctaggtatggaaatcactagagacagaaattctggtttgttatttcttagtcagcaaagctacattaagaaggtcttcagcgttttaacatgcatgatgcaaagcctgttagtactcctattgcacctcattttaaattatcagctttacaatgtgctagtactgatgaggatgtagaatacatgtctagagttccatattctagtgctgtgggttctttgatgtatgccatagtttgctcccgtccagatttatctcatgctatgagtttggttagtagatacatggctaatcctggtaaagaacactggaaagctgttcagtggattttcaggtacctcataggcacagctgatgcttgcttgaagtttggcaggactgataaggggcttgttgaatatgtggattctgattttgctgcagatttggataagagaaggtcactcacaggttatgtgtttaccattggcagttgtgctgtgagttggaatgcaacattgcagcctgttgttgcccagtctaccactgaagcagaatacatggctactgctgaagcatgtaaagaatcagtttggttgaaaggattgtttgctgagctttgtggagttgattcttgcattaacttgttttgtgatagtcaaagtgctatatgccttactaaagatcagatgtttcatgagaggacaaagcacattgatatcaagtaccattatgttcgcgatgtagtcgcgcaaggtaagctaaaggtatgcaagataagtactcatgataatcctgctgatatgatgataaagcatgttcctgttgctaagtttgagctttgctcaagcttagttggtatagtggtttagcccaagaggctatttggcgccgaaagtgttttttgtctttgttgtgttcagggtgaaggattggttcatgctacaagaaggaatttgtctcaaggtggagtttgttgagttgtgatccaaattcatttgcacttaataaaggccagcttctgccgtagtggagcggaggcccgtcgccgggaggcttgggcgaaacggatcgtcatcccttttagggttctaccatatatatacctcttgtaagccgtcgtgcggcgttgtaacctcaccccagatatagtgaagatattttgctggctagcgcccgtggttttttctctcctgttttgggagggttttccacgttaaatctcgtgtcttctgtgattgatctattgttctttatcgtttgttcgcatatcggtcgcgctcgacgtggcgcggggtctccactacctccacgacgagctcgacagctgggtgatccactgcgacgtgaagccgcagaacatcctgatggacgcggccggcacgacgaagatctccgacttcgggctggccaagctgctccagcccgaccagacgcgcaccttcaccagcgtgcgtggcacgcgcgggtacctcgcgtcggagtggtaccgcggcgccggcccggtgatggtgaaggccgacgtgtacagctacggcgtggtgctgctcgagacggtggcgtgcaggaggagcatggagatggaggaggccgccggcgaggaggagcggacgctggcggagtgggcgtacgagtggctgctggtgaagagcgaggcaaagagcgccatgagcagcgacgagacggtggaggcggcagaggtggagagggtggtgagggtggccatgtggtgcgtccaagcggagccgcagtctcggccatccatgaatggtgtcatcttgatgctgcaaggccgtttggaggtgccatttcctcctcctcctccagcttcttcttaagatgctactactaacatcgttgcaactccagctatatatctaaagttgttactaatcgggccttgcaattgaagttgtgttgcatgaatgtgctaatctacgttgataaagtgacaagggcttgagtgatcagttaatcgaacggctgggttggtacagccgttgcatcttgtgaagctgaagtacgtgtatgtgggatacacatgcaggtgtttgattgcttgcatgacatatagctggatatgataaaatgttgtttggttggttgtagcaaagggaggatgggatggttgcatacaagatatgttgtttagttggatgggtacatcttgtgtgtagatacttgttcttatgggtggtgaggttacccctaaaagcttttggagcaagatttttttccaagtcttaaatctgtttatgggtggtaaggttaatccgtagtagagttttactgatatggtcatatttaagaacccaacaatcgcatattcatcccctctagtcgatatctcgatccaacatagcctcctccgtgcgagagcggtgttgcgctaacatccaagtcctaaatctgtttatgggtggtaaggttaatccgtagcagagttttactgatatggtcatattttaagaacccaacaatcgcatattcaccccctctagtcgatatctcgatccaacatagcctcctccgtgcgagaacggtgttgcgctaacctcgcctcaccggcgtcacttgcaaggtattggagatatgaatagttaatataggggagaatatactaacatgtgtgtcaacctatttttaaaatattacttttgttgaataaactgccacgtagaaccaaaaccactcctgatttatttagtgggtaactcgttccatttgaagaattaggggtgtgaaatgtttggtatttaatttgggagggataattcgtttatagtcttgaggtgtaattcaatttattttcctttacgacccaaataatgctatacaattacattcagcggacatagcatgacattttccacaaaaaagctcatcatgagtccacatatatatcgacaatttgggtccttaaataactttgcgattggtgcagaaaccagatcacccagatattcacaataagaatgtaccactaattaaatttctgagaaaaaaactatcttaaattcatagtttggaactgttattaaatattaaccactaaccacaagtaggtcataatatcttactaacactacggaatacagtacaagatcaaatagtgttatgatgaatataatcagaactacttacagtgtccagagggactaggcgttgatagtcatccagggaagcaagcaagcagtattcagggcgaaaggaccaatctaatatgccatcttcctcagagtgcttaaaatatccatgcttctgaagaagccgcagcttactgccatcatccttaatgcatagttatccttatccaggagaacatacagaaggcaataatcctccttcagcttatcgtcaccatgctgcttgttcttctgtagtcgctgttttgacaagtgatgatgatggcaatgagattgatcagaaaagatattattattattcaatgaaaataattggaggttagtgaaaccaacaaacataagtagaagtattacgagtagaagtattacatgtaagtatttataccttatagtatttgaggcgatacagtgcgtggcgaatgtagaggtctgttcaccttgcagcttagtcttgggtcaggacgaggaggcccgtgaggcagatttccgagacaagcaaggcactcctcgccgatgctctctcaaaaaccccagctcgtcccaaaaccccccagctcgtccattcttctttttcttctacttttctgtccatcgtccactgtagctaactactccctatgtcccataaaaaaaatctagtactgtgatacatcctagtacaactaatctagacatacatttgttcagattcgttgtactaaaatatatcatatctagtcctatattcactttttttttatagagggagtaacttgtaaaatcttgtgattttcccgatgcttggcggcaaatatgattctttacaacaaccttgtgcacatctagttggtgtgatttcgatcggcaatagctagttgtgtgttagtgatgaactctcgtcgagatcgaccacagctctcgcgaatttcaccgtggaactcaacaaggcatcactaatctctaataccgaaatttgtgcaaaactctagcagctgctcgtgccatgtggcttaactggtttcgccggaaagagctcctacctcgcacttgtgttggcgtgacttttgctaaaaaataggcccacggacaactgcaaaattaacaggccgtgcaaaatatgaaatatcactggacgattctagagaaatcagaaagaatcccttgcaaaatatggaatatcactagacgattctagagaaatcagaaagaatccagatttaccacaaccagccatacatgtggtcaacctttaataatattataacacaaattctgtataaattaatcgttggcgcacgtcttcactcacggaatcggtctccacgcaatattgccatatatgcggtcaatctctaatcttataacacgaattttgtgcaaatttgccgcccggcacgctgattttctaggcatcgctaatctcttactatcgaaatccgtgcaaattatcgagcaattagcgatgccacgtggcacagcgtggttcgtgcgtgcgctcccacacttgagaaggactaaaatataaaaaacaatcttacgttggagtaaaatcaaaaagtgcaaagccacctgatgtttccggaagggtcacgactcttggtcttctacaatcttgattcactcttcatcttctataatcgttcctcttttctcttgtcattgtttcacattcattctccatcttgtctgatccaccgggagaaagaggtagcgacctccggccggtacctctgcggcaagcatgtcctgcacagagacaacaccacgaggaggaggcggtggccttcggccggtatctctgcggcgagcacgtcctgcaccgcgaggacgacgttggcgagttcagtgaatggcaatcacatgtattagtgatataaatattgcagatttttcattcttaaaaaaaaaccagctagatctgttacttcactgatatatattagactatttgttatagtataagttattgggaatggaagcattcggaaagaagttttactgtccctttgttattgtaaacgcataatgaggaccatcttcattaagaagatagaacccttgtagaatatattttgtttagtgatgctggtactactcctactctaccaagttccaatatcatgaggttttctgtttttgtttgacaatttcgccaatgattaattataacatttgaattttatttgttaagtctttgcttagctccagctttggggcttgtattgactaggagactacccatgcataagaagtttcagactttcagttggttaacttaatttaattcctcgaatatttattcctgtgattatctggtggttaaatttctctgttctgccactatagtgaaaaattgacacacttaatttagtgagaaccaccccaagatattcagagcatggaagctgagccatgtaatttagagacaagcagtttgtcaggcaaaagagcttatgaagatccgaacagtaatgatcaggtaaacaattgctcatatttaaaatcatttgtttttcaatcatataattaacctactactgtactgtgcataagcttggcaccatttcaagcaagtgtattaccttatatggctgcttcaatttcacggttacctaccagataccctgtttacatgtagtattcacatatatacctgacactacatagaaacctcatacttgcccaacctagctactgcatcgtgttaagtactgcatgagaaagaattgctggttcctcagtaacatactttgacaaggattctaattattgttttttttgggaaaataatgaagaagaaaacactgacttttgctatttatagcccaagctggatacttttgttatcctctcatctaccagccaatttatttttgatgtatttagcactcaccaagaacctacactcatctactttccagttactctaatacaaaattgatagggagctttattaaaatcttccattatttaagttccagatcaaatgtctataatatgtcacatactcataccccgcggcgttgctgcggaaaattaagttgcataatatgtacaaaactaaaaacaatttgatacaattttgagcctaaaagtaattgagattgcatgtttttaagagagaagaaagaagaaataatttagaccatagatctatcatccaaaggctagaaataattagggtgatgtgggttaatgagaagagagaaatagcattaactacacttaatggagatgaactatataagtatataggataactattgtgttttgttcagattatacagtctatatcacattatatgccatagattaatttttaaaatttaatactctgctgtagtaatcatgattgtgcaatatagtattttgctacaacttgcattgttgttaaactgatcattctgtctcaatacgaccaaatagtgtggcccatcgagtgttgcacgcgtgtttttttctagtctactaatctaaagctggccattctttctaagtttgattggtccacgtggcgccgtattttgcgaagtgactcgtgaatacgcatctctagctagcagcggtttaaactggacgtaacaccggcaaaaaggaaaaaaaaaaggaagaacgggcgcacgcacagggctgaggttgacaccgagctgtgggctatacagcccaatcatgtgtacctgggctggtcgtttcatgctgttcatgctagaattcgcacgttggacgttggctcctcgtggccactaacaggcacccatgagcaaacagaaataggagaagaaatagtagggaaaaataaatacaaataatttcgtaaaaatatttgaatatataaaaaacatcataaaaaataaacgaaagaagtaattttggcacccctaattacatgtttgtcacaattaacataatttggtttttctcattctttgacaaacacaaaattaaattcccgtaatatgtccttcttaaaggaatttctaagcgtgtgaaactactatgtaatgtacacccatacctatagacacaccacatacacatcctaccactactgtacccagggttttcaattttgaacagggtttttttttgccaggggttccgaattcacgaaatcaccaaaatttcggaagttttggtattttttggcctaaattatttgaaaatttaactaactttaaatgaatgtaaataaacttttaccaaattcacataaatttgcaaaaaaaaaggaaagtttcgggcaagatatgtgcttgccggtgggggcaaaattactgaaatttccgaaatttgttccgaaatttcaatccatatttgtccctttgaagattaaatcatcattcatatctaggaattgataatggctggtacatcacctaccactgaaaaaacaaatagctgtaaataagaccacacatgttaactctataccttaatcctgaatagacatgttccaccacacggaatgtaaccaaccgatctacacttagtatatcctggatatataaaatcaagataagtatctttaccatgttggtgtcctttatttttatttctagaaaatgaaatgggtaatcaaatacacatttatttagatatgtatttcctactaattatgcaacatctatgacttacatgtataaaaaatgatgcatataaataaaacaagttttttcactaatatatatcatctttagccatttcctgaaattaaatagtcgttcagcatgacaagaccactaattagaattctgccttgatttgttccacaacattttacaaacaaaaaaatttaaaacccattaaataatccttttgaatatatggtttataaaagaaaatacacacgggctataaactaattggcgtgccaactgacatgcttattttctagtctatcttctaaagctggctcgtctcgagccatttcattgggtcacatggtggtgttaaattttaggttaaatctaaggaaattatgcataagaaaaaatagataaaagaaaagaaaagacacaaatccaatttctagagacttcatgtcacgccccgaactagtcccgaccggaactagcccgtgacgctccaaattaacctgttaattgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagaaactggagctaagccttgactaaactgcagcgggaacaccactccacaggcatcctcgacggcacggacgaagcctactcctcagggaagccttcatctgacacatacccgtcctctggggttgggaaaagtagagcaagactgagtactacccactgtactcagcaagtcataccggaataggggtatgatgcaggggattaacaaagaagagctagagtggttcatttgcataaaaactggcatttataaacaggaattgaatgcgaaaacggttgtaataattaagcagtattaaatctccgctgtccaacgctaacccacgttgcgacaggcccaaccatccacctaaactatccaagttcaacagattactctagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctataatctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaaaatgggatcaacatgttcaagtgacaagcatgacttgccttgctctgctgctggagggacctcggcgactatctcgaagtacaccggagcgtcggagggatcggaatctaacgacatacaaagcaaacattgcaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaaggggtggcggctcgcgggcccactggtcagtggcacggggaaaaggaggggcggcggcgccacgtggcggccgaaccgacggccccgatctacccaagggtagatcggacggcgacggggacctcgcggccggggcgcgcgggcgcggcgcgagacggcggcgaccatggcgccggcggcgcggcgctcacacggcggcggcgcgcatgcggcagcggcgcaaggcggcgaccgaaggcgaccgaccggcggcggggagcggcggctagaggaggagcggcgggcggcgataaatgcggccgccggcgcggctcggcatcaaagccgaccggccggctgggttaaacggcgacggcacgcgtgcgacgacggcggctaccggcggcacgggaaacggcggcggcagtcgaaggcgacggccgacgactcgaagcggcggctagcggctctaggaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagagagggattagagagagagagatggaccatggcgatcgggatccatggccgaaggcggcgatagaggtggcgctcacccgtgcgcgtggagatgagggctccggcgacgaacctcgacggaggaggggtggacgaggtggacctcgaccgcgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggcgatgcttaaataggggatgggggaaccggacgtggccgggagcggcgggattcgacggccgacgtgggggagtggggaggagagagaggcgggattcggttttcgaatcccggccatctcgggcgcgggcgcgagcgggagagggaggggaacgggcgcggggaatgcggcgcacgcgcgggcgtggtcgacgtggcccgggagcgacggaggcgtgggcgcggcggcggtttcggcgcggcggtgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaggaggaaaaagggagggaaaagaaaaagaaaaaggaaaaggaaaaagggttttccctggaattaaaaattgcactttagtgatttttaattggttaaaattatttctagagctctgaaaattccactaaaaatcctgttaatgcatttcgacatgtagaattcaagaaaaattccacatgtcaaatccgattattatatgcattgttttcttagggttttatcctgatttcctctgcattttcttggggtcatttgtaatttacaatttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccattgaactcggcaaaaccgggtgaccttgtttctggttctcctttcactggtatcaagtatgcgaaccggcttctccacatatgtcaggtcttcctggatatcaatgtgttccgaatcagcctgttcttcgggtacccttaagcacttctttaactgggaaacgtggaacacgtcatggatgccgatcatattggatggaagttctagctgataagcaacttctccccttcgttccaaaattttgtatggtcccacgaagcgtggtgccaacttgcctttcgtctggaaacggtgtactccccggagcggagtgacacgaagatacacgtagtctccggcctcaaaagttagctcccttcgacggttatccgcgtagctcttctgtcgagactgagcaatcctcaatctctccctgatgattctgactttctcttctgcttccgctaatacttctgttccgaacagttgacgttcgcctgtctgatcccagaagagaggtgtgcggcacttccggccgtatagagcttcaaacggtgccatctgtagactggcctggtagctgttgttgtacgagaattccgcatatggtaagcttttgtcccaagctccaccaaaatcaagagcgcaagctcttaacatatcttccaggatttgattgactcgctcggtctgaccatcagtttgcgggtgataggccgtgctgaaattcaaacgggtccccaattcttcctgcagcttctgccagaactttgaggtgaactgactacctcggtcggatactatcttcttgggtaccccatgcaaacacatgatccttgcgaggtacaattctgccaatctctttcccgtataggtggtatgtactggtataaagtgagccaccttggtgagtcgatccacgactacccagattgaatcatgtcccgatgatgtccggggcagtcctgttataaagtccattccaatctcctcccatttccattccgggatttgaagaggttggagtaaacctgctggtctttggtgctctgctttcactcgctggcaaacattgcagagtgcgacgaattcagctatttctctcctcatgctgacccaccaaaacttctctttgaggtcttgatacattttagtgctgcctggatgaatggagtacggggtctgatgagcttcggtgagtatcagatccttcaattccttgtcgtccggtacacacaatctttctcccatccagattgtgccatgctcatcctcaaggaaatcccgagcctttccgactctcatgttctttttcagttctgctatttccggatcatttacttgagcggctctaacttgatccacgagcgtaggccgtgcctccagagcggctacgaacccgtgttcaacaattcccacgttgagatgctcaaactcctgccgcaattcctcacacatgccctcgatgcatagagcagtgcagtaacttttccggcttaaagcgtctgccaccacattggctttacccgggtggtagtgaatactcatgtcatagtctttgattagttccaaccatcttcgttgtcgaaggtttaggtctggttgggtgaagatgtatttcagactcttatggtccgtatatacttcgcagcggttgccgatcagatagtgcctccagatcttcaaagcatggaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattcttgagaagttttcgatgaaacgacggtaataaccagccagtcctagaaaacttcgaatctgcgacactgtcttcggtggggtccacttggtaactgactccacgttcgatggatcaactgctacaccctgagctgtaatgacatggcccagaaatttgacttccgtcaaccagaagtcacacttgctgaacttggcgtatagctggtgctccttcaacttctcgagtactagacggagatgttgttcatgttcttcctcggactttgaatagataagaatgtcgtcgatgaataccacaacaaacttgtccagaaattccatgaacactttgttcatcagattcatgaagaatgcgggtgcgttagtaagtccgaaggacataaccgtgcactcatatagcccgtaccgagtggtgaaggccgtcttcggaatatcctcttcccggattctcaactggtggtagcctgatcgcaggtctatcttagagaacactttagctcctttcagttgatcaaataaatcgtcgattcgcggcaaaggatatttattcttgattgtgacctcgttaagtgcgcgataatcgacgcacatcctctttgtcttatcctttttctccacaaaaatgaccggagcgccccaaggtgaagtgcttggtcgtatgtaccctttctgcagctgttcatcaacttgcttcttgacctctgctaattcgttggccgccatcctgtatggtctcttgtaaattggagcggttcctggtgccaaatcaatccggaattcaatctccctcttgggtggcatggtggtgaggtcttcggggaacacttctggatactcgcagactatgggtatgtcctccaattttctcaagttcttctcttcggtgtccactgggatttccgtctcaatctgattcaacgaggctcctttctttggcgagactagagatttgtacaccacggtttctcctttctcattggtcagggtgactgtgcgactcgcacaatcgatgactcccttaaacttggtcagccaatccatcccaagaatgacatctaggtctttggattcgagaaggatgaggttggctagaaacggtgacctttgaatttctattgttatagaagggctgaattgaaccgaagtggagctattccctggggtatgaacccgcatcggtgtgctaagttcctctcttattaacccatgcatcccgacaaatttcttggagatgaaagaatgcgttgcaccagaatcaaaaagtactgttgcagggattgagttaacaggaaacgtacccagtacgacctctggtgctgcttgtgcctcctccgcagatgcgtggttgacacgagcctggataaaccttggtccggcacgcctgggcttcgggcatttgtcagcgaagtggccaagctcgccacagttgaagcaggaccctggttttgctcccgtctccttcttggcttgtgcgggctggcctgactgtgccggtgccatcggtgggcgtggagctgcaccgcggttgggctggcctccatggtggttctgactgccactagtgccctggtggaagttgctagggttgaacgggcggtgctggcggacgatcatggtggtaggtccaccctgctgtccgggagtgaagcgcggtcggtgctgactaccttggttggaccggaactgcgccgcctttcttttcctgtccattttgttgcgctgatcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtcctgttgccctggtggagcgcccggaattccctcttcttttgtgccacgaccccatctggcacctgtgccttcctaaagctacggcagaactctgcccatgtgacttcagtacccggtgggcgggtggccatgtggttgtcccaccaagctgacgcaggaccctgaagctggtgtgtggcgaaagcgactttctcctggtcattacactgcaggagattcagcttcttctctatcgcatggagccagtcatttgcctccatagggttggtggtgctggagaaggtgggtggcctgacacgtagaaactccggcaacttggactgagggggagggggaccaaactgctggtgctgctgttcggcgtgctgcatcatcctctggtgcatctgttggtgctgctgctgcatctgctgcatcatggctgccatcatctgagtctgatgtgccataacttgggcaagggtcggattctcgggaagtggtggcggaccattgccagaatcaccgttggggtgcacaccatcagcgcgttcttcaccgttgctgccctcgcctgttgcgcggctaccagtcctggtgtagaccatcttgaggggaaagcagacggggaaaagaagaaaaacagatgctcaaggactaagctttattatataggaattaaaactgcaattgttctgatctgaattaaaacacttaaaaaggcaagcaaaaatccttattaagacagccatatcataggcacatgatatcgaccgtcaactgaccccaaacaagcaacctaaacacacaaactaacaagcagaaactagacaatcgataaactaatgggaaaacgagcctaatgctcggaacggctcctgcggtcggtggagtcgaaagcgtcctcctgctcgtcacctggtccctctgagcgactcctggagcctgacagatcagtctcgccgctgccactgggagtagcggacaaccaacctccggtaccactggctgaacctctggcggctgatgctggagcgaaggagagagtgaacgcgggagctggagctggagctgaagctggagctgcaggaactgcgggcagaactgaaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctacctcgtccttcagagcgacgatcctcatgagcttcccatcgttcaaggccttggtcgccttgtgcaggtccgagtgcatcctatccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtaacctggccatcatcaagtaggctgcctcctgacaggcatgatctgcggtgcctcctgacgcctcaaccgccatgttagcgaggcaagtccccacgtagccatggacctccaagcggacacggtgaggaagctcgccactgagcggtgggatggtcgtgtactccggcgcgtcggggtagcccaccaccagggtcatgcgtgccaactctgccacgaaatcaatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagtgcgaataaataagactcacataacgataaaataatgggaaattagatacataataataataacgaacaaagcataaacaccttacaacccatgttaccgagctaggacctaatgcatttcacccctcaaaccccaactgactgacgaataaatcccaataattttactaaaaccctagactgactcgttttaaaaaactcactttaaacgagcgaccaagatttttcccttgaaccacaagaacagatccccattttcccggaacaaaatccaattgcaaggaacatatgcaatgaaaaggattcagagggctcttaggtctttccatttggcttgtcctacggtcaaggtcggctctgataccaacttgtcacgcccagaaattcccgaatagaattccaagcagaatgtgtattaaaacccccgtccaggaccagccggggtgcacaaacgacaatgttgacatacagatccacgtcttacaaacattataaaggtcttacagaaatgcagcggaaaacaaaagaaactggagctaagccttgactaaactgcagcgggaacaccactccacaggcatcctcgacggcacggacgaagcctactcctcaggaagccttcatctgacacatacccgtcctctggggttgggaaaagtagagcaagactgagtactacccactgtactcagcaagtcataccggaataggggtatgatgcaggggat

SEQ ID NO: 36518 - DNA, 22588 bp, Oryza sativa
cctcgggggaggcaaaatagacttttgcggaggaatttgattggaaggaattggattcggagttgaactcgacgatagatcggggattgagatcttgagatggcacggacactagacaacaagcaaagaaacaaatttcgcaattagggtttttaagagataattttcccgctaggcgccacgacggaacgggcgctacaaaccaacccccctaacaagaatctcgaccccgagattcaacacctaagggagcaggtccgggaactcggcgcggagaagatcttctcgctcccaggttgcctcgtcttcggaatgattgctccattggactttatagaacttgatggtcttccttcgagtctgacgttctacctcttcaagaaccttgatcggtctttccttgtaggtcagattcttttccagctcgatattacccaggggaacttgctcttctggaactcgaagacatttctttaactgggatacgtggaacacgttgtgcacatctgcgagaccttcaggtagctcaagctgataagccacttcgccatgtctggcggttatgaggtagggaccgatgtagcggggtgctaacttgccggacatcccaaaccttctcataccacggaggggtgatactcgcaggtacacatgatctcccttttcgaactcaaggtcacgtctccgattgtctgcgtaatttttctgacggttctgcgctgtctttaaacgctctcggatcagcttaacttgttcttctgctgacttgagtatgtcaggaccgaataccagggcttcgcccacctcattccagcacaagggggtgcggcactttcttccgaacattgcctcattcggcgacatctgaatgctggcctgataactgttgttgtatgagaactcagcatacggcaaacaacgatcccaagtgccttcgaaatccaaggcacacgcacgtagcatgtcttctaggatttggtttaccctttccgtctgaccatcggtctgtggatggtaggccgtactaaaatttagatcagttccgagggcttcatgcaactgcttccagaaccttgaggtgaactgagtgcctcgatccgacactattttcttgggacagccaaatctacatacgacatgagtcatgtagagttctgctagtttctttccatcataggtggttttcactggcacgaaatgagctgacttcgtgagtcggtccacgattacccagatggagtcgtacccgctgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacgtctcgcttcattccagcccaccagaagtatgccttgatatcttggtacatcttcgtacttcctgggtgaatggagtaggcggactcatgagcttcctttaggatgagatctcttaactccttcttggccggtacacagatgcgtggtccgcaccaaactgtgcctttatcgtctatggagaaattggtgtctttcttctcctgtattctttttattaattcttttatcccttcgtcgtctttctgagcctcccggatttgcgactctagggtaggctgtactgtcaagctggcagggacacctgactgtaccacggtcagtcttaacttctccaattctctgcacaggtgatcttggtcaggccgtatttgagctacattgcaataggccttgtgacttagcgcatcagcgaccacgttggctttaccaggatgatagtggattccaagatcgtaatccttgattagttccaaccattttctctgtctcatatttaactcggtctgagtgaagatatacttaagacttttgtgatcggtgtatacttcacatctgttcccgattaaatagtgcctccagatcttaagagcatgaaccacggctgccaactcgagatcatgggtgggataattggcttcatgaggcctgagctgcctggatgcataggccacaaccttttgttcttgcattaggacacatcctaagccttgtcttgatgcgtcacagaagatctcgaaatcttttcggatatctggcaaggtgagaactggggcagtggtcaaccttttcttcaattcttggaagctgtcttcacaggctgcagaccattgaaatttcttttccttctttaacagctcggtcataggtctggctagcttagagaatccttcaatgaatcttcgataatatcccgctaagccaaggaagctgcgaatctctgacacattcttgggcgggttccaagcaagtacagcttcaaccttgctgggatctacttcgacaccgttggacgagatcacgtgtccaagaaatgctactcggtctaaccagaattcgcacttcgagaattttgcgaatagttgatgatctctgagcttttccattatccgcctcaggtgttcagcatgttcctcctcgttcttggagtatatcaggatgttatcgatgaataccacgacaaactggtccaggtattccataaagattttgttcattaagttcatgaagaatgctggagcattggtgagtccgaaggacattactgtgaactcatatagaccataacgcgttgagaaagcggtcttcggaatatcttcagatctgattttcagttgatggtaacctgacctcaagtcaatttttgagaagactcttgctcctttaagttgatcgaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccaactcttcgatttgtcttttaacttctgctaactcattagctgccattcggtagggtctttttgcaattggagctgtgcctggtgccagttctatggcgaactcgatctctcggtctggtggcattctttttaattcttccggaaatacgtcgggatattcacagactatgggcaccgactccaaggaggtgacttgtaaacaggttaggatagaccgacttgcggtaggggtgttaggggtaaagcggacttgctttcctccaggtccttgcaaggtgatggacttttcggcacaatctatctgtcctttgtgcttagccaaccaatccatccctagaatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttaacagagaacatacccatcacaacgtctggagcatcctgagcggtttcagcttgaatgtgattcacacggcctcgaccaaagttgttggaagcacgtgaaccttgtccacttgcctgagagctaggacgagactgagctgccgctggagtaggagttctggcagtgctgccattagcatgccctgagttggtgttggtaggattctgaggacactgtctagcatagtgacccatctggttgcaccggaaacactgaactgctgacggtccctgcggtgacttgaaagagataacactgttaggcgcagtattgccactaggggcacgctgctgtggctgaggtgccggacggtttatctgaggacgaggggcgtagcctggctggcggttagcctgagtgaccgactggtggtattgcatgggttgaccgtagcgagggcgaggtgcgcctcggaaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctttcaagaatttcctgatcttcttcttgtctgtgtccacttcctcaggggcataccgagccaacttgttgaactgacttaggtactcattgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgagaggcgtagagcatcttctcaacaggagtacactgcactaagttgagttttctatcaacatctttcaaccaatcgtcagcctcgacgggctcgacggtctgagagaactctggcggacgagacctcagaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtgggaaagggaggcgttcttctccagaattgtgactggcagtgcggtgagagcggtgagactgtcccatctctgcatcacgggaaactgtgcgatgcgagcggctgctgcggcggggttgctcaacctctgcgttgcgggaaacagtacgatgcgaacggttgctgtggtgagactgctcattagctgattcatgattttcttctggctcaactctaccatcctcaaaaccaaagcgggctggtgcacgagctgcacggcgggggcggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtaggggagctgggtagtggaaacggaacacggtggcagaaccaacaacacgcttccgcgcagtgcggataaagcgtgggccacggcaggaggaagcaactggggtgtgtcctggggtgtaggaagggctaactgggtgtgggtagggcgagtacactggtgagtacggcgcacgcgagctgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggccaggcgacgaagcgcagtccaggagaggtcctggtacgcgatctggagagtgggcctggctacagtgaagtggtgtgggcgaaggccagctccgtgtatacctccacgggggtaaaggtacacagagagctcacagtgagggggaacacggtccacggagtaccccgtgtactcgggacacgagaagccaaggaaacgggcgaggtcacgaagctgagcgacgtggtgaccctcaccaaaaccgtgggaactgaaactggcgttcactgccatctacaattttgaaagagggagaaagatcagtaaccattttagaaacaaactattgaaaataaagaagacaaaagaaaccttagcttttcgcaagtagttttgaacttagtatccttagggtcgtcctaagtgtcgggtttcgccctagggccaagcctgtgctctgataccatctcttgtcacgccccgaactagtcccgaccggaactagcccgtgacgctccaaattaacctgttaatcgataccagtcccaggaaatagtgctggtatcacagggagacagagtatcacagcaacagaggtctctttattatagagtagaagtacagtcatattgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggaggattatttatatagagcaagggtgagtacgggagtactcagcaagccaggggaaataagtgtttaatgcaggcttcaaggaaaggctgtttttttcgtaattgattttgtttgaactcttttctaaaaagtctaagtgagtgcttctcaaacgacacggatgagacagtgcatctcgtccggtcggagtatgtgcaatgtatcagtctttagatcttgaaacagggttggcacccggccaacagcttttcaaacggccacccgggccaacaacatttcaaacggccacccgggcctagctgatcccgtcagctgctgatttttcaaacatcgaacccagtttcacaacagcaatttcacaagcagtagtcagacaaaactacactaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattctaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaacaaaggaatgatcaaatgcaacaaattaggtaggtctgccaatctgccttgcagacgggacaacagattaagtgtgatcctatcaatgcataatatttcgcaagcaaaataattaaatttcaaatataggctcaagatgttcaaaggtggcttgccttgctcgagatctggagcttgatcctcgaaatccttgcactgcgggtcttcgggctccgaaactacacgcgaaacgggacaactcaacaaaacggcgaaaatagagccctattaaagacctctaagcgtgccactagatagatctcgagatttgggaaattttagaagttgaatggagtcaaatggaattacggttgggaagatattgaatttataagattattggatttttggtctaaaggaaaaggatttaattaaatcctttttgaaaaagaaaagaaaagaaagaacagagggatggaaattagacttttcctcgggcggctagggcgcggtccaaggtaaatggagcggctcggccgagcttaacgggccggccggcccaagacggcccaagcgcgcgcgcgcgggagggagaagagagagtccggtggaccgggctcaccacgcgcggtcccgggtgggacccgcttgtcagcggctcggctcaccatgcggagggagtacgtggctcatgcgcgcgggcggggaaaggacgcggtgcacgcgcgcggtccgtggtggacgcaggtgcggcgggcccacgcgcagcctcacggctcgcggtggaacgcgcgcacggggagggactgaccggggtcggctcgatccggtctaggctgagctggcgccgacgtggcgcctacgtggcggccacgtgggctggcgggaggtagacgacgacccggcctcgaatggacggcgggcggcggcggcgagcggcggagcgaaccacggcgatacgggcaacagcgagcacaccgggcggttgcacgtgacaagggaaggcgagccatcggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacgctagcgtcggattgggcggaactacgccgagcgaggccggtgacgagcgggtgctacggagctcgagcggcgacggcggcgaacacacggcgagcgacgacagcggtcggggcggcgccggctaactacggggaggctactcaagctactaccgaaagctagggggaggagatggagcgaggaggaagaacggagagagacatcaccgagaagaggaggggcgctgtgacgagaggccggcggcgcgggagtaatctctccggcctcgggccggggaagaggaaggagagggcgcggccgaagtccccttccgcgtcctcgaacgcaccggctctcccggcgcttggcgaaggacggcggaggcgagacagagcacgggggcggcggcaacggtgaggaggcgaatgggagaggaagggaaagggggaggcttgggtttataggatggcaatgtcggtttgggaaccgacttagggcggtcaagggcgcgagctggcgctcggcggtcgcggccaaagcggcgacagggaggatgacgccggcgaggaggaaaaaggggaaaaggagggggagaaagggggcttgcccctttgccgattcgggaaaaagggggaggggagcgggggcgacgcggcagagaaaggaggggcgcggcctccttcccttggcggcttgcgcgcggagtggcgggggccgggcggtgacgacggcgatgacggcgggcggtttggagcggagcggcgacactggcgacaggcgcggtagacgctgacgacggcggcgaccgggcggtcggccactcggcgcgcgcgcgcgggaaacaacgggcggcgtccgcgcgggcacgcgcacgcgaacacggcgcgcgggaagcgtctttgcgagcggggagctcgcgcgaggggaggggcgctcggcgcgggcgactcccgcgcacgcgcgcgcggcgcgcgggcggggcggaggggggggcggggagagaggcgctcggggaggctctcgcatgcgcgagcagcgtgtgggcgggaaagagagagagagagagagagagagagcccaggggggagagggagagatgggccggggaagaggggaagatgggccgagcgagattcggcccatcgacctcgggggaggcaaaatagacttttgcggaggaatttgattgaaaggaattggattcggagttgaactcgacgatagatcggggattgagatcttgagatggcacggacactagacaacaagcaaagaaacaaatttcgcaattagggtttttaagagataattttcccgctaggcgccacgacggaacgggcgctacacttcacaattatctatactctttgagataaatctagagaatatccatacgaaaaaaatatcgagaagcaaacaaaaggtacaacatccagattctaaaggcttcctaaaatatcgttccccttttcaatctatctatgtatctcatgttggttggttttatgccagctaattggctgagcgacatgtggcgagatacaagcgacagaaaaagcaccgggtaagaaaccctctctataaaactggcgagcgtgcgagttacaatggtgaattgaaataaaagagaagaaaagccgctccatgtgcgtagttgggccacacaatgcgtgattgggccagtgcaaatacataaaataaggaggaaaagaaaaataaaaaagacaaaaaatatgaaaaattaaaaagacaaaaaaatattttttataaaattctttgcaaattataaaacccgcgaatttccgaacatcggatgaaaaattccttgtctcttatctcatctaccttatttcatgtaattctatgcaatttacattcatagagacatacttaagccctatcaccctaggattgcaaaagttaatctagttgcttagttagtcttatccttcacaaagcctagtcacttaagttagttttgattaggtgtaatttatttttaatattgcttattcacccctttagtgattgattcttatagaaagggaacatgtataatattatttcataaaagaagaaagaatggaacacctagagagtgcagtaaggtgaaaaaacatctccactgtcggaaatttattgaaagtactaaatctggttagcttctcataaaagttgataaattgatgagctacatttgccagagagcatattacgttatgaaatacttttctgaaaagcaaaggtaattgaagatcagcagacctagcatgacaactaagtattataccttgtagtatttgaggcgatacactgtgtggcgaatgtagaggtcatgtagttgttcaccttgtagtttagtcttggtgtcaggacgaggaggcccgtgaggcagatttccgagacaagcaaggtactcctcgtcagtgatactctcccccaaccccagctcgtccatctcttggatcattggctctgcttcttcttcttcttccacttttctatccatctatgtaactaattaaacctgtaaaatcttgcgatttgtgtgatgcttggctggagatatgattctctacatcaaccttgtgcacatccaaatccaaaagagaataaccttgtgcatatccaaatccaaaagagaatatattggtgtaatttcgattggcgacatcttagtgatgaactctcgtcgagatcgaccacaactctcgcgaatctcgccgtggaactcaataaagcatcgctaatgttagtggagacgatgcgatattgtggatgcaagacgagggtttccttgttggaataagttcatctaaggtcccttaacttgtcaataaatccaattttcgtccctcaaccagaaaaccagacacaacgggtccctcaactaccaaaaccagattaggtccctcggcggttttgagggcagttttggctgacgtggcacctacgtggctaatttaactcggtcttcatctgatgtgtcattgacatggcgcttacgtggcaattttgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctgacaaacaaaaataaacagcagcggactagcgggcctatggctccatcttcacaggcgctcaactggggtataagctaggactccacctaagacttcttctccaaagcttctcttactgaaggggggaaagatagagcaagaatgagtacaaccacagtactcagcaagtcacaccgggagatgcatgattaatgcaagggggtacaaggggataataatatgggttaagttttgcagtaaacagcatttaaaagtcacttagttgcccaaagccattttaaaaagacgatcctagagctacacagtattattaatcaaggccgtgaacccgcacgaacctgccttaacccaaggcctatgatgattcagaccgaactggcaacctgaccctaggtcccagctcgtcccaagccaacccaggccaaccattccacattttagttgttaagcaggttttaagaattaaaacactaacttgggtacattgctaggcttgcccataaccgagggcgcggctattcgaatagattatactctgatcagaggtgtacatctttacccacaagacacgtcttcctcacgtgtaaccacgtgccacataccaccacggcatacggacggaagacgtgacatagtttccaacccatcctagccatagacaagagtgccgacccaaccccacctacggccggaacctccgggacaggtaggcaggactgagcccctagcagcaggacaccagccctgtgccatgacatctcgactaccgggccgcagctcgtgtagccttcatttgtcctagagatgtccatcgacccccgacttcatccatctccatccgtgtacttttgtttataaccagactgagccacaaactaagccttacccactagacatgtggaagtacggtagtgctttgcaacagaggcccgaagaccggtccttatgtggccgaggtgctactatcaaatccatgcaccccgagcctagcctaaaaccattttgagggttttgaatagagggggaggtgtgaatccaattccacaataatccaaccattccacaatgtccaagtgaaatggatattcccaaagtctagagttataaaaccacctaatgttgcctaattaaacagcgaagcatctacctaaattcatactagtggtactatgaatagagtacccactagttggggttttgtttattctagggtgaacaaggtaataataacaataacaataataataaggtcatagcaaaggtaaataggcatggctaaataaaacagtgataacgcgggaatttaaataaagctataatgcattaattcaaataaaaataattttataaactgggattcaatatattcaaggatgatgtgacttgccttgctcgctttcccaaacgtcggcttcaacctgcacgtagagcggatcttccgaagctgcagcgtctacacgaccaacggaaaggaaaaaggcttttactctaataaactccatataacaagtaggaacaaagcacaaaaatgggttcttgacttcttgaggaaaaattagagacttgaacggtccaattccgagttcaaatggccaagttatggccatttgaagtttatatgctctttaagtgaatatttgcgaatttctttatttaaattttaatttaaaaaggatttattgcgtcagccgaggagagggggcgcgcggaccgggtccacgggagtggggcccacgcggcagcctcatggtccacggtggaccgggcgcacccgggctcacaccagccggcgccgtgggccccacgcgtcagccgtacccgagggcgcgggcggctgacggctaggccccacgcggcggccacacagtgcgcccggaggcggccacgacggtgcagccggcgggaggcggcgcccgcgcccctatggtcaccggcggcggccataggcacggcggagcggcggccgagagaggggaagggaagggaagggggaaaagaggcggcggtccacggcttaccccgggtcgacggcgacgacaaaggaggcggccggagcggaggaaggcggcggcgcggctcgggtggactgggacgatggcgctccggcggtcggcgagctcggcgaggtggtggacggggtcagcggcgatgcgacgaagccggagaaggcgacgccgaggcgggagacggtcccggcgagcggagagggccggccggaggtcgtcggcgacagaggagagagaggacgacggcgcgagctcgattctggcggggagacggtgcggcaagtggcggaaacgggcgagagaggcgcggggagggtttaaatagggttgggagggagagagggcggccgacggggaaggaaaccggcgcgggaggtctggccgccatcaatggcgccggcgagatttgcgggagcaaatccggccgtttgaatgcgagagagagagagggagaaatggggggaaagggggaggggatcacggggaataattcccccccccccacttaattgcacgcgggggcggcgggatgcggcggattcggcggcggcggcggcggcgctcggcgcgggcggggcggcgagagcggcgggaggacggggatgacgggtgggccccacccgtaagcgagggtggcgggcaggcccgcccgtcagcggcacgcacgcggggagagaccgaatgggctgcgggggagaggagagagaggaagggagatgggtcggattcggcccatccgaggggagagagattttagggtttttctttttataaaaaccttttcaactttttttatttcttaataattattatttgtgctctgaaaatttaagtaaaatttgagggctctttttagaccaaggagaatttaacaaaaattctccgggtcacattcgaatttttcttgtacgcattttaatgtttgccaatttctttttgaattttaattaattttattattccttttagagaatgatttttatttcgggatgaatttattaggacgtgacaaatttgatcccaaaaataataaaaaccgtgggtcctacatgtcggtctcacatagaaaataataataaaaatagtgggacccacgtgggcctgagggcactcaaccgaggccgtagaaaccagaggagaactggagaaaaacaagatgccacgcctacgctcccggcacgggacgaacccgagaaacaaaggagagagagacctatccactcctccatgcggcatcgcacctcacttcccagccactacttaccagttgccaccaccactaccacccacaccgaactaacctcgccgtggaaaccaaacccccgcgcccgaccaccacctccctcctcccacctcttcttctggccccaccgcgcgccgcggcagacctcggcacggcgcgcgtggccgtaccatgccgtgacggccggaacccgccaccgccttgatcgccgcgcatatgcaccccatggccgtggcagtggccgccggaacagccgccgtctcatgcccgcgcctcgtccccgagcgtatccccctctccgcctccgtcgccgtcacatgtggccgtggctgcggggtggcggtgagggcgcatggccaaagcgcaacgcgtcgcggagagaagctatgcgacgaccacgacggccatggtggatgccagtgcggcggctggtcgcagcagcgccgaggagcggcaacacgggaaggggtcgtggagtggagtagccagaaggaggtggtgagggcgaggagctcgcccgccgccgctcctcctctgctccgccccgccggcccgcgcccgcccgctcgtccacgcctcgccgccgaggtgctgtcccgctcgtcggcctccccgcgcgctcgccggcctcccccgagggagcacccaagatagagaggagttagctcgagccgccgcagccagggccacctccccccgccgattcctcttccgccctcaaccgccggagccgtgcctctgccgctgcgcgccgctccctcctttggccgccggccgccgcgtgccgctgcctctccgtcgcctggagagagaggagaggagagagatgaagacaggggagatggggagagaggaagaagaagatgaagggtgaggatgacatgtggggcccacgtggggcccactattccggatcgaattgccacgtaagcgctacgtcaatgccacgccagatgaagacctgagtcaaattagccacataggcgccacgtcagccaaaaccacccttaaaaccacaaggacctaatctgcaccggttttaatagttgagggacccagtgtgtctggttttctggttgagggacgaaaatcggattcggattcgtcgacaagttaagagacctcatatgaacttatttcttccttgtttggttcgacctcgatcggggttgagtgggctgtggcggtgaaatcgagcccaaatcgacagttgcagcatggtccaaagcgagcccaaaatcaacaagaaggccggcccaaaggctgaggcccatggacagctgcagccatcaaagccgccccaccaacacaactccccacgaggccccgagcatatcatcgccttcgccgcaaagtcccaacactagcggcgaccggcgaggactccggcggcgacgtgggtgggactgagaagcgccgccgctgacaccagcgagacgaggcggcgacctccgttgacggtaacctacctaccaacctcgccattcctctccaaactgttgtgctgctgtctagatctcccacactacactagttactcctcgtagatctcggctacctggctcaagatccggggtcagatccgggtccggggattttctttgtgccctatggctgtattttggcgtctgtggctgatgacagcgtgtgttctcgagtgcggatgcaatctgagttatataggcaaatggccttgtcaactcgggcagcggcattgctttgctcagtgtgtttgaatgtgctgaaattcatgtagtaggctgtaggctgtgcatttcttgatttgcgtcttgcataattcactggtggattttctaaacctaacaagtttaaaattagaccattcaaccaaagacaggaggaataagtgaagctgttgtagtcacagcttatggccgatccaaaatttgttaggaatgtgaatatgtgatgctacaaacatatccttgtaagctaccatgctatttatcatgttccatcatggtgattggtgagcactcatgaaaaattcagatccaaacctagtgttacatgtggatttgtgctctgcaatctatcgccagtaataaaatggttgagtgatccagctactacaaaatcacattgcatactttttttttttgtagattatgcatcctggttttgggtggtgggttcctgatgtcaggaatataaatttagcctgctgatttaggtagcactgccggtgcacactttggtttttgaatacttgtagtcttccagcttcttgtagaactggtacaatgtgggccgtatataagaagggctgtcaactagcacatgctcactaattagtctaaacatttatgtttttattcattcaggtcaggtgcaatcatagaagtagttaatgacaatactttagttgttctaatattatttatgtatggactcaaattaacatgcaaaacatatgagattagtggcatgcattctttttcttaatagtggaaaatacgagataatgataactgtgaagctctgttagtactcttcattactctatttgagtggcagcatatctcatgctagccataaagcaagttctagacgtattctgttgttaattacttgtagctatataacccaacctagtcattccagcttatgtctcttagagatcatgtttattagcacctcaagatttcctctgcacagtatagtaactatcgaaaaagatattatttctttgtttttaattgacaaccttcacgtgctacttatttttgcagagtaaatctataggaaatggctgacggtgaggatatccagcctcttgtctgtgacaatggcactggaatggtcaaggtcaggaacttcatcttttaaaccatctatcatctccaagactccaactgcatttttaccaatttgaattccttaaaattttgcaggctgggtttgctggagatgatgcaccaagggctgtttttcctagcattgttggtcgtcctcgccacactggtgtcatggtagggatggggcagaaggatgcatatgttggtgacgaagcacagtccaagagaggtattctcacgttgaagtacccaattgagcatggtattgtaagcaactgggatgacatggagaagatctggcatcacactttctataatgagcttcgtgttgcacctgaggagcaccctgtgttgctcactgaagctcccttgaaccccaaagccaacagggagaaaatgacacagattatgtttgagacgttcaatgttcctgccatgtatgttgcaatccaagcagtgctttcactctatgctagtggccgaacaacaggtatgtgatgttttacttaacttctttctttccaatttcttggttcttttgcatctatagattcatttagatgagagctcggatgattaagaactattcttatacatttttaatgttggtcagtaggtgttagaattatattatctatgctcaataatagtcgtgcaattatttaatgttggtcagtgcatatggctaatgctgttttaatcaacaggtattgttctggactcgggtgatggtgtgagccatactgttcccatctatgaaggatatgcacttcctcatgcaatccttcgtctggatcttgctggccgtgacctcacggattctcttatgaagatcctcactgaaaggggttactcgttcacaacctctgccgagcgggaaattgtgagggacatcaaggaaaagcttgcatatgttgcacttgattatgagcaagagctggaaactgccaagaacagctcttcaattgagaagagctatgagctgcctgatggccaggtgattaccattggctcagagaggtttaggtgccctgaggtcctcttccaaccatccatgattggtatggagtccgctggaatccatgaaacaacctacaattccatcatgaagtgcgacgtagatatcaggaaggacctgtatggcaacgtagtgctgagtggaggcacaacaatgttccctggcatcgccgaccgtatgagcaaggagatcactgcccttgctccaagcagcatgaagatcaaggttgtcgctccacctgaacgcaagtacagtgtctggataggagggtctatcctggcttctctcagcaccttccagcaggtaagtccttatcattacagcttcttagatgctcaccagaattagttcataactacttcataaccaatccattttgtttatttgtccacaccaagttgtattttaatggttttgctaatgcacatgtgatttgtttgcttggcattgataaaaacagatgtggatatcgaaggatgagtatgatgaatctggcccagcaattgttcacaggaagtgcttctgagtttctcatgctgccctgtgcgtcggtttgtactagaggagaaatagttgcctttatgcagccataaactgcctgtgaattgtacgtcactctcttatgtggttggttgctccagatatcgttgtactatgttcttagctctgtgactgtgaggtcacctctggaacttctctggcttggttggttggatggagttgtgatagctgatagccctggtgttgtttggggtacaaactcatgtggaattttgaactatatatatccgtgtctggtcatctggtgacatgtttgatgcgtttctagtatacctaccaaagtgacaaggcattttgtcccggatggttttcgcattcttattctaagggccgtatagattacctttctttaccagacttctagttttttttttttgaaaaaagaacttttttatctgtatttcgtaaactctaaaactttttaatgttccctccatttgataaatcattttgatttatttttatagtcaaatttctttaggtttgatcaaatttatagaaaaatagcaacatctatagtaccaaattagtttcattaaatataacattataatatattttgataatatgttcattttgagttgaaaatattgctatatttttctatatatttgactaaactttgaaatgtttgaataagaaaaaaattaaaacgacttataatataaaacaatatatagtaattcattggttcgtgtcctcgagtaattatcataaattcaatttcatccattatcctattttagactactctaagcatcctttggaacgaaggaaggaatttgaagaaaaaatatgggaaataaaccgatatacccatgaaatcgtatgggcccttagcaatttggtggacgaataccgccctgttaagtataagaggattaacacttaaagaggcaacgtgattagagcgttggctgcgtgattagctggtgttggttctagaagcagggcagcttaagaaggttgtacacgtgggcaaccgcccatctccttctcccttgtaatccgttggtttgattcgattcgctttcccactagccgagccccatcgatcgtattcgcgtcaagcttcttctcttcctctccaaatttccaacctctccatccatccatcccgcatccgattcttccaaccaatctcatcttcttcctcctcctcggcggctcgccgattccccgacggcgatgaagatcacggcgctgctggtgctcaaatcccccggcgacggcgactcgtcgtcgggtggcggtggcggcgagcaggagcaggagcagcaggcggcggtggtggtggcgaacgcgaccgacgtgagccacttcggctacttccagcgcaaccccgcccgcgagttcatcctcttcgtcgcccgcaccgtcgccgcccgcacccccgccggccgccgccagtctgtccagcacgaaggcaaacctcctccccttctctccttcgctcgctctaaactctaaaccctactaacaacgaacgattttacgatttgcagagtacaaggtgcattgctacaaccagaatggcctctgcgccatcgccttcaccgacgaccactaccccgtcaggagcgccttctccctcctcaacacggtaactaacccctatatggcttcatccaattcaattcaacctagttattatgcttacgattctccttgcatagtcattctgattgacccactcaattcaacctagactgctccaagtttgacccaaacttagtccttccttctctagtactaggagattggatcgagtaggtgcaatgctttcctgtgtgttctcaccttcttctgttgttgggatggatttgtagcctgtttgtaataatttcttcgctagctgttgtgaggttctgtagtaatttcaggcagccttcacatagggatttttctggcgagttgatactttcaaagttattgcttctatttttcagaaggaaacaatgtgattgttcacttattttttttgtctgaaaggttatgtgttccttttgatttttgcaggtgctggaagagtaccacaagacttttggggagagatggaggacagcaaaaactgataacacccagccttggcaatacctggatgatgccttgacaaaataccaggtttgtccgtttcatattataagtcgatttgactttttccctaatcaaatttcgttaggtttgactaagtttatagaaaaaaataacatctacaataagaattagtttcattaaatgtaagattgaatatattttgataatatgtttgaatatattttgataatatgtttgttgtcttagaaatgttactatatttttctataagcgtgatcaaactttttttaaaaaattaactaagaaaaaaagtcaaagcgatttataatatgaaacgaagggtttactaatgttgtcactgcttgagtaagcggttctctggggattgtagatttggaagaagcaaattcaaacctatgcaggttgagtgcatgtcttggaattcttcgatcatgaccatttttattcggcttgaatagtacagcagtaataggatgtgtctacactaaatattacaaccaaccaacagaagaagcaatggcttgccatgctcatgcctatgaatcacactgcatcctgttatgtgaatgaactgcttattaatgtagcacctttattctagtttacatatattcttgtattattagagattaggacactgaaataatcaatctcttcatatacatgagatgtccctgtatcattattaaccaagggacaagtaatcttttgccatccatcctacggtccaatatcctttttccactgtccttatacccttgaagccatgctttgacttctttcaatgggaattgtaaaattgtgtaatgttctca

SEQ ID NO: 36519 - DNA, 2087 bp, Oryza sativa
cagataaaatcattattgtacgtttagtttttcagttgtatttttctaaactagagcatgtacataaagttgtggccatattattttcttgttaattgtcaacggtgcaccgcttaactgatgcttgtattgttaaacatctaatttcttgcttcccaattattattctgcaggatcctgcagaggctgacaagttgctgaaaattcagagggatttggatgaaactaagattattcttgtaagtaactctatcgctcatgaattaatatatcctgattgcaatttataccctatgctggcaatggcatattccttatttcagtgtgcatggattcatgtttctgttttcagatattagtattcagcaaagaacactattggtatcttattttaattttgcttaagctacaagtttgaagtatacaatgagaaattttgatatgcttttcctgttggctgttagaaattagctcgagcaataaaatgtgtggttggtgttttatattattgtgtgcccggtagttatactgcaaattcttgcacgccattcaatttaaataaacagagggaaatcgaaccgtagtaagttctttttgtcctgtggaactgtgtatagttgaatgcgctggaccaggtgttctctatttttctggaagtgtctttttccccacccacgaataactttttaggcttgttttggttttgctctgtttgtggcaaattattcatttgttatctttaatttggataattgcagcacaagaccatcgatagtgtactttctagaggtgaaagattggatagcctagtggagaagagttcagatctaagtgctgcttcacaggtaggtattatgatatggcaagtgacagatcatgggatacagatccactctatgtttctgcttcagtgatttcttttttcagcgaaatgaaacctgtttagttaactctgcacgtaacaattgaactgtaaatcgttggatccctgaagctttatgtcccttctaattgggaaatttgctcctttgccacaaagttgttaggccttctcacttttgccttggaactagtacccagtatccaccaccagctgctggttgtagacaacatctaagaaaatctttcctagatcatgctaaattaacatatataaggaatgaatgaccctttcattcagtgctatctgataatattttctgttgttaatcaatcggttcagttatgatcttttgtgctgatttgtccctccttgttatgcagatgttctacaagcaggccaagaaaaccaactcttgttgtacaatcctgtaatagaaactctggtatagagttctgcagtagcacactatgttggcattttctttgctgcaagtctgcgattaatgtcatagcatcctggtgtccgaggtgttaaacaaagttagcggttaacatatgccacagggctaccctacgtaatttttgtaagtaacacaagtgtggttgccattgagatgatctgtgcctggtactgtgtcaaagctataattagtgatgaaattgtgtactgtcatcttgacccccaacttcattaacgatgcaagaaaattgtataaagacccgaacatgaggatcatcatgcacataaaaaataaatggaacagactaacaaaaatataatagtaaattttataaaacccaaattgggacggatgtaacacaaaaccaacatttacagtcaagtgacaaaaacagaggaaatatttataggtaatgacaggttaaatctccttcctggttcatgtcaacaatcccagagtacagcacatgtcaacaatgctagagtacagcaaagcgagcgcacctagctaggagtactcgacaagaacatggagtactcgacaagaacatggaacacgaagacaatagctaggagtccatggagtactcgacaatagctaggagtactcgaacagagacatggagtactcgacaagaacatggaacatgaacagagaccgtaagactgggtaggagtactcgacaagaaacatggagtactcaacaatagctaggagtactcgacaagaacatggaacacgaca

SEQ ID NO: 36520 - DNA, 1618 bp, Oryza sativa
atcgatggcatggcaatcatctagagtatttcctttgaggagaaggaagagtggatgtctaagattgagtctagacaagggtttcactctaagggcaattgtgacattttcttagcgatcttgggctataattctataaacagagaggtggatgcaatgatggagtgtgcctttggtaatagtggatgcaacggtagagtgtgcctttggcaatcttttgagtggttttttgagagagttttgggtgagttatgcgtgtgttgcctttggggcttttttgtgtttaaatttacatttaagtggtgtatgtttgctcctcttgagcggttgtacttctgatccttcagttacttccctctaaatgtttttggaaaaagcatataagtgaaacatctttggtaaaattataaaactaaaaagaaaaatgaaacaaagataaaatatataatcacgcaaaccagaaagacaatatttttaaaataaccaaaaagtacatttttaaagtaatcctaaagttatatgtgaagagaaatagaaaacatgtttttatgttttttcaactagtagtttttatctttattcttcagtaacttaatttgagcatataactgaaaggaaaatgaaaaaaagttaaaatagataagcacgcaaaccacaaagataacatttataaagtaactcaaaagttatatgtgaagagaaatagcaaacctattttgttaagttggtagtaatctaggggaagtatacttctctggaacactatttatgataaaatttctgaattgcaagttgatagtaatcgaggggaagtatacaatagttagtgtgaaattaccatctaatgtaccatcattctcaatttcataaaaatatcgatgcatatggagaaacgacagcttaatgttatcttccttaatgcatttagagttatccaaaaaaaaaaattcaaatcttcgtccaatttattgttagcatattgctcaaagtatgtattgtttacttgctgctttgacaacttagtaatgaaaacaagatcaattagcaacaagataattagttaatgtaaataataatgacaggtttttaacgaatccaacatacatacatgcatataatatactccctccattttaaaatgtaaaatgtatgacgccgttaactttttgcataacgtttaaccattcatattatttaaaaatttagtataaatatgtaaaatataagttaagattatattttatttaatgataaagcaagtcataatgaaatagatcatatttatatagttttttaataaaatgaatgatcaaacgttgtacatacattttaaaatggagatagtatttgtttatatctggagtacctttagtacttgatgcgataaagcgcatggcggattaagaggtcctgaatttgatcatcatcagtgagttgggtatcatcatgaggacgaggaggctggcgttcgtctggcgtggcaactgatagaagtaggtatcatcatgagaacgaggaggctggcgtggtagctgatagaagtaattgaggaattcttcgtcaatgatgctctccaccaaaccaaactcgttcagctcttggatcatacgctctgatt

SEQ ID NO: 36521 - DNA, 2546 bp, Oryza sativa
cagttttgtcacattctttttcagcacaaaaaagtaaccttgcacctaccaaagaacacaattatgttattttatattaattagttctataaaataacataaacatgtataaaattgtttacaattctctgtcaaatttgtttagtaactatatgcaatactactcatctgcagataacatggcacctgataatttgattattgcattaacaccaaagaacgataggtggaaaatcaaagtaaaagttactaggctatgggatgcggttaatcctacaatggctgatgatttctatggtatacagatgattgtactagatgcagaggtatgattgttgtaaacatgtgatttaatatattgttctattgtgtaaatacaatctttttggtgcagggcaactcaattagagtaaaagtaaaataataaaatactcagaccatgtgacaagttataatgcacgcataatgttatgatgccggactaggtcatcgcatagaatataattatgattttaatgtttcactgcttaaatatgttaatgatttttaagataactaacgctcaacatttagttttgaaaatatcaaacactcatattcaaaacaaaaggatatggttgtataattttatatgatattatcataagtactaaatattttatggacaaacatcgtatattgaaactattattaattaacatcttaagtaaaagtcgtcgcatatctatacggcaataaaatcaataaaataaaaataagatgtccgtgcatcttttttttccttcacatagcatcgaggcaatcaagccactaatgcaaaggttggttattatttgtgcactgatggatgataattttatcttggtgggttaataaattttaaattcccgtgtttatgtacacttcttttccatactatattttgcacatacatttcaatcatatttatgtaccttttctattttcttttcaaaatcctatgttacaaaggagtccctaaattctttcacggatagacaaagtcataatatttcacaatcctaataacaacaaaaattatgatattttaaataagatgcccgtgcaattgcgtgggctaccttcctagttaggcttaaaagattcgtctcgcaaattagtctcaatctgtgcaattagttatttttaagcctatatttaataatttgtgtaagtgttcaaacgttcgatgtgacagtgtgtaaaatttttatgtgggaactaaacagggccttacaataaaattggttatggggtagaattctagaatcttgaagcaagactgacagttagaatgttttatgtaacttataactttttaagtttgtttggcattaaccattaactgtcttgttttaatcttagttattggttacaactaggtgattccccgcgctttactgcgggaattactaagtaattattaatttttttgacagcaagttaggagtaaaaagaaaaaaataataatgaaacatcagggtttatcaatcaaataataccatgcttcaatgtgaaacatattgataagtatatgttaaatattataaaagtgatagatagatttgttaaaatatcgtgcaaatgatatgaggggtgatgattcaaggtttcaaacatgctgaacatgctgctacccagtcaagtgaaatgtccatgcatgtttggttttcaccttaatattgctatgttgtaggaagcaaacttatttagcaaactgtaagtttttattatactatgcaacaggtaggaaataataagaatacctggtgatcagagatcttgacaggcaccaggaagaagtcattgtccacctccatagtatcctttcccccagccaccacctctttccgcatcttggacaggcggggatcgtctttgtccctaatcttcgtctgcagcacaccatccttgaatagcttcacacaaagtagcgaaagagagataatgccagaatagattgctagtgttgcccagcagaaaaaggaaagtctgtaaattcattctcacctaagatgaacaacagaggtctgcccccaattctgtgtgtctgcaaaaatcaccaagaaacaatgaggataatgagcagcacaaccgaattagccaaggaggaagatttcctcttgttggccaaacgaaagaaaaaaaagggcaccaattaacctgcagcagtagagtgggcgagcttccaagagagaggaaccgatgatagcagcacgagcaacagaagcaaaggcgctgctgcccttgtccgtgtccgccgtcgtcgtcactaccgccgccctcgaccgctgccaccgccctcatccgtgtccgccgccgccaccgtcgactacagccgcctcgtcctcgtccaccgccgccctcgaccgctgccgcctccctctcccgcgtccgccgccgccgccctcgtccgcgtccaattccgccgcagtcgccgcgctcgtccgcgaccgccgccaccatcgacagagtccgtcgccgccgtagtcgctgttgctgtcgcgcgggggggggggggggggggg

SEQ ID NO: 36522 - DNA, 26024 bp, Oryza sativa
gggcgatacggtgcgggaggcgatgcggtggggagcgaagggaccgagggcatgctccaaaacgcaatgaggaccactgagatgtaatccaacagccgataattaaatgatgacgtggcttcaccaaatctcagctttgggtcttaattttatagaaagaagggattaggacaatcgatcgaatcattagatccagagaggtgtttttaccattcaactgcaataccaagtttactgaacctacaggtattctttttttttccttttctgttttttcgcctgcgtaatttgggatcattggatgctttgttctaggtgtttgttagttctcgaaggcctgcgtttgtatttgtttgttgttcatatagctcgaatactatatgctaaacccaagaattatttggaagccggcaatagagaacagttcagatctaagcgctgttcctcgtggggctccatctcggtcggtgtctcctcagacataccactgtcaaagaaaggtaaaattcgttgccgctttgaacaaaagctgggagctgagtacgaatcacagcgacagaaaccatatttacagacaatgcaattgcaagcaagcagtgacaggtttatatctaatctccttcttggttcatgcaaattaacaaattctactacagagtgcatcaatcgaggagaggctaggatggtcagctcctccccgacaagaacaagatggagatggtagccacaagcccaatcatggcgatctgagcacgaaccggagcagcagcagcacgccccaccacctgcagcaaggcaaagcaatgcaaaagcaagcatgagctccaaagatcgccggtgaccggtgccagtatggaatggaattcacagtgattggttagctggaactggatttttgtctccggagggaacatcctctcgctctttacgtgtagttcaaaaaaagttattaaaaaattatcaagatagattaatatatgatatattttttcacaaacatacaagttaaaattcgacctatacaattcaaaacaaaaataataaatttgactgtgaattacacgttcacttcacagacaaaattattatttttgtttctacttgtataatttgaatttgagattgcatgttcgtgaagtgacataccacatattaatctatcatactaattttttttaatttttttatgactttgtaagtgacataaaaaaacgagggatattctcttgagggatgatttgagttttctttgttagcttaatttagaggttaattaccttgtcgttgccgtcgcctcggtccgggagcgggagcacggtggaggtgtcggtcatgccggtgggcagcggcaccgtcgggttgctgccgatgaacgggtagccctcgccggcggcggtcggggcgacaggtggcgccgcgacgccgaaggtcggctggagcgggaagccgaagtgcgggggtgcctgcttgggagcgcggccaaaggccggcaggtcgtcggcgccggcgatgggcgccggagcgggagcggagagtggcgggaggccgtggccggcggcggcgctaggcgaggcattgccgccgccgacgtggtggcctcgtcgtgtaggaggatgattcgggtgccactgcgagggaacgtcatattaaaaatgttactactagtactacttttctttcaaatgaaatttggcaagtgtagcatggatttgactgaaaaagaaatgcagttattcaatcttgaatggaatttggcaagtgtagcatgcatccttgctgcaatgtttggtactcctaatttaaactcctggagtatagtaaagcatgcatgcgatttttagggaatgcagctcagctagcagctatagcatgtgagcttcagcagagcgcatgaaagaaagcaagaacttaagaacagaaaagtttcagtttggtctcaagtttcgcgaggtgcaaagcggttgacgcaagtgagtagtgacgctaaaaattgtgaaatgcagaagcaaatggtaccccatttcttgtagctaattaattaagaaacgatgagaaagaatgtgaaaggaagaagatgagcgggttaccgaggaatcagccgcggcggcagctcgagctcggggcagcaaagacggcaagacaaccaagacggcgaggtgaaagtgaaacagcagggtgaggccaccgccatgattcctcctcttctccatctctggctcttgctcctgtgactgtgaccgtgagtctgagtaaataattaaacagctctgtctcttggaggagacgagggtagctgctgatctttaattcttggtcagttgcacttaactagtgagtgatgagtgattcagagtgttgtgcagaatagagagctttgtagccacaggaggccaaggagaggagagggaatggtgatgataatgacgctacagtggctacggacgcagctaccatgcaatctacacactacagtgactctactatcgtgcaaatgtacaaattgcacagtacacaatacagtgagccccaataccaaaagctataccaatagtatagtaaagcaaagctttctctcttcatctctctctctccctctctatgggctgcagcaacgaggccttggaatctctgtgcaagtttctgcttgctttgtttgctttgcttttggagcagggatgagtttacaatctttttttttcagcaatctttttttctggcatctttgccttcgtaggagtatatcattcaggtttgaactcatccggaaggaaatgactggagcactgcactgccaccactcactgcactttcatccagtcatagtgccagactaccagtacatgacatcaattgactgaggatttttacatcaatgcagttttgtgcagtttcaggcaggcagcaaatgcatcttttcttcagttaattaagctcatccatgtctctcctccaacagtctgcatctcgacaagtagaagaaacaaacagttagtaacagcaagagtgctgttttggaagatgagttttgactagttaaagcaccggctcttgttaaattactcataaaggtgtgctaaaggtaagtaatgagatgctaattacggcgggaggttcttttagttttaccggactgcgtgcctgtcctgaactgtctcaacaccgtcaaaccgaatggggagtaacaggcacgtagcactcgcctagttttgtcttccagagaaatggctccacattgcttaggattcgaagtagtcttcttgtttttaatcaaagccgtgatctgcaactttgtaataattgattatatttttttaaaaaaggcagaataaattgtactattatctaaaaatttgagttgccttgcttggatagacattactatttggtgatgtctggattggaatttggaagtggctgtagagcaggtacaatagcaggctataagccagctataaatatattttaaacagataaaggaaaaaagagaaaagcaacaggctacatatctgtaattagctgcagcacggactccaagacgtaatatgtgtataataggtgggaccagatattatattggctatggatgatttggagccagtaattagctatactattaaacttgctcgtataaagaccatcctctgtaagggcccctttgaatcgtaagaataaaaaaacagaggaataggaaaaatataggattctaacaggaatgtaagtgtaaaacaaaggattgcaaaatacaagaaaaacatatgaatgatcgtttgattggatcataagaaaaacacaggaatcggatgagagagatagactcaaaagatttttaccaagaggttggacctcttgctaagttttctccaaaacttacatgcaataaaccattccataggaattttgtaggatttgaaaaacttcaatcctttgaatcaaagggctacatagaaaaatttcctataggatttctatcctatgaaattccttcataatttctttaattcaaaggggccctaattttttttcttcgaaaacagagtcctctataagttagagtagtacaccgttctttatttcagtacattcatttttgaacggaatttcagtacattcatcgatccgatgatacaggatttcatgtacgtacaaacatacatatgcttgatatgcagcacatcttattgaacggagcatacagttactgtataaatatttattcagtagcggcgtacatacatgatatacggggtgtgttgattaatcaaataagttgccgtagtagtagtagctagccgtgctgcggctgcggcatcctggcgcaggggcgtactgctccttcgctttgtgcccctcgtactgatctaacatacatggagtatacatgaacagattcagttaatgtacgtatacacgcacgatccaatcaagatgagacgacataggtcacgttagctcgaatgggatatataatagggtttgttggaaccatgccaccctaattttataaaatttaagatatgtcactcgtatcttaatgacatgtaggacccacatgagtcaatgacatgtgggtcaaggttgcatatcacaaattttgtaaaatttgtgtggcatggttcaaattttccctatataataatgcatggtgtccatagcttagagatgatgaatcagtattgtagacattacctgagctaaattaaggtgttagtacttaaaaaagaactgttcgatattaaataacaggaaaaaaatattttaatagcatcgaaagttcacgattttaaaaatatagcactcaaaggttccgattcattttaataacatcgatagttactctctccgacactttatttaccatatcggtaacatttacttttttgtcgtatctcaatttatgtcatcaagtttcataaaactacactattaattattttaattttgatctatcacacttttaagttctacaaatcttttgagtcgttttatctatcgtatttaaatgttatgtccatgtaactatagtttttaaaattttgatatatacaagtatgtcaaattagtttacggtgtggttttatgaaatattaagagtataatacatgggttatacgtacttatgatcttgtataacttggaacatagtaaataaagttttatgaaatttaatcctaatactgatatccagaagtctatcttcttttttactggaaatcattgaccagaagtcaataacggttgagaaataaccactgtattaatgtattaatggtgggtcaagtataggttactggctaccaaccactagggagagccctttctgaataattgcggccatgcgctcctgctgcttgtgggagtactcctgatcgccggcgccgccctgctgcgaggtcttcttgctgctgctgccatggtcctcgccgtcgttgccgccgtggccgtgcctgccagtttcgtagtactccgccattctctcgtacgtgcagctaattaactctcaggtggtggtggcgaaagtattaatggatatgacgtttggatgatctcgcctttgttaatacagaggaactattaatcctgtaacttttggatggttaattattattatgagctagcttataatttggatttgtatatatatgtacaaagtacaacccagctgcatctaagaaaacagcaatcttaaggaaaagatgcatgacaaaaggttatcatgcagccatcagaatttctggtactaacattttacctcctactatggcagattcttactatccttcaccttagctaacatcgcaagagtcatctatatatgctgacatactgatgtgcagtgcatttatgcatgcatagttcttaagattcttgtgctcgttgttttctcgatctcttttcgtaaaagggtagtatgcgctcggtaataattcaccaattggggcatatcagcacttatttctttttctatgctccactcggtaaaagttattctcaagtcattaatgacagcacaattttcatttcaccttttcttcttttagcagcagaattttacgtcttcagtgttaaagaaaacatccacgtcgtctctaccacacgtccttattatgacacaaattcttcatgctgggtcatatatagtccacacatgtcaacaattttccgtaggtttagaggagttgaacaaaatgaaaaacttggcttaaacaaagtaaatgcataatactactgtttttttaattattaatgatgtagtcataggtgaacctagaaaaaaaatcctagccctacatatgtgaaaagaaacttttgaaagaaaaataactccttattagtatattatgatagacatttgatcaatttatacttctatatcatgatgtgcatttgattaatttatacttctaatcttattatatttacgatatttaagatatagaaattggatcacccatataaaaattctgatacactactggacgtagttgattttttccctaactttgactaacagtatttattcaattacctttttataagtaagttaaaagaagtaccattagatataccatcaaattaaaattgagtatcttaaacatcccaaaatacaaacatttattactataaatctggataatcgtgcatttagattcatattaaaagtcgctatatttatttttttggataaccgtccaaaaaggaaatgatggtgactgtacgaactcatctatttacatttttttttctagctactgctccataggatagtcgtacatattggtttatcattaggaaaacactggtatacgttataaaaagaatcacaattaatttggcgcgaacaattaaaagcacgcgtataattcatcacggcgcggcccagcaaggtcagccagtgtttgtccgtcccaatttctcatattgggccatttccggcgtgcggcgattaggcccgtgagaaccaagactgttggatccgctgttctccatgcggcacaataaaagttcgcctgttacgtacggcccatcgctagatgacggaggcgccgccggcgatggagacgacgaaccatgtataaaaacctttgacttttcgaacaatatttttaaatataattatatgttaagactattctttcataaaataagtcattacaaaatgaataatatttatatactttttaaaaagatgaatggtcaaattatcacgttattaaaggttaatgcgcgtcaaacattgaaaattgttgggagtactatttccgtcttaaaatttaagaatttaggatcagatgagatgtttgaaacgttgatatcttataaaccgatttaagggtctgaccccagacctctcattgggccacgtggcatcgcgtgttgccctctgtcgtgattctcggctggagaaggtgccacgcattcgcacccctccacagccgttagatgagatatcaacggtgaaaaaccatctggcggaccttgatgtaaattgtaagttttgacaggggtttttttcaaaacgtgtgatcttaaccggaagagtctgggttattagagaaaaatccaagggaaaaaaacgcaagaaaaatctccaactcattgtgccgccgccttgcgtcgaaccctcgatccacatcgttggcgcctgcttcgggcgacgaggaggggtggcagcggcttgatctacacggactgctccacctacgggggatggtgaggcaacaccggcggagggagatggaagcccccttgcgcctcctcgatgtgctcgagccggccgcctctccgcttcaggagttcagaggatgcggagggcgagagagtggggcgggggagagaggaagctgagctcgacgatgaggctgatggccagcgacggatggagcagttgagccgcggatttgcccatcatcgccgccatcctgcgccgccagtggtcgttcccactgggccatgtacctgctgctcatgtgctcctgaaggtcgccgtctctgcagccatcctcgcgtactcgcgtggttgtgggattgggaaacgagtggttgtggcttcatgggaaacgctgctctttcctacatgcacagtagtagtaccctggtctgcgtttctcttttttttctttttatttacaactattcacttcaaggctgcattaaaacatacccctataaaaaaatacagtactaccaataaaaaaagacaaatattatatgcccctatattacttaggtagttaggggttgtttagatcaaagagttttgatgcgtcacatcgggtattatatagggtgtcacatggggtgttcggacactaataaaaaaataattattgaatccgtcagtaaaccgcgagacgaatttattaagcctaattaatccgccattagcgaatgtttactgtaacaccacactgttaaatcatggagcaattaggcttaaaatattcatctcgcaagtgtgcatttagttaattttttagcctatatttaatacttcatacaagtgttcaaacgttcgatataacagggtaaaaaattttgggatgggatccaaataaggccttagaactcaaaattaaagctaaaattaaacttacttctaaagttgatttaaaggtatttttaatgtagtttctacttatttgtttttaagtcactaacaatacatatttttattttaaataagccgttttggtttattagaaaatatggacaatcgatgagaacattaatctatgtttgacagtgtgagaaggtgaaaagaaaatctcattttccgcatgtataccacccgaactgataaatgatatttttttcaaaagaaaaatctataggaaatttatttaaaaaccatattaatccattttcaatgtttaaaataattaatcatcattaattatatgctaataacttaattttgtgtatcatatcatcgttcttttttctcatttactcaaacacactttgagtgttaattattttgggataaattttaaacccaaaagagcatttttttttaatggatggagtggattagaatgcaaagtgggctaatagggtatttgtgaaattaattttctcatctatgggttctacagtaaaataaaatggtaaaccgggtgtcacccttcgtccaactttttcacttttgaccgggatacttttacctttgtggcattttataccgtccttagctattttatcgtatacaactatattgtcgtatgtcaaagaaacggtgtatatatagctgagggagtttattgaccaataagaccagaagtattgagatcattcatatgcatgagaagagagtatcaaaggcaacatcatccgatccaaagtgaaaacattgattaaagggtgatcaaaagcgaaacatcggtaataaaagatgacccaagtaaaaaattactccaaaaagaattttctagaaaagttatcttaaaacatattaatccattttttaggtttgaaataattaatatccattaatcatacgctaatggcgtatctcatttagcgtatcttatcattcttctcttttcttcttcacttaaacacatccaaatgagtagttatttggggatggagacagtaaattagaatgtgaagtggcccatatggtatctatgtaattaattttctaatctatggtccccaagggtaaaaagaaatcaagagaaatattaattaataaaataagaggataaggctacgataaggctattgtgcatcgtgaaacactttcattgtgaataactcgaagtgcatgatcttcacaagaatttgatgaaaatttgagctaattaatataaagtctagcaaaatattagcattaattaccctcagcaattatacaaggcatagagagcagcatgtcaaccagcacctttattttcccaaagagctggctcttgtcttattcaagaattgttaattatatcgaagatttggtaaatagtattcacgtgaagagtttacatgattggccaaataaaatattctgcatgctagcacattaatatattctacttattggcccgttatgcggcaaagctgtgtttgttttgagatgttattttgagcttagatttttctttttaccagttttcatttatccaagtgtaatatgtttgttgagaaataaacatttctagaatttttttcccaaatagaaatattccaaaaagaaatatcaccaattattgttgcttggttcattcttattccatctcatatatatatctaagaaatcaaactaattctaaataactatacaacatttatatatcctagaaaaagtacaagtattcatgggatatttttttagtttgtgcgccaaaggcgcaccgattttctagtattgtactagagaaacatcatatctaatactccctccatcccaaaatgtttgacgccgttgactttttttaaaaaaatttgaccgtttgttttattcaaaaaatttaagtaattattaattcttttcctatcatttgatttactgttaactatacttttatgtctatatagttttacacatttcataaaagtttttgaacaagacgaacgctcaaacatatttaaaaaagtcaacggcgtcaaatatttagggatggagggagtacgaggaagcagtttctatcatcacggtagaattcatcgatccgatggccacacgtttacagaaatcacagtacatatatagatgtacgtacacacatacactggtttggaataaggcgcgcggccgcggcggcgaaattgtgggtgagcaacgtatatacgtgtacgtacgtacatccttgctcatcttattgtaccgtatatatacgtacgtagtagccagtatttatttagtggtacgtacgtacgcatggattattaataatttgggggtgattaataattaatcagttgcagtagtagccctgctgctgcggcatcctggcgtagccgtactgctgctccttggcgccgtagctggcctgcttctgctcgcggtgctcgtggtaggcgtagccgccggcgcccaccgccgccaccgccgccacgccctgctcgatcctgtgcctctgcgcgttcgccgggtccttcttcgcctggtgcccctcatactgatcatccaacacatcgtatatattaccgatcgatatatatatattcagctaatttaataagcagttttacaatccttgagaatgtattatgatgtacgtaccaaaagttttaatgtaaacgtgtggtatacatcttaaaaaccataaaattgctctaatttaatataatgctatctctgtttttcaatagatgatgtcgttggttttcatcacaaatttaaccattcattttatttaaaaaattgtgtatttatatttttatttatttattttatcacttaacgtactttaagcatgatttacatcttatatagttatataaaatttttgaataaatgaattgttaaatatgtgtttaaaatttgacggtatcatctataaaaaaaaggagggaatacatcaagaattattcgaagatgagaagatctaagacatacgagagcgaaggcgccgctggcgagggcgccgatctcgccgacgcgctcgcgctgcttgtgctcgcgctcctcccgcttgtagtactcctgctgctggccgccgccgtagccgtagccgccatggccgctctgctgcctcatcaggtactcctgcgagtgcatggagttgttcctcctcccacggtcgatctcgccgccctcgctgtagtagtcgtcggtgtgggactccaccctcatgccaccatgcccgtgcccgtgcccgtgaccgtggccgtgcccgtggccgtgctgcctgccggtggtctcgtagcactcgtccacggtgctggagtagtactccgtcattgttggtcggtttctctcctgcagctagctacttctccgatcaggtggtggtgcaagggaagttctttgctttgcttgctgaatatgtgggggtggatttgggtgctatttatagtgtggcgagtgacagtgacgggtgaagatggacggcttggattaattcacaacgatttgttgatgatcgccgctctgttaataattggcagttacttattttggtactatctccatattttaatgtacgacgccgttaactttttatccaacgtttgaccattcgtcttattcaaaaaatgtatgtaattgtcttttttttattgtgactagattcatcatcaaatgttctttaagcatgatattaatattttcatatttgcacaaaaattttgaataaaacaaatagtcaaacgttgatcgaaaagtcaacggcgtcatacattaaaatacggagggagtatttgttagctagctagctaagccttgcctgcctaattgacaccggcctgatgtaacttaagagcaggtacaatagtaggctataaaccagctgcaaacatattttaagaagacaaataaggagagagaagagcagcgggctacagatttatagccagctgtagcacaaactttaagatacagtgtgtgtatgacaggtgggaccagatattaatagtgtagtatgtaattattgtataaatgagctattagattagttatagatgaattgaagttagtagttggctataaacttgctctaaaggcgccaccacggcaggaatcgctaccaccccttggatgacacgattggatcagtagatgtagaacccagctacgtactctccacttttttttagtaacgtcattgattatataaatgatgtttgatcatttatcttatccaaaatatttatataaatgttatttactgtgaattattttatcatcaaaaagtacatatgttacttttgaaagttttttaagttataactttcaaataaaatataattatactgtaattatattgtaactagaatattaacattataagtcttatataactagtatgcaattgttgcaaaaccatcctggcgcaagtagcattcggatcgcgagtcacgagttcgatatttgccgcacacacagatgaaagcacatgtctttttttttcctactctcctgcaacatgaattttgattcatattcggtggtctaaattttgaaagtttctagtaatacttctaaaattcatggcttgtactttacatatttacactaataataagatagattgttaaacattatgtcaaaattcaacaacatcatctattaaagaacggaaatagtacaaaacaacatttgaaggaaaagatgttcacacaaaggtttcctactactagtactaacattttataccaccttcattggccaatcaatgaagaatccttcacctacattgtaagagtcatacgttgatgatatacatatatagtagtttcttaagattcttgtgcgcgttgttttctctctttttaaaaaagggtatgcgattattcaccagttgggagcatatcagcatttttatcttctttcctcgccgcactcggtaaagttattctctatcgagaaatggcaacaccatttgcatttcatcttgttcttcctctgacaagagaatttcacatcttcagtgttaaaaggaaagcatccacacacgcgtcctgacgacagattcttcatccatgtcctggatgataataatgcacgcatgccgacaattttcagaatgtttaatgaattgaacatatatatgaagaccccggcttaaacaaagtaaacgcacagcatagcaaacagtaatacagtatgatgcctttaattaaggcacggatcaaattaatatgttccaacagagactaaataaacaggaaccgaggctatatgtccaaattaattatatagtgggagcaaataattagataaatggagataattaaaacaagtctttggacaactataatgtttctagctagatacgcatttcattatttttcaactcatcaataaacactttgataagtaagcttaataatcccaattcccaatccctaagtcaattatagacggacaaaacatcgtcctcctaggtcgagcactgtatgaatatttatggcacactacttattctatactcaaccagatagatattcttgtacagatgctggaatccacaatcactcaccacatgacatcgcacaataataatggagcaatataatataatgcagcaggcaaatcacacctttagctatcggaaacgcggcccagtatcacggcccacccaataggcaacagccgaccactacgcggggcccgcgaaggtcgattgtaatgggccatctattcttcgccctgtggggattagtttgggccaatagaccaccacgcggcccgtcatcgggagtgggcccgaagacactcagtccgcgtcgcctcgcatctcccctgcagctagtagctctcagtccttgccgcctgctcgacgaaatgcctcgccgccggcacaccgtctctccttcagcttcctcgtcgacgacgaggaggatgcacatgccactgaagcgcccgtgaaacagccagacgtacgtgaagaaataaactagctggccatatagccttagtcggattgaacactcaaaggttgagttgagcgcaggtatagatcgatcgactaactgatcgacagcgaatgaaaccaaatcttattcttcttcttctggaggaactcaggcaattcagcgattgaattatcctggctttgtgaagaaagccaaagaaattaacagtcttaatccgaaccaaaccatatatacagtatagtataacattcatagtctatattacaataggagaatactccatataaccatcgatcgggtggtacacactgaacacacagtagcatacatacatacactagctaagctagctatctgcctagatgcgtctatgcatccattaacttcttattatatactcactccattctaaaatatacgaatctaaaaaacatcaattcagattcatagtattagattgcgtatgattcaacgttaagttgctatattttaagatggatgatcgaacgaactatcttgtactagtagtggtagtatatgggccgtaggtagctactggtagctggctggtggcctcctcctgctgttggtggtggtgcactgccggcggcgccatactggttcggcggccggatcatcctgtggacgatcttcacctttctggtggtggtcggtttggacataatgccatactttagcatctccttctccctctcgagcttctccacttcgggctcgcgcggccacctgcccttgctgccgtggtacccgccgatgtcgccgtacgccctcctgccgccgccgccgccgccgtgcccgtctctcctcactatgggttcgtcttcgtagtcgtcgttgtcatcgctggtgcgcagccgctcatctctttcaacgacgttctgttcgacgatctccggcacctgcaccttcgtctccaccacggatggcgtccgattgtccttcatccacacagtcatatcatacagatgagatcgatagatgaattttggttgaatttgatcgtgagatcgaattgaattacctaccgacgctacaatttcgtcgtcctcctcctcctccttcattctctctatcatctcaagctgggcgggggtgggccacctggtcttggtgcgggcaagctcgtcctgcatcctcatggcgccgtgaccgtgacccttcctcctgcaatcatcgtagtcggtgcggacgtggatcgcctcgatcgaccttctcatcgatctttctctctcgatcgtgcaccactaacaaggtgtggtgtgctcttcagctttggttgatgtgagtgccggtggaggggactatatatttgtagcgtctcgcgagtgagactaaggtctttttctttcttctaatacagtctcagtttttgttagcacgtattttaaattgtgcatcatgcaaaaactttatatatatatatatatatatatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaggtaattgaaaaagtttcatactcatttgaattgggtatatactcaatttcaacaatggtgcccgggcaccatggagcaccaaacaaatatatatatatatataagttacgcattttaaatggtgcatcacgcgaaaacgtaacatcagataaatccatttcatgagtataaaataattaaaatttaattaatcaaacatcgctggctaaggggagcgcccacaatggaaaagataattttgtttggtgcaatgcaaaagataattttggtaactggctaaggggagtgcctagaccccaaaaaaattgattttatttggtgctagtgctctatgttggtcaatttggcgttgccgtaatgatatagtttttaatcataaaagaatgtctaacatcatgcaggttatcttcatgtgttccaattggcttcactcttgttgtatgatgctttcacaggaacaccaagacactatgcgcaatggtgctacgcgtttggaattggtagccaagaaacttttattccagtttggatggcgcagtacctacagaatttcatgatagaatctacgtgattttaaaaaaactttatcttagtagatcatattatcggtagaagttgggggtttgtcccatctcatcttttttaagttattttctgttcactactgaactttttggttgtgtgcctacaggcagaggccggagatgtaaccattttcattatctaaaaaaaatttaatcaaacatcgatgactctctcgtttcgtgaacctaaacttaatcttcatcttgaagtctaccgaacgggacctaatgataatcacgacaaacggtgaggatttacttcgtcatgatgactggtgtatggttatgtagtacccgtagtggtaggatactaaggaaaagccatacaacatgcaacatggactagtggtttaaggggtaatttggaaccatgccattataattttttaaagtttaagatatgccatcagtatctcaatgacatgtaggaccccatatgagtcaataacatgtaggtcaggatgacatatctcaaattttgcacaattataatggtatggttccaattttccctttaagggaatgcggtgaaagaaaatttattgagaaaatatatttttaaaatatgaagcaaataatacatttcaataatccagtgaataaactgaaaataatggggccttaagattcccgtgcgcattgtcttatttgctttggagaaaagggatgtgcgttaatttgccaattgggaccataccaacctatttttaactgcgccactcagtaaagttattctgtgtttaagaaataacggcatcatttgctttttttttttcatcttgatcttttatcaagagagttttttcatatctccagtaggtaaagaaaatgcgagcatatcaacacgtccttatgacaaacacaggccgacaatcttgaacaactgcttgaacagagtaagggcacagtagcagacgatgttttctttacgtagttctcacgatgatgccttcgcgttccagacagggattgcataactaacaaatagaaaagaagattacaggacgacaatctgaacgcaaaacatcctcctcaaaaacagcaccaaatgcacacttcataattttctccacaaacaacagataaccttgatggagtgtctcttagatgctagaatccacaatcgctcagcactaaaatggagcaaagaagtggtcaagtgagaattatttcattccccaacatgccttaaaatactatatacatgcttcaacttaactaaaggacgacccgtataaaattataaatcgccttttctggatgcaaaccagaattaccacagccaattttaagtaaatagtccgcatttcaaaaggtaaaatgataaggtaatttccctcagaattgataaatacagtaaatggtgcccagaggtacaaagtataatcatcagttagttcacacaattttacaacaacataaaaaaaaaacagaccacagaagatcagcaagctgcatcttaggtgtttgcacccatatcttgtttgctgggatttgaggtaatttaaaaaagacagcatcaattcacggagaatcaattgttcacctatactgttgtccacaagaaaattggtagcttccgctggtacgaataatagtattctgaagtcagtacagagcatccgttaggataacatataaacacaatccagtagggattctttagttaatgcatagttatgtaaaacagtgtctaactttgatactttgattttccataattcatattattgaacacctcatctataagctcattattggcttgatgtcccaaaacaagtaattagattatattacacaagcatatactagctagtttgttatactacacttctatagtatgattactgtggttgtttgcatacagaataagagaaacaagaaaaatcagattcagttcattcagcaaaccatgtaacattcagtctagaatagtcaggaaagaaaatccaaatggcatttactaataccagtagtatctcccaccaatacttatattgttaaagaagcccgttcagtatttcacactacttgtaagttttaagttctaactaggcgaataacatggaaagtggccacaatatgcgatcatagaaaggaataggagctaactaaagttggatgctaacagatctcaattcaccaaggcgcggaaaaaaaatatggtgaaccagcatgacgaatagagaaggtgttttctaaaaaaaacttttgcataactaactgtacttattacaaaactatgttatcgtgatatttcagacctatatttcagagagttcattacaaggtacagaagacaaggtttagtccatgaccttgcccagttatataaataaaaatatcaaataacagtgactcatgtcacttcagtaatgtatctgagatgtagatgcagaaagaactatcgaataccattcatgcataactaacaaataatgaataatgtgcaccaataatactcaaacatgtaaatgcagatgcgatgggtagcaatacaaatgtcagggacaattttctgcccagctcagtgctcaccacacatgctactttgcaacctccaaagcactctcaatctgttggattagttgattagcaggcagcgctccctcctgcattgccaaaacaaaaatgaaaaacagcatagaccacaaaaaaagagataacctcattattgttagcattaacaaatcaattaaaattgagaaaaggtggatcctcaaaacttacaaagcgatgacaaggtttcccattcttgaagataataaaagttggcaatgcttcaatttggtaacgattagcaatgcttgtgtacttctctgtatcaatttttacgacttgaatcttatcgcctaacttttcgcttacttcctgaagtataggaaccatgtattgacatggaccacacctgacaaaaggaagataaataaataaatggagagatacactcaaaatgcgtttatcaatcttcctactaacaagccaagaactgctaagccatcatattatctgaatggtgagtaaccgttatcaatgagcaatcactttgtcagtttggtgttgggagttgccaaagtggtagagagaatacggccagactattattctctcttttttttctcccataaggaagaaatagatttgatctaagattttgattaaaaacaaaaacaacacaacagcaccttgcaagcctacacgatggacaataaacatacacttgtcttctccctttatccatggaaacactaaagattggacaaaaaaaaattgatcccattaataatgtgtttgcattactcaatgtgcagggaattccacattcactttcacaaggtcagtgatgcattcaggtaggaacaggacattacctccatcaaaactaactccttaaggtctaacactgtgagaattggagtacataaatctagtacagagcactgatagtgatataacccatcaagacatttggaacacagtttactcttaccagtagcttaccaagttgcatagaagtcgactagtacaggcttttcagacttctccagtaactcgtcaaacgaagagaacgtctgtttcttcgcttgaacctattcaaataaacatacaaacaatttttagaaacggaatatcaatattatgttaacagtaactatcaaattaattagaaagacatccatgaatataagcacattgaaggattggagaaaatactgatttggattgatgatggttaataaacctatgatgaatatctggttacacagcattacatctaatcatatatagttacattcatgaaagatttccaaccgatatgggtccgcaacaggtgtggttagcaaaaataaaactaagtctaaaaatattcatgacatacagccatcaaatcaagtaactgatgctgcacagtgatatgtgaagaaatgacaaatagtagggacatcaaattgttgactcaattattccacgggcaatagaagtacagaaatggtggctttggcttacactggtcccagaaagactgaactgggaccaacaaatctattggataactcatagccccaaatttcacttcgttgtcatctaaaatcgatccaggccagatcaccacagcaacagctagtacttgatgcagcgaaatcactacgaaatgctgcatcaaagcacggcaaaccaacgagcaacccgaacgaagctgcaacagctagtacttgatgcagcgaaatcactacgaaatgctgcatcaaagcaaggcaaaccaacgagtaacccgaacgaagctcgcggggggctcacccgcagcgtggcgccacggcgggacggcgcggccgctcgccgaagccccgccgccaccaccaccggcgcggcggagcggagcggcgccgccgacgagcgcgcgacgagggccgcggggcggcacggcgtgggcgacgccgccgcggcggtggtggtggaggtgaaggccgccatggaatctcgcgcgcgccttctagggttttgtggctggcttacccttatcccggcgattcgggaggaagaagaccaggtgcgccagcgtggtgcacccggtccaccacgtagatgcgtggactggttttcgtggaccgagtccacggtccacgggccagcagccaccaacctgcctggcccacggcccactacctcctctgcgcaaccgaagcaaggtgacgcatccgatctccgcaccaaactcctcgtggtggtttcgcagctctcctgcgagcgaattctagggtttgggaggaaatccaatccctccaaatccggattcgttttggaagacgttttggaggaggtagcatgagctcggcgcaggatccgttctacatcgtccgggaggagatccaggactcggtaattcttgctctttctctcctttgtccctttctccgcttccagcaaatgcgaaattagttgccgtcgtcctgtatgcatatggatcaaaaccaaaaattcgagcgtttgcgcgcagacataccccttagttgcttgattctgaccgattttgtagattatgccgatcgtcctgtttctgttcagatgctacctgtgatttgggatgtcttttatgtctagcgatgccaccaaaaggattaagagtacagatttgtcggtacactgtaagaaatgtctatccaatttagagtagttccaacgtatgctaggatgacatgttgtgtccaatgggcttgaggaatgggactgggtgacagggcgtgggaaattgacaacagtctggtgttgcatttttaacatttttgatgtaatgatggaagaattgtaattatgttcttgaacagaccttgaacagatttgtgttaagttggtagctgatacacttatattatcactgaattgccatgttacagactccatcactaattggtcctattaagctcataactcatgaccccttaagattaagaactgttggagtagcttttctgtttaactcatagtttcagaaacattctgcaccatcatgctgttcactgtgctattctaccattcctgaatatacatcttccttgcatctctattgttaactccctcacacattcagaaacatatttcatcctcatgcattttactatgctagattttgttatcgctgaagatatagccccttcgtgttattgtgctgcttatttccttcataacttcgaaaacatatcacaccatcaacacacatgcatctatcttattcttctaatactgaggataaagatatttctgtgacagattgataagttgcaaactactttccatcgatgggagaaaacaccgtcaaacacaggagaacatgttcatttgacaaaggagcttcataccagctgtgaaagcattgagtggcaggtgagaaaacagggaatatcagtgctgtcattctttgatgtttttggtacaggaagaagccgctgttgcatttaatatattagagttacttatcggaatatctgttttcttcttcctgcacagttgttctggtataactggtgtttttttatgttggaaggtggatgagttggaaaagacaatcttagttgcatcaagagatccagcgtactatggactggacgaagttgagctttctagacgacggaactggattggttctgctcgtaatcaggtatttcttgatgtttcatcttgtttcgctttttatgttatataaactgctgggtgacttattggaactttacaaattatacttatactacagatttcatgtgccttttcgtttgcgcctatttcattttcataggattatcaattaggtatatcctgatcatgtgtgagcatcttagaaatacaatgactgctaaacatgatatacagtggcgtgggaaaaaaaaagacacgagaataattttgatgttactgtgttctgaactctatgtagccaatgcaagtttcatctacgctggattcctgtttacgggtaaacatatccaggttgctgcagtcaggagatctgttgaaaaggggaagagtaattcaactttctcggcgcaccaagacatgggcacaagcagaagtaaccactacactgcacaagacaatgatgacttcattgcttcagaatcagatagacagcttctacttatgaggtcaattttcattctgctacatttattgcattttgcaattttgcaaatactttagttagaaatatatattgtctgccctgcacatataatatgagcactgcatttatgtttctgttaatggttagctggttgatgcataatcttcgagttacacttggaattgctaagaaggatatatttttggttctagcagtgtaaagttcatatagcctgatgttctgcacttatctgataactgtacttaatttaccttcaggcagcaggatgaggaacttgatgagcttagcgaaagtgttcaaaggattggtggtgtagggctaaccatacacgaagagctgtctggacaggtattgcccttgtcacacggcaaattgatggagatgttgcctaatgagccaaaaaatgttcactacagggccattcagtctcttttttttttttggctgggagtgtagcactctaaaaagaacatgtcagctgaagtaactgggaacgtcttgcttttttacaggaaaggatcttaaacgacctaagcttggagatggaaactacttcaaacagacttgacttcgtgcaggttagttgcttcattataaagcatgacgccgtcgttgtttcttgtattcaagatagtttaaatttccacaagttatttgttgatgtgcactagatgcttatatttatgtttcagctagcaatttttattgctgaatcagttaacaagcctgtaccatgtcatacttatttgctgcattcaagttgtgtagaagttcctggaaattagagtagtgccctgaaattattttcctctcattgcctggtgcagaaaagagtggcgatggtcatgaaaaaggctggcataaaagggcagattatgctgatcctcttccttgtggttctgttcattatacttttcgtgttggtgttcttgacataacgcactagtgttccaagcctcgtgttttgcggctgtacctacctactgtaagctgtggagaacagaaaacaaatacacgagttgctcatatctttcaaatcctacctgattattgctccatctctattatgatctttttatttcatacgccctatttttttctccaacaaaagttggataaacttttaatactcgtggcacgcttttcaaactgctaaacggtatgtttcgtgcggtaactttctatatgaaagttgttctaaaatatcagattaatccatttttcaagtttgtaatattaaaaggtcacatgttattagcaccttgttttccgtgaaacatttaatctttatcttcattttcaggagattcgaaacactaccagtctacctgtgattaatatatctttcacataaataaacaaatgatcatgtcatgcaaaatcatgcgtataccatcacttgccctcatcactgaatttatttcactaagattgcatacaagcaaggccataagttgaaagcatacagctgctaatccactaatccaggctaactagtagtagtcccagagtattattttattatctagaaaacgaagctgtctgcaacctcgaggacggaccacgggaggtcgccggcggcgacggtgccggggtttctggctgagcagttccggcgaacctggccctgcgagccggtgagcacgctgatctgccccatcttcaccatggacacggcgaactggtcgaagaatgccttctcgtcggcggcgaacttttcgacgatgggcttggtggcggcgtcggcgaagaggtcctggtcggaggtgaagagcccctcccggttgacaaggttgacgtagtacatgttgtcgaacacgttgggcgtccggacgtcgttcggcgtccggcggtcggtgcccgccgccgggcaggttcgccggagccggccggcgaaggtggcgttcatggccgggtcccggcgcgggaagaggcggccctcgaaggagctgcagtgcgcgaggcccacggtgtggccgccggagagcgccaccaggtcggtggcgtcgagcttgatcttggccagggcgtccagcagcgccggcacggcggcggtcggcggcggcagcccgctcagcacgtcctgctgcgacgcgaactcggcgctgtctcgccgccccagtggcaccttgtactccggccctcctgactacacgtcaaaaataataatagtaaaagtaaatttcagatactttaattatcataaaactataaattgtgaaatttcataaatattgatttagtaaaaaacttggatatttataactcaggcataacataaatgctaagaatttaaaccctataagctataattttgtgctaattaattattaaatctatagtttttatgataaatttattgttaaatatatatttctaatacattatcttaaatctgtatttttacaataatttgatcaagtatatatagttctataaaatttacttaaaagtattaattatttttgatta

SEQ ID NO: 36523 - DNA, 4351 bp, Oryza sativa
actgtaagactctaaatttatacgtttaccgcgacgacagagtcgcgggcggcgagagcgaggatgtcggagcaggagacgacggaggcgccgcacgccttctcaaggcggtcgcggatgtcgttgacggccttgaacgctgacgggcgcagcgtgaggttgggcggcgcctgccgctcgccggggccggtggcggagccgtcgagcagcacggaggcgtcgcagccctgcacgaagcagtcgtggaagtggagccggagcaggccggcggcgaggccgatgtccttgcggacggcgtccctgacgaacttcctcacgacggactccgccttggggcagctcttcctgtagaagtcgaacgacaggccactcaccaccggcggctgccgcgtcgcgtcggcgttgccgtcgccggcagccgccggagcgcacaggcaagcgacggcagctaccagcattaccagcgtcgtcgcagaagccatttcctcccgtaattgtatttctactgctctaagtgtaagctcgtactgaacatacgcagctgtaggcttcaatttataggggagtatattttgatatctccataggatttcctctcgttgtttgcatgttactagaaaaattttgagaagatgtattaacatatgatatatgttcaaattcaatttttacatctcacagtcaaaaaacaaatttgactgtgagtatatgttcactggctgtaatttaattttttttacgagatgtagaatttgaactagtatatttgtagagtgatatattatatattaatatatcttctctatagtttttaattttttttcatgatcatttaagtgacatgtaaataacgagggaatatttatggatggatcaaaatagtttcataattgatagggattttgtttttggacatttaaaatattattaatcaaacttgtcatgcatgcatgttgacgtaggtgaatgcaggatgctttgtgagatgcaagatatgggcgagaagagaacaaccgatcctatctccctacgtcctgggtgtcggtgtactgttgattttatcggtttctccaggagttgggagtgcagggtagcgctcttggccaaacacgtcgaccactctgctgttcctgcccataccgtgtacacgtttgctataaacgcagcaaactaagaacctcggtggcatgatctgaaagtgctaagaattaagtgaaaaatcttgaagatgatgtgaattgaatggcatattctgaaaattctcatctactttagcatcatatgatcgagtaggttgtacgtgttcgttcagatatatcgaataatctgagtgtcatgcatggtgcacaaattgaagtgtggttttagccactttcattgaccaagcagtgaggcattagtccgacaacaatcttgttggttcacatatcactgtgcatagaaacaattctaatccctcaaggggatatcttcttgttctttgcatatcacttaaatggttataaaaaaattgagaatgtatattaacatgtgatataacactccacgaacatgcaagttcaaattcaacttctacatctcgtaacaaaaaaacaaattaaactacagctagttaacgtatatttaaagtcaaatctgtttttttgcgagatatagaagttgaatttttatttgcatgtttatggagtgatatatcacatgttaatatatctttctaatttttttaattttctttataaccatttgagtgacatgcaaataactcgagggaatcaaaatcctcttccgcctgtgcagcacaagagcgtacacgtactgagtcgtggcggatgagagaggttgcacctggcgctatgttgcagatcagccactagcaactactgtaccagtccagccacactagtagtcaccgtgcccatcattcatccggccggccggtctgtcccctgatacactgccgttgcattgtttgtgtgcattacagagtttttaagatggattaaacgttaaaaggatgagtagttaatagtctcattttacgtgtttgtaataaaagatacataccagatttcagtttatttgactttatttgaaaagatgtaaggctacaagaatacacgcacgcatgtacgtactggcaaattaatggaagcaacaaacttttgctgatcaagaaactagggagaggatttggtgatcctttatcactcgagtggacatgtacactcgttttatccacttcctagctagagatataatccaaggaaggtgcatgcatgtcctgttttctttatcgatctgggtttgctatcaaggaaattattttcctcctcaatttctctagaggattcctttccaaactcaaacaagatcagtatggatattcgaaacgcaccatgaccgaatcgaataactgacttaccctgcaactttttttatttttacagaattgacttgcactgcttgcaatccgcacagacaagagaaacaagaggcatcgaatcgaatcaaattatcgaagcaaatacagtaatatattatggccgatgtacaaagcggcggcggcggcggcatcaccgtcaccgccgtggcggagcgggacggcgagagcggctacggcgcggcggtgttcttcgcctgcctacccggcgcgctgatcgccattggcgtcctcatggtgctctactaccgctcccaccatggccatggagcgctggccgtcttcctcctcgtgctgtccgtcttcgtcttcctatccgtgtgcttctgttgcataggtctcgtgcaactcgccatccacggcagccttcccctggaagaagacagggttgctgctgctgttgatcatccattagacgccgtctgatgatttaattttgatttgattttaaattcagtattcatctgaattgtgattccgatcgagctcaaacatgaacatgattatcttgaattcaaatctttattgaaacgaatttcagattgggttatttgagggctaagttttttgtttgataggataagttcctaatttaaaaagactgcatatatctggttggatgtagaggccaggtaaaaaaatatccttataaaaaatgattagccacccacattgtttgttagattgcttagtttctacttaaggttaagtttggcttactatacgcaaaatcaatagccaaggttctcctatactaggtgatttcttgaattgtaatggttgatttccaaatcaccaaagttgcatggatccaataaatcctatatatttggggagtagattctgatccctcgaggggatatcccctcgtacaccttttttctttcaaatttgatataaatagttgtgaaaatttctgaaaaaaaaacaatgtagaggttgaatttgtctttttatatctcgacgtgtgaatcacatttggacttaagattttgtggagctgtatagatatgttatatgaatattgtcaaaattttccagaatttttcataaccgttttgatgtttttaagcaaacgaggggatatcctctcgagggatttaaatagttttcatatattcaactttatttgcaaataaaaaataagctacaaaatacacgcaagtgtacatactcatgacatttggaagcaacaaaatatttatcaaggaaataagcttaattaaactagccatccttgttagcaccctacagcaccaagctctcggcggcctcagcgacggtctccacgacggaccaagcacggtcgccggcggcggcggcgttggacaccgaacagcgcttgcggatctgcccctgcgagccggtgagcacctcgatcatgcccatcttgacgacggagtagacgtactggtcgaagaaggccgactggtcgacggcgaacttggtgacgatcggcttggtggttgcgttgaagaagaggccctggtcggaggtgaagaggccctggcggttttgcaggtcgacgtagtacttgttgtcgaaggtgttgggcgtccggatgtcgttgacggtggtgtcgttggtgttcagcaccgggcaggtgaccttgaggtggccggcgaaccacttgtccatggtggggtcgacttgagggaagaggcgcttgtcgaaggaagtgcagtgcgcgatgccgacggtgtgcgcgccggagagggcgacgaggtcgtgggcgtcgagcttgagcttgcccagcgcttcgaggagcgtggtgacgttggagtccggcgacgggagcgcgctcaggacggcgtcctcagacgcgaaactggagccgtcgtggcggccgaggggaacatcgtaccacgggccaccggcgaggaggacggagtcgcgggcggcgagggtgac

SEQ ID NO: 36524 - DNA, 3060 bp, Oryza sativa
gtcgcagccctggacgaagcagtcgtggaagtggagccggatcagcgccgcggcgaggccgacgtccttggcgatggcgtcctgcaggaactcgaacacgacggcctccgcctgcgggcaactcgcgtcgtagtagcccaacgacaaccccttcgccaacggcggcatcctcgccgccgccgagctgcacaccagcgcagccgcggcggcgagcagcagcatgccggcagtagcactagtcctggacgccatggtcgatcgatatagctaagtttacttagctctcgtcgtactcgtactgatcgatcaaccgtgtgccgtcctcggaggatttccatcgcttttatagcggacgcgcactacttgcgagtgtcgtgatgaaattgatggatttggggcgtgcatctgcgatttttccacgaggtcgttggaatcgtcgaaaaatctatgataggtctattatatgaacgcatgcgcgaacaaattgcagcggactgagactggctgatgcggcgaacgatcgagcgagcttgtcgggattgagcaaattggcagcacaagtggatggctttttttttctttttggttgaaactttacaagtggaggttggtgcatagtacaatgcacaaatgctcataggcggctatataaggattagtagcaaatttagttatgtataaagaaaaacccttaacttggcgatttttcacatatgtgtaatctcgcaaattgaattatagctaggctcgccgtttttttttccccttttttccaacgagctagcacgattctttggagagaaagatcaataatgtgtgattcgcttcaaatggttcaaccttcttccgttgaattattcgaaagaagtcttacgaatgagtggtgcacacagctcctccatcggaatccatgcatgcataaattagctgtcgttgtttaagggtgggcgacgggccggcggctacgctgatcagtttatcatcattgaaaaataagaataagctgatgaagaaagaaaaacacaagcaaatttaactactcacacaaatataaattgaatccgattcatattcctcaaccataaaactagataaatcgacccctctaactatcaaaaccgtttaaaatgactacatcaactgtttttaaaagcggtttttcgttgacttggtgttcacgtgacatcccaatcattaaaaaaaatagagtgggttccacctatcatcccctccatctccatttctgacctctctctctctcccatatcgatttttttcagtctcacattgcccaccaccatcagaattcagaaagatgtcctggaaagttggaatattcatgtcccctgctattgctttttccatcgcccccgctcgagttgaactgttgaagaagaggtggtggtgtttcacggggttcagcctcaggccgtcagccccttgtacaaggccaggaccggccaccactcaggtaaagcagattaagtgctatgccgacgagcttagactgacttctttcctagctttctcaactcatcttcttcgttttttacacatacacttttcaaaccgctaaacggtgtgttttttgcaaaaaaattctatacgaaaattgcttaaaaaatcatattaatctatttttcaaaaaaatgctccatccaattcaggttataagacgttttgactttgctcaaagtcaaattatttcaagcttgattaagtttatagacaaatatattaatattgataatactaaattagtttcatcaaatcaataattgaatatattttcataataattttgtcttgggttaaaaatgttactactttttctgtaaacttggtcaaacttaaagcagtttgactttcactaaactcaaaatgtcttataacctgaaatggagggagtagctgctaatgagccgctccattttatgtgccaagagatttgttcccaaccagtagtaacgaacacagccgtaattggttatgcctgacgaactcttgaccttcacttcacatactccatcctctgtgcacaggggcagatccaagaacaaaaattgggaggaggggggctcaattacacagtttgttcaacctccagccatttagaagccttaagtttatcattcattttaaaaaaattaaaggggatgctctgggaggtatccatgggccttgtgggtgtaggggggactccaaaccccccgcacccacgttggatccacccctgtctgtgcatatatctatgtgatccaatatgcgcatgcatccaatatgtgcatggttaggttgtcacgtcaatgtcctacacttctgtcttctgcatgggctaaaaaaaacggcccatcgaagttagtaggcccaaaaaattttgaaggctgaaccgccactttttcgcagggtgcataagcaatcgattcccaaacaaattttattttattcattccttcaaatatcaaagtttgatctctgaactaacatgcggattataaaatgcagctagcattaacagactagcaaccgatgagcgtacataaagcggggaaactattttgatggatgctagctgcctagctgcattttataatccacccaaacggttattttaaaaaaatatcatccaaacagttataaaaaaattatataaaatttgataatgttcgtacaacatatctatacaactccacaaaattttagatccaaactcaactcacacatcgacatatagaaaagacaaacttatgaatagtagcatattgtatacaaaatttgtctctctttttttaatcttagtgggtatgtcaaattttagcttgatttttggtggaccgatagatatcactatactctacattggcaaatctatatctatatctatacctaattaaaaaataagtaaggttttcggttgattttttttttccgtcattaaagggtggggccacgtgattattttgccggttatccgtgaatccggatgcattacgacgatttttgaggtccgcaaattaaagaggatggaaaaaaaaaagagaaacctagcgagcaggccgg

SEQ ID NO: 36525 - DNA, 12026 bp, Oryza sativa
  unsure (1)..(12026): unsure at all n locations
gaattggatttaaaaaaaggaacaatttcattattttgggaaagtaaaaaaaaaatcacatgtctttcttttttaaaaaaacatgtaaccaccaacaaaatgaattatttactgacaaaataaattacttttagaaaatagaaaacaatcacgtgtctttgttttttaaaaaaacatgtagtcaccaacaaaatgaatcgtgtttacatccagattttttccctcatccacatcaattttttttcattcgttgtatgtttttgttctaatttttttagagtgagatgatacaccacttttttttttctttccattcatcgtacgatttccttctgattttttgagtgaaagcgattatgcaattggagtacagtgagatttatctgatagctagcgaaaaacatttcttgtactattactactcttgcagtatgtaaaaaaaagtgtttatcaatatcaagtacaaaaatataaccatgcattgcaaccgactcataataatacatgacaaaaataaatactttttgggtttcaaactttagtatgtataatacataatttcattttaaagtggtattaatagctttcttataatccatgtgaatggatttagagcaacgaataattatgtcatgttagcgtcttacttgcaccgaaaagattcgatttgactataaggatctcaattaacctggtggcattatgctcccacacgcccattactatttatttttgtcttcacccagtgcaacgcatgggcatttcgctagttttattagaatttttcataattatttgtatcgaatttagaagaaaaagatacacgagagaatattctctcgagtgattaaaaatttaaaatccaccccgagtaaaacgtgctacatgcaagctccgagttcttcatcggagcaaagagtaattgagctccagctaggtgccaccgccggcggcgttgcgcaccgagcagttggtgcggatctccccctgcactcccgtcatcacctggatctgcgacatcttcaccatggagaaggcgaagcggcggaagaactccggctggtcgacggcgaacctgccgacgaggcccctcgtcctgccgtcgctgaacagcacctgatcggaggtcaggagcccctgccggctgagcaggtcgacgtagtacttgttgtcgaaggcgttgggcgtccgtacgtcgatggcggtggtgttggtggtgttcttggccgggcaggagagcctgaggtgggcggcgaaccgcgcgtccatggtggcgtccacctgcgggaagaggcggtcgtcgaaggagatgcagcgggagacgccgagcgtgtgcgcgccggagagcgccacgaggtcggcggcgtcgaggccgatcttggccacggcggcgaggagcgccgtcacgttggagctcggcggcgggaacgcggcgacgacgcgctccctcgccgcgatcgtcgcgccgtcgcgccggcccagggggaccctgtactccggcccgccgaccaggcggacggagtcgcgcgcggcgagggtgaggatgtcagcgcaggagacgacggccccgctgcacgcgtcgtctagcagggcgcggagttgggcgacggccatcaacgccgacgggcggatggtctcgttgggtggagcgtccagctcgctcgcctccgtcgccgtgcgcgccaacagcaccgacgcgtcgcaaccctgcacgcacagcgcagcacaattattagtggcggtttcgcgaataattacccgtcacagatgcgtgtttaaatatagtatcgatcgatctgttcaatccagaattcaaaattcagagcatgtttgaggcgtaatttcatcattttgcacatgcattatgcatgattaggtgtataatcaattaattttaatcaattagttaattgcctggacgaagcagtcatggaagtggagacggatgaggccgggggcgaggccgacgtcgttgcggatggccttcttgaggaagctcctcacgatggtctccgccttgggacagctcctctggtagaaaccgtacgacaagcccttcgccgtcggcgggtaatcgccggcggaggccgccggagcacacagaagcagcaagctgcagcaggaaacgaccaaaacctgcaacgtgctgctcatttttctcgccatctcgatcggcttaattttgtgtcttggagttggggtgaatgagcttgcatgcgagtgtcttcatcaatttataggcgtttgctcgttcgcacctacaaaatcattttcgcatatacaaaatgatgtcaaaatgtcaacgcaatcgactacctacaaaatcatccatttcgcgcagctgtatgaaggttggcaaaaattgctacctgtgttgcgttttgtctcaataatgtgagctagtagcttccatcgattgttctattttatcagttgcgtgtgatcgagcgatcgagttcatcgatcacccaaaccggccggccagtacgtacgatccgatgtactacgtagtacgtacaaacgttgcagatgctacctagctagtcgttagtcgttacgttgcctccttcgcaaacgaatgatcatttgacttgacaagctagctaggcaaggtcaaatttctctctttaggattaatttttcatatatcaacttccatgcatgttgattagtagtccgcacggagttgaggggatcgagaatgattaacgtaccttcaattcagcactacatgaatgtacgtacatatgcaatgtaaacaaattaatcaatctatgggctagctcttaattcttctttggatggaagctagttgctagctacgtcagtgatgaaaacagggcgctgtttgtcacgtatgatcacaaattaaaactttaaatttaaaatacacgtctttttttttatcatatcgattcttgcaatcgtgttgctagttagaaaattttgacgaaagtttcttttccgaattcaaacatgatcagtatactcgatcgatccgtgagtgttcaatacatgcattgtggtctgctacgccatccactgcacttccaccacgtacgggtcccatcacggagcggatgccgtcttactcctcgtgctcagcttctttttcttcttcttcttggcattcgtctgttgcttcctcgtcgtgcaatttgccaccctcccttcgaacaatgttacaggcttcctgtagtagatgatccattattaatatatgatataccattccacgaacattatataagtaaaatttgacttatatataagttccttctaatatatattgacgtgtaatccttttgcacgtttgcgaaaacttaatttgacttatataagttccttctaatatatattgacgtgtaatgcgggtttgcgaaaacttctactaagttataaccaaaaggaacaaatatagttctagatgtatgttttagcaagttttagtttaatttattttttttattgttacaaataagtcaaatttaacttctatattttttatgcgatatatctgttataaaagtaccttgttacaatttgtagtttcattatatattttttaagtcaatatctcttattaatgtatatcaacctttttttgcaattaaaagggtatatctagggatgaaaaaccatcttcttttgaattagatgaaaatggtcaaacgtattcccaacgtcaacgatttcatctatttaaaaacagaggtatagggtattttacttatttgattgattaattgttgctagaaattattttcgcgaacgcgcaaaagaattgcatgtcaatatattagaagaatagagttttgatacacgactcactcagccagaccggcctatgccaagtaaggaagaaaacaaagataaaaaacaaagaaaggaaaggaaaaaaaactcgaaaagctctactccaaacagcggaagggagcagagccactctacgctcccaacaattccccaaagtaagtgacggccgctaacgaccacagccggccctccaaaaggatgacctctaggactactgcgaccgaagagagcacagagtcaaggaccctggagttacgttccctccacagttgccatgagactaggaggaccagggagtcgaagctggcacggagatgatcaggtaaacaagccctagaagatggccaccaatcatgcagccatgtgccatagaggggagagagggcagcccagccaggagacgataacacccgtgttggtagaaattatatttctcctttatttaatttggtatatggttaagcatatatggtacccgatcgatccgtgactgttttacttagagtatgcatgcgtgaccgaattgaacgagataatccgagcctaattcgaacctaattgcaatccgcacaaacaaatagtaccaatcaacaaccacacatacatcgatcgtgatctctagctagtacattagcagagagaggcatatatcagaattaattattatcgaagaacaataaataatgggcgatctagagaaccctaactacgatggttatggcggcgacggcggcggcgacggcgatgacgattactacttcaccgccatggcggagcgggatgtcgggatcgacaacgactacggtctggtggccttcttggcctgcctagctgtcacgacaatcggcgtcggcgtcctcatggtgaagtactaccgctcccaccatggagcccttgccgtcttcctcctcgccctcgccatcttcctcttcctcatggcatccggctgcggcacaaaagccatgctgtataccctccacggcaaccctcctgctcctgatgaacaacgacttctcgtagatgatccattggactgatagatatgtatatatgattcttagtttagatgtcgtctgattatttaagtgatatgcaaataacgaggagatatccccttccctcgaaagatcaagaaatagtttcccctccacagctcgggctaccatggcggcttcgtcttgtgcgtcttggcatgccgctgttgcacaagcctcatccgtcattccatctacaggaaccatccgtcattccattatactgtatgatccatcagcagacaagacgccggcgatctgattaattattgattactacctccgttataaaacattttgattttagttaaagttaaactgctttaactttgattaagtttataaaaaaatagtagcattttcaacccaagacaaatttattataaaaatatattaaattattgatttgatgaaactaatttactattataaatattattgtctataaacttagtcaaatttaaaataatttgactttgatcaaaattacaatgtcttataatctgaaacggaaagtactgtactttactttattttgtttgatatattggtgttaattcggatacttcttcagttgaagtaatctgtgacctggagggtgacaaactatatatagcttgcttgctgccagcaacaatcgacatgtgcttgctatctgctgatgatcgaggatcgatcactgattggtgttgatcattgcctaatcaggatcaagtaatcatcgggatgtttttgtcatgtatgcagcaaacgtatgtctttagagtttcagacactaggttgtttctctctctttctggtatatacgtacatacgtctatttatgcaggtatcttatgaattaattattaatctattatcgttgccgacaaatattgtacgccttaatactcaacgcatgtgtcatgtgtgtctacaggtgcgtgacttctgcctccactccaacctaattaattaaatcttaaatttggcttaaattaattaaaagaagtgatctgcaatatacattgggaaagtggttttatcactcaagggatatcttctcgattcgtgcattccacctaaaataatcataaaaaattttggcaatatatattaatatgaaatatatatcactccgtaaacatttaagtttaaattcaacttctataatgtaacaaaaataacaaatatagctgcgaatatatatataactatgttcaatttaatttgttctttttgttgcaatttgtagaagttgaattcggtcttgtatgtttatggagtgatatatttcataataatctatgttattatatataattttttaaatttttaataactatttagataacatacaaacaataaaagatgtttcctgcaagatgaaaatccacatccatatatattgatcataaaggaggttgtcatgacgtcatgcatttattcgacatggcagtaaccaacatatatccacagtcgtcgtcgtctctttccacattcaacgtacggtacacgtactgacgtacgcgtccatggcgcgcacaattgtgtgtctagagcacgatgctctcggccgcctcgacgacggtctccacggcggcggaccacgggagctcctcgtcggcggaggcggcgccggggttgcggacggagcagtttgcccggatctgtccctgcgagccggtgagcacctggatctggcccatcttgacgacggagaagacgaactggtggaagaacgccgactggtcgacggcgaactcggcgacgagcggcctggtggtggcgttgacgaagaggtcctggtcggaggtgaagaggccctggcggttttgcaggtcgacgtagtacttgttgtcgaaggcgttgggcgtccggatgtcgttgacggtggtgttggccgtgtcgttcttcgggcacgtcagcttgagctggccggcgaaccacttgtccatggtgccgtcctgcttcgggtacagccgcccggtgaaggaggtgcagtgggcgatgccgacggtgtgggcgccggagagcgcgatgaggtcggcggcgtcgaggttgagcttggccagcgcggcgatgagctcggggacgtgggaggtcggcggcgggagcgcgcccagcacctgtgacggcgtcgccgatgtgaggccgtcacggcggccgagcggcaccttgtacgacggcccaccggcctgcacccaattgcaatgttcaacattttggtttttatatttatttttcttgaaaagagggtaaaagctttgcttgtatattgatagagtaggggttacatcaaagaattgggcatcaaagaatgacttacattatgaaacggagggagtatgttctaacattcactgattaatatttatctttgcacagacgtaaacatttctaacgtttaattaaatttgtccagaacaaacatttatgtaatactccgtaccacttttccagtccaactactcctttaagatttattgatttacacgggcacatccgtaaccatgcacaaaccaaacatacacaacaccacgctaataacagtctaatacatactcaaagtccaaagatatggggaccatatcatatctttaatctcattattttttttagaaaacgtatttttaacattattagtaaaatttctagtcatcaaaacaatttcatctaaatcttaatccatgctttgactccttaaaaatgtttatattcgtgaacagagcaagtaaatgatatgtaatgactaattgattaataaataattaattagttaatgaacatcgatggtacactcctagtcagcaaatggtcttattaatatctgttacacgtattagtcgtcctaattatttaagatgtcgatgttctgataattttggccattgggcatgatacagtgattccacacgtggttgagacagcaacacaatttcctgtttccttcatctctatcttgttcttcttgtgccatttctcgcaagccaataaattctacagaagtactgatcgtgacagtccaattatcccgcgttatagtttcctatggctcttcaagggaattgttactcagttacatggcttaattaattagattaatttacgtgcaaattgatctccaaatatctttcactctaaagaaggctagcttaaagggaattgtcttttctaacatgcagaactctgcgtagattcttttccctttgtttttcgatgcgtgcataattaattgttgggtatttaattaattaagagaattttaaagggatgatcattatattgtaagatgttctttggtcatttctgttgattaatttaggaccggacaacgaaagtctcttgtccgctgccagatcgagatatactagaaaattggagaaacaagatgcatggatcatggatggatgaaacacagttcgtgcatcggcagcatcgtgcagtgcgccagtgcccacatcagggttcagactttttgtttccggtatctgtatcgggtgccgatatgatgatattttcgaaatttcggttcaaattttttgaaattttaaaaatatgttattcaaatttaaataaatattaccaaaattcatgaaaaaaattaaaaattaaaaatttagctaaaatagtatggtatcggatggtctaatatgaccaaaatttcattcggaaattttgaatcctaacccacattacttaagttaattttcctatcctctattcatgaactccactttttagatagcagtagtgtttaatccatctcctcttccatgaaaaacttttccagtggcagtaagtaagtgaaaaaaatattaattaatcaattaacttagttagttaccagtttgacggaatcgcgggcggcgagggtgacgatgtcggagcaggagacgacgcggccgcacgccctgtcgagcagggcgcggatgtcgttgacggccttgaacgccgccggccgcagcgactcgttgggtatcgcctgctgctcgccgtcgggcccgccgggcgtcttggtgaggaggatggaggcgtcgcagccctggacgaagcagtcgtggaagtggagccggatcagcgccgcggcgaggccgacgtccttgccgatggcgtcgcgcaggaagctgaacacgatggcctccgcctgcgggcaactcttcttgtagtggtcgaacgatagccccttcgccaccggcgggtacgacggcttcttcgccaccgccgccgccgtcgccgccgccggagcactgcacaccagcaagtatacagatacagctactaccgcagctgctgctgccatggccggactagctgctgcacttctacgagaagccatgtacactactgttcttagcttaatatggtactagaaattattaaggtgccttgatttcaatggagatcgatcgaggtggcttgtggagaacttgcgccagccggtgtcctcatttatagccatcgttgttcggcactgtacagtgagaatgtgagatgatcgatcagtgagtgacactgcaacttgcgcggaaacaaacaagcgggtttaattaagctaccaaagaatatgcccttaatgatgatcaaatgtttatgtaatatttcagtcaccaactctatcgatatactaacaaattaaattaaagtaggacaccacacttccactctcgtagcagttccttttcctacatgtagaaactaccggtgttttattttggacttttcactagctttgctatttattgatttaatcacgttctctgtctctctagttcagtctcttcagttcatccttgtgttgtcactgatgatttttatccatgtcgtctccctgtgaaagcggcacgtatgtggaagtgagcaatcctctttctagcttaattttcttttcctgaaacaccacagaataaaagatccaaagacattggttcggtcacagagctttcaggacaatttctaagtaacttcgcttgcgacagaagagcacggtgctattctatatagggctgtgtttagttggatccaaagttcggattttagttgaaattggagatgatatgactgaaaagttgtgtgtgtatgacaggttgatgtgatggaaaaggactgaagtttgaatccaaactttggatctaaacacagcctagtgagtatatatcacacatggcactatgcatccactgagaaaaaaaaaggtcacactaagcagtcagattccaggattaatcaaagaacagatatccctgagcaattaagcagtcacccattgactaattaaccagtctttggcttggctatagctgtgtagtcaccatctatgtaccttctttttaaccaacttgatagtactgcttttttttttccccagccattattccatccttttcgtcaccggcctcaccttttcttcccacgattagagatagcaccccagcaaattcagcttacctgttactctgagtctctgggaggttggcaaattgcaactttcttgacagtgagattcatgtttagatatcaaagccgccggaaagagagggcccggccggctaaatcatgtgtaaaattaaagtattagcatcccaaccaactcaaattagcctctttttaaactgttctgctgcgactattgtcgacatcttaagataaggtcttaaaaaaagcaaatttaaacactggattgcgtcacgctatgtatatgttaattgctgggcttgcaccgcctcaaattttccttttccccactgtttttgtcagagtgaactttatcattattcactcacaaatttagttggactgcgtaccctataaagatctctatctctactataaatgcgtaagaaaatgaagggttcctgctccttggaaaataatgaaacaatatgggctccgtacgctggggcctttgagtttcagcagttttcaattatcttgacatcatatatgagtttttctcttttttgtttttgaaaaaaaggacatcggatcacatgcgtactcaaccaagagagactagtccgttatcaaaatgtaccacagaactttgcaaattggtttttttcttaaaaaaaagcatatgacaaacatacgttcacaacacgcgcacggtcgtccctataaatatacacacacacaccttacccctatgagcatctctaaaaactgtactagcaaatcttaagattgacgaagtcagcacggatgtttcgttgtcgacgtatacatcggctaccactaaaagaaagctgtaaatgttgagcacgtgtaccaagtttagaacttgatcgaggtgggcggattctactacaagaaactaactagtggagctgtgctcacttcgtaaaatggaaaatattctgattagctgcagagtgtttcattggaaaatctacctaggcgactgaaatctttttcagaaaggagaaacttttgcagaaagagaaaaaaaggaaaagaaaaaaaaagaggcccgtgtagtcaattgaggcccagaacacatggaaggcgaaacagagcccacaatggaggcccatgtggtggcctctatatatcaacccatcacaaagctagggtttttctccccgcctcgctgcttcgcctctcgttccccaaggccccgaagccgccggcgccgccgccctcctccggttcgagctctccgccaccatggtgagtagcgacctccgaaaccgagccacattcgtttgctccgctatgctctacccgttccgttgtctgacgcgatgccgcgctttgttttttttttgtgtcgcagatcatctccaagaagaaccgccgcgagatctgcaagtacctcttccatggtgagattctccccctttcttctcctctatacgccgactctgtacattgtgtatgtgctgatcgtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36526 - DNA, 1095 bp, Oryza sativa
ttgtgaatgctgttgtgaaactgggttcgatgtttgaaaaatcagcagctgacgggatcagctaggcccgggtggccgtttgaaatgttgttggcccgggtggccgtttgaaaagctgttggccgggtgccaacctgtttcaagatctaaagactgatacattgcacatactccgaccggacgagatgcactgtctcatccgtgtcgtttgagaagcactcacttagactttttagaaaagagttcaaacaaaatcaattacgaaaaaaacagcctttccttgaagcctgcattaaacacttatttcccctggcttgctgagtactcccgtactcacccttgctctatataaataatcctcccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttactgtgatactctgtctccctgtgataccagcactatttcctgggactggtatcgattaatgtcacaccccgaagttttcctcccaagccaaattgtaaattacaaatgaccccaagaaaatgcagaggaaatcaggataaaaccctaagaaaacaatgcatataataatcggatttgacatgtggaatttttcttgaattctacatgtcgaaatgcattaacaggatttttagtggaattttcagagctctagaaataattttaaccaattaaaaatcactaaagtgcaatttttaattccagggaaaaccctttttccttttcctttttctttttcttttccctccctttttcctcctttttcttttcggatgggccgacggcccattcccctccttcctccccctcctccttgctgggccggccgcaggccgagggcccagcctggcagccgccccccgcctcccttctcggggtcgcagacaggtggggcccacctgtcgggt

SEQ ID NO: 36527 - DNA, 678 bp, Oryza sativa
tttatggcaattatgtcagaaagaagatggacattgccattgattccacggtacaaaattgattttgttgataactgactgtgaatccaaattaagatatacaggctgacaactagggatgaaaacggtacaaaaacggatagaaactacctttatcattttcgttttcattttttttttcagaatcggataccccggatacgaaaacggaatcaaatattgtcgaaaccgaaaacggcgctgatacggtaacgaaaatttatcggaatacaaaagcccctcaaactaagctttaaactatgtcaaatccaattctcaagtctcaaatttcaacattacattacaaaacacaatcatgtcaagtccaattctcaagtttgaattgggtgtattgggttggactgaattgagtgactcaggggatgctgaattgggttggggtggggaggaattatagactatggtatgggcctttataattccaaaaattccgagaaatttttcggaaagcttccgaccgattttgagttccgacggaaactgcccttatcatattcgattccgtttccgagaaaatagttccgaatccgttttcgtttccaaaaaatttccgaccgacagattccgttttcgaaaataggtccggaaccggaaagtttccgtactgtttttatctat

SEQ ID NO: 36528 - DNA, 351 bp, Oryza sativa
cccggtttggtctacgtggcgtacacgtggcagtccagtcagcattttatttttttaatggtgggacccacatgtcagacaccactttctttcttccttctttctttctctctctttgttggtcagcagcggtgcgcacgccggtggctggcacacatggcgcggcgcgggggcgggctggcggacggcgcgcgggaggtggacgggatgggggagaggcgggcgccggcggccatggcagagaggcgagccatggccggaagcgtcgggaggaggacgggggacggcggacggaggcgcacgtcgggagctggagcggcgtcaggaggaggacggggaggaggaacaaga

SEQ ID NO: 36529 - DNA, 12482 bp, Oryza sativa
  unsure (1)..(12482): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttatgatcaattagaatatactgcttacaaatttggtaagaaacttcaaacatgttctattgttcttgatgagaaggatcatactattgagattcttaatgctgaaattgctagattaaaatctttgattcctaatgacgataattgtcaatcttgtgaagttttattttctgaaattaatgctttgcgagatgtcaattctgttaattgcaaaaaattggaatttgagattaaaaaatctaaaaagttggaatcttcttttgctcttggatttgctttacatgctcgtgttgttgatgagttgattttgaccaagaacgttttgaaaaaatacaaagttgctttttgtgcaagttctttggtcaatgcttcatgtgcaaataaggcaaaacaaaacaatggtgttttgatttctcaagattgttcaaagtgtattctgaatgagatgaagttgaaagatgctttagggcgtgttaaacacatggaagaaattattaaacaagatgaggtgtttatttgctcaacttgtagaaaacaaaaaggtcttttggatgtttgcaaagattgtgctattcttactcaggaggtttcttatttgaaaagttctttgcaaagattttctgatagtaaaaagaacctcaacatgattcttgatcaatctaaagttagcacacacaatcgtggtttaggttttgattcttatgcttatcatgctagacatcctcctactgtaggagaggtgaaattttgattgaatctgagcctaagaacactgtgtttaaatctgctggcatcatgtcttctttgaatgcatcttcttcgaaatcaaatgttgtgaatgcaaaaccttctgttgttgcaaaaccatcaatttcaaaaacatctacttcacaaacttgtcgtgagaagtacacttgttctttttgtggaaaagatggacatttggttggtttttgttttcgacttgcccgcaaacagaaaaaggaaacagaaatttcttttggaaaacgacggtggcaaaaatcaggtttttgttcgaggagcccggttagaccgctgggacagcagcggtcagaccggcctcagggcaactttgcatataattcaaatcatgcttttgtgaagcgacaaggtaagttttcaggtaagtctggttctgattttgttagtgcatatgtacctactggttctactgatcgtgtgactcagtgttggattccaaaatttcttatttctaaccccaacacggaggcctcgacatcttctcgttcgtaggtattttggtggcatactccccatgagtgttcaacgttgagatgacgattgcttttaaaggtaacatcaatttagttttggattgacatatttttggttctactctctcgattattagcttttcatatgctagtatttcaggtagtagtttttttaatacaagtggatacatgtcaattcatgagaaccttggtgatgtcattggcaattggatgtctttttcaaaatctttgatttcttcttgatttattttcgggtagaattgaaggttaatttgagggggagttaatgctttttcatgcattcatgtttattttcatacattgcttttaaatctgaaaataaataaaaataagaaaaagaagagatttgttttatacctctagtatattcttgtgcatggtagcaaaataattgaggtctatttgtttctatgttagcttgtatgcattttagtctttatatgaggattagatatttcttttaagtgagatgatgcatgacacttaaattcgttacttgaattaagaaaatatgcaatattgatgctagcatatggtttgatttataaatgcttatgtatatgctttattgaattgttattcttcaaatagctttaattgttcattgtgaaaagagaataaaaaatatgaaaaaaatgaataccgaatccttggaaacagtctttgacgacaaggacgtattcgatgtgagcaaaaataataggtgccgaatccttagaaacagtcttgacgacaaggatgtacccggaataattgagagaaaaaaagtgagcaaaaaggctcaaataaaagttaaaaaattctcttggttgttttgtgctaaagctaatttgagaaagagtgataaatgcaataggtatatatgtatagtgtttatttttcaacctatgtgcttgtgaatatattgcattataaatcatttgaaatcatgaatccttattgttgatttgagcataattgtaatatgtttgattcatgtttatactatgatgcatgcttgttaactagttgattaatttatctcccttgtcttgcaaaacatgaccttgaattgctttaggtacatttcaaagctctcgaaaaaaaatggttattacaagtgacaatcatgacatcattgcattggtgctttattggttattatttttcatttgtattcttgatgaaatcattatcaaaaggagagaaatatacaaaatgcatgcttcttgaaagagggagaattgaattgtttcgattttaaaatagtcaattttgtgctttgattgaaaattgatgggagaaattctttcttttaaaaagggggagagtttttcttttcacttgtgatttttttttatttttcaaaaacataaaattgcattgtgaagatgttgccaatgtgtttatcaaggaggagattgtgaaatcattgtcatgattaatatttgtgatgaacaattggctttacaaatgatttaatcgatgaattggtttgaaaagttgtgtggatgttggtgtgagtgcgtgtgactaatgtgggtcaggttgtgcgtgtaactttcatttccactaaaagtttttgggtttttagttttccctaccattcaccccctctggtaggcttggttgcttgtgttcgatcctacacattataagtgcagccatggttttccgcgtccaactttaaccgttcgtcttatttaaaaaaaattaaaaacataagtcacgagtaaagtactatttatgttttatcatctcataataataaaaatactaattataaaaaaatttcaaataagacgaacgatcaaagctgagcgcagaaccgccgcagaagagtcatcgagcattagttcactcgtatacttgcatgttttttacgcggaaagtactggtttgggctctcgagcgtgcagcagaggtcaggtgcccagcgcagtagcgaggaaggtccaatttttgacgttccattgtaggtgcgtgcctttcatacctctatgataaccataacttttgctgaaaattgaaccctaaatgtaaaataggggtcatcatatttcattaaaaaaattgtttgccgcccctcaccgttcttaaaatgcagtaatatgtattattatactttatatctcttttattgaatgaatatcttttttgggcagggactgccatgcatgtggctgtgtttagcaggaaggatccagtgcttccttgagcatctttactaaatagttgtatatgcatggttcctacctactctctcttctagtgcgtgtgacatgtgccactgaattcctatcgattcaattgattattagtgctgtataagacgatcgactggtgcactgtgaacgaatccagtattgggaaagggaaattcatagagcttcgggaagaactctagatggagaaaagtagaaaatcattaggtttcatagatatgaaaatagaactcgtactttacggatgtcgccatgttgttgccatgtttcgccgcgtgccctccctatcggcttataataaacaaacaaataaaaaagaaacttgacgatgcttgcctgtattttaaatcaagttagggagtgcatgtgaattaaagattccaaatgaactagagctcatacacatgtcccatcctacagcaatggtggacctaggaataactttctttgccattttctattggtttctggtgtttggctttaattagagcaatatatatatatatatgctgctgtttcttttcaaaaagctacttatgctgcagtggatttcggttggaaagcagagtaggctaatatatttcagaatgccatgaaatagcaaaatagtctgcctattattattatgcaaccatgtatagtccagaaaaattacataatatctataaaagtggaggtacaaaatatgaggatgtgactttttttcttagcttattcattcttttcattcttaagtgtacaaatcctctcctccaaaactctatttataggcaatgtcttgcccacatttcatattagtgatgggccaaactagtgggtaactaggctagacttctacatgccagtggttttctaacattttcccttttctaacattagctctcactgcgtgatgcatttgcctcatcaaaactccgtaaaaacccactgggaaattttggagaaaaatgagtagatagcatatgtttgtaatatcgtacgaattgtctcattaaaaacatcgattaaaaactgtagggaaaacttatccaagggaagaaaagtacaatccacccaattctttattcaatatttctatattgattttgggcacttgatttttcatatcaaaattctggaatgagttaacagtattctccctctgaattttgcatttctctaattctcattatttcggtttctcggacatatttatccaagataagatgtcaacgatgatttagtggacaaatctgcatgattttcacataactcattccgcaatattatgttgtttttatccaatttatgtgcatagaagaacttggggttcatatgcttagtgagtttgcttctcacgtatctcatatacaatttgtatatgtgtgacatattctactttatcctcataaatgatattggattttctatcagaatccacttacttttaggactacatgtgtcacacaacgggtattacaataatgttatagcaaatactgcaatccatagatattagaacgggtcttactgatgagggatgttaggtcccaatcttatgataggtattgataaacagtcgatttgggaggagtcgcgacacaaatcgatccggcttctgaacgaacacgctactgagccctgcaatcgcagcaccacgtctcctctggttatcaaccgtgccgaaacacggttgacctcgtcgagaaggctaatcactgcatgcgaatcgaagaacacaagcaagaacaagatagattgcaacacaattgcatatgaatgattaagcacttgaatttggggttccacaaaccgatctagcgacgaaactgttcttgacagaataatctaagcaaaacccaaaccataatgattacggcgagtattgatatatatattttagggtcgtacaaccaacccttgatgcaaccctaatgggttccaacacgatacacggcccaaagacacaaatacggtgacgcagcaccaggacagattatgtacgtcaacttgttcggtcgattcccgttgactcggaaagaatttggatgtgggaccaaaactattcagtactacagaatacgtctttgcagacggacgacaacgattttcgcatgtggctaggccagccgcatgtgcgaaattttctgcaaagatcgtcatctttgcatacggctagagcaaccgtatgcaaaaattggatttttgcaagcggtcccctataccagccgcatgcgaaaatgaattcagcgaaataaaaaaaaagccgaaccctagcccattgccgcccaatccagccggcctccgcgctgccgaattcgtcaccgtcgtcggccacttcaccgctcccaccgtcatccgtcgttgtcggcgccggatccgcacggggacaggccgccgccgccggatccatgctgtcgtcgcgtccccgctggatccacgccgggatgggccaccgacgcggatcgacgtgaggtcgcgccgccgccgccggatcgacgccgtcgtcgcgccgcggggcagggcggggaagtcgatggcgatgacagagggaggtagaggtggcagatccacgcggggacgggccgccgacgccggatcgacgccgtcgtcgcaccgtcgctggatccacgccgaaacgggccgccgacgccggatcgatgtgaggtcgtgccgccgccgtcggatcgatgcccccgccgcccttggcactggatccctcgccggatcaatgtgaggtcgtgccgccgccgtcggatcgatgcccccgccgcccttggcactggagcccgcggcctctccctcgccggatcgatgtgaggtcgtgccgccgccgtcggatcgatgcccccgccgcccttggcactggagcccgcggccgctcccgccccccgccactgaagtcgccactgcgcccgccgtgccctccccgccccgcgccgctctcggtcggcaccgccaccgtgcccgccacaccccgcgccgctctcggtctgagagagagagagagagaagagatagagtgagagagagaagactgagaggagaggataagatagggttaggtgtgaaattttttgaactgcggaacagggaaggaagagggaccatttttactgcgggctacttaagcgtccgtatgtaaaaatcgatttttcgtatgtggctttttaaatttcaaatcgatttttatgacactagataaactcatatgaaaaagttaaaaacaaagttgtagaactcattgagatctaccatttttctttttgtcatttctccatccgagtttgattgaactataaaatttgaattttaaaatataggaaattcaaataatttttgggtactagatgatttcaaatggaaaagtcctcaacaacaaagttgtataactcatcaagatctacaacttttgttttggtcattgttctatatgactttgtttgaacagtttgaacttgattttcaaaatatgacaatttcaaacaacattttcaaatactaaatgatttcaactgaaaaagtcatcaacaacaaagttgtataactcatcaggatctataacttttattttggtcatttcttcatccaacaaagttatctgtaacattgttcacaaaatgtatatctcttatatagttttataaactatggagagagatatgtaaattttgtgaaaatgtttccatcactttgtcggatgaggaaatgaatgtaatataagttatagatcttgatgagttatacaactttgttgttgatgactttttcatctgaattcatttactacttcaaaatattatttgaagttttgaaattcaaacttttaattgataattaaacaaagtcacaagaaaaaatgaccaaaataatagcaatatgaacgcaataacatgatagagcatggttttagaaacatttaggaaaaaaatcatctaatttggatttcatatgattgagataaactagtttcaattttttaaattttttcaaattttattttcgcatacggctccttaagtggcccgtatggaaaaattgatttttccatgtgggcgcttaagtgagccgcatgcaaaaatgagctcatttttgcttgtggccattttaagaggcccatatgggaaaatcgatttttccatatgggccacttaaggagccgtatgggaaaatgacgctcgatttttgtagacgccactagttatggtccgtttacaaaaatcatgggctctcgtacagaaaaatcacttttttagtagtgattggaaatgttatcttcttagctttccatccatataaagaacgccccaatccgagcatgtatatgacctaggtgcccgttttagtgcagactggtcctagactccgaattgcactcgaagttgacttggtttgggcctccaccttgacttggatgtcctcgatgatcctccatgactctaagtcgttctccaagtgtctccttgtcccctccattgttcctaatcacaatataatcattaggtagcaatctattctcaaattcgtacaaagaagaacataagaacgagctcacctctaaattcaattatcgcgcgcgagctcttgttatcggtccttgaatgaccgttggaggattgttgtgtgtatccgaaggagtgatgtccgcatcacttagtctattcatctcgatatttggtacttaatgctagtctatgccaattcaccaatcatcaaatgctactttagcattgtccttatggacttctaaagatgattagtgaaattcattcgagttcacgtcatcttgttggatcaatcttggcaaatatgcagtttcaaatagacacgggatgttgactaattcagaagcattctatccatatagtaccaaaaataggagcgcaagtattccatgcaatccacttcagagatgctgaaattataccttcgtggtatgtggtccatgtgttaatctcatgctggtgcatactggcacacaaatcttccttatttagggaaattatgcatatatgtgctatgaccatacatcttataattctaagaccaatatggcagaaaaattattgcaaacaagtagtgtaacccaaatcttcataattttagagagttcaatgaagttcatagtacaataaatgtttttataaagtgcatatttgttccataggtaatatgatcgtggcacggccaaaattttcaattgctgctactagcaaaggccatagtatttctatttctattttttttaaaaaaaatgcctgtttctcttaaagtgctatttgtggttatgtggaccacaattcaatctttttctttaatgtttgggtgcaacacaaaattcaaagcattataatcatgtgctaggaaaaagcaacaaaatagtaaacgtctcaaatatactattttatactagaaataatcctttattgcagagaaaaatgtgtgctctactagggtagaaaccatttattcaattcaatattgtattaaaaaatattgtattgaaaaaatattgtattcaaaaattgcaacaaacgatgacaaagtgaattgattaaacaaagtattccggtacgttggattcaattaacttgacagtgagctttttgctcggcagctatgacaatgtttttctagtctaaaataaattttaggaccgatccagcctagcataggagattctacatccgtagccatgcaaataggctaggagttctcttcatgatgagtgtgcttttccttttcttctcatactcatgagtgcattgttctagattcttctttcgttgaggtaaatacagaccagacaagctgctcgtgttgatttcattatcaactgtgtgctggtggtttgggaaggcaatgttcttctagttaacactatcctgaacattacataattctagtctcaactagctaggcatacttcttgtatgcgtactaatgatacttgcgtgcgactttcatcgcgtttagatagagcatcaagagttttcacattattgggtgcaaattcggtgtatcgtattaccatactcttcggatcgtttgcttagtgaatttgaatcgaaaatatccattcctgcgcatagttcttgctctatgagtggtgggtgtgcatcataatcctttaaaccacttttttgtgcagtcaaaagagtgcctatgccctcattcgtctagtgaactcattcaagagatatcaaatagaaatgcttgatcaatctcatcaagttaataaatagagcgcacttgagttaatggtgttcagagcttcctactacagtacaatttcaactttggttgcatatgtcagggataatctagatttggcgaactttctagttcgcgatgccaatcatctttagtcattcgaaaatatgtgcaaattttattcaggtaacatgtacaaatgttgcaatataatggtacacaaaattttcacaaataattccaatatattctatgcaattctatatattttatcgcaaagatattagttaaaggtaaaaacagcattacaaataatcaataataaaaaatgcgataaataaatttcataatcataaacatcaacaagaaaagtgcctcaacttggatggttgggatcgatattcaaaattccttggctcttttatgagagaatacatttttttagtggattttgcaaatatcaaatgctatttaaacaaatatcccaaatgaagagggttatttgtgtattttctagaaaattcagtgtataaaacgtaaagtttccaatgcaagaaatatgcgcttaatttccaaaaactacaatggactttttgtaaaatcgtaggagattctttttccttctatgtttcatttcttcctctttcccccaatggccatgcgcatgggcaagggaagctgaggcggcgcaacacagcctaggcgcacgacggccaagtacgagggtgcaacggcacggcccagcggctatgagccacggcgaagtagtcgtgcgacgatgatgggaggatgcggcggcacgatggttggtgccggaggtggcatacgggcaggcacaaggtgagcggtcggtaggcggccattgcgggtggtcagtgacagcggctacgctagctagtgctgcttgctactttttcctccattttttttcctttttttctttcctttgttttcttctttcttttctccctcccataatggcggcggaagccatggcgccacagggtgtagtgcgacgatgtcggaggctcagcccggcactatccgacgcttagcatggagtgcggccatgcgaggatggtgacacgtggccatccgatggcgaggtgtggcgcgaccatgtgccggcggggctaggagtggcacgaccatgcggtggcccactggccgacggtgcgatgtggcggtctccatggccatggtaggagtggcggggctacagccttctttccttttttcgttcttcttctttcttctttctcccattgttcccgcgtgatacagttcgcggccttcatgttgcggtgcacgatcatggtgggacacgggcgtcctacaaccttgcaacctggatgtcatgacgcaacacaatgaagtgcatgactcgatccgagatttgttcgaggggcacaacttccaaccagtggcactgcccttaacacccgaattggctctccaccgatgactccgagtcggcgggggcggtgtttatcgcgagtggtaaaacatatcaagaatggagagaagaattccatttttgtgattcgattcaaggaatacgatgcagatctacaatttctttacccttctctttcttgtcttcagtagaaacatcatgctgataacgcattacgcaacccctcctgctaaagtatagttcaagagggattgcataattctagaaaaaatggaggcacaagatgtgggggtgtggcttctttctcattctttctttcattctcacgtgtacaaatcctctcctccaactctctatttatagatgatgccttgttcacatttcatagtaagtgatgagcccaattagtgggtaaccaaggctgagccttctgttgacgaacgtaaagttcaaactttaactttcaactcctacacagaaaatactccctctgttttaggttataagactttctagcattacccacattcatataaatgttaatgaatctaaacgcatatgtatgtctagattcattaatatatatatatatatatatatatagggtaagactattctacacccacccgaggtatagaatacttattctatgcccccctcccctcccgattcccccaccccacacgcctctcctgccctccttcccctctccccttttttctccccaccagcgctcctcccctctccccttcttttctccccacccgagcgctcgctccctctctccccttctttctcccgatcccccctccacctctctccttttttgagagagaaaaaaataaaggaataatttgccttcaatgggaatagaactcaagaccttcaactcaaattaccacatggcactaaccagtaggctatttctcagttgtgagagagttttcttagtaaaatttatcttctcatacgtgcttaatccttgtagtatttggccccaaaca

SEQ ID NO: 36530 - DNA, 35157 bp, Oryza sativa
caatatagtgttactgcaatgcatgtgtatgacgttactgcacttttgacagtaatattgttgtgaattacagtaaaccaggaattgaaataaaaatatatgggttcaaagtcttagatgctaaccatatacttgttactgcacaaaagtaaaagtgttactgcacggcatatacacgttaccacctgacagttacacattaccgcatgtttatgtagtaacactatccaagaactacagtaaaacactttgttactgtagaacatatagaacgttagtaaaccagaaatcaaaagaaaaatatgggttaaaagtctcacatgctaaatatacttgttatcgcacaaagttgaagtgttactacatggaaggtacatgttaccacatgtttatgcagtaacactattcataaattgcagtaagacgcattgttactacaaaacttatggcttttactacacacttacaataacgtcgtgatgggattgtagtaacgcataacagatagtagtaacaagtagtaatgctatagtattactacttgtggagagttaagatccaaaaaaacccaagcttcgaataacaatatctctcatgtgatgtatgattttttaaaaccatttgcaccatgatgttagaaaaaaaatgcttatcaaaagtagatccgtcatgactatatttcaactaaattttaatgttattgctacacgtaagacacagtattactgcacgatggctgtcgcgttactacactgtttcgcaagacgagagctgagaagaggtgggtggtgggggagttggtaggcagtttgaccgggttttgactgatgtgggggtgctttgactgacctttgactgaggtgggaggtggctatataatagtttttctatatatatatatatatatatatatatatatatatatatatatatatttgtgtgtgtgtgtatgggcaatgctagaaagtcttataatatgaaacagaggttgtatcaaatatactatcaaatcttagtggtaggagtttaccactaaccacttccactagttttggtaaatatatgtttgcaggacatttaaggagaaaatacacccaccatgtgattaaaatgaacctctggccaattatatgtgagtacaaggattggagggtgcacaagtcagtcgaaaccgacttaaaagtggggccaaaccatccttaatcgccataggtgcccacctgtaaactgctggagaaagtctgtggagagaggtggggcccactagccactcttggcccaccttatctccaccttacatgtagaagaccgggatgaactcccaatgacggttgtgaggggttaaccaccatttgaacagtcattagcagctataaaaggaggtcttcctccgcacttcaacacacataaacttgagctcaagtagagtacatctcacttgtagtttcataattagtacatcagagttctttcgagaattttatggagtgctgggttgtcgccattcttcctacggagttctggagaaagccaggattattggccttcttctctcgctcgtacagcggtggatgcttcttttataaagtaagtatttgagtttgtttatgttctataattagtttatttatgtgagatatatcggtatgtgtttatcgattagtgtgcaactgagtgctctagtactaggtctctggataaaaaaagaagttcctgagcatggctagaatagtaattaataacttaggcatcatgtctaggttaaaaaaatacctttgtttgttgtgtgctctatgaaaagtgaggtaggcagttggtggtgacaacattgtttgttctttgtatacctgcacgttcgggtacatcatagagctcaaggccggacttagcaagacagatagagtttaacctttaacttaattaactaactaaaaagacataggaatcttctctagccaaattattctaaggttgttgttcatggattgaatcaagatcgtagataatgcatgcacgttcctcgtgttcgataccattagattactctaaggggaggtgatatagcggcattccgtacgcttgcgaattaatctgtgattgtaagaaataccaacatgccggttccttaatagttttctatgcaaagatgttttttttgccccgccgagaggaggttcacatggtggagtagcagagatttccaccatttgcacatttaggccccgtttatcacagcgtcagctcccaactccaacttacatagagctggggctgtgccagacggtctagattcacaaaatttggagtggagcggggtgaattgctcgagaaatttgtattgttgaggtggagcggcgaaaacgtggctccacagctccactctgaaaataattatagggccacccatcccttttcatcaaaattacaggaaaatgccatcgcactaccccttagatcaacctgaaccggtgggtgcgattcccatccactcgtcgccctcggggccttatcgctagaaaggagacaaaggggagacgagcgaggaggcggctgcggcgatgactgcgatgccacacggcggcagagctactctctctcctcctcttggagctacgttttgggcaactaggtggcggcgcacggtgacggcgcctttctgtgtgcacgcagcacggtgacgatagcagggtttggagcatggcaacagcggcggtgtgaagggatttctccatatctgtgtgcaagttatccccaaaccttagtaaaccaatttgatagttcagatttagcacatgaataaatacatatgtactccttagtagcactgactgatgtatggaatacaatgaaacgagaaaattaaaccccttatataccactgaaagttcatacattatcacttcaatcttttcacttaatacttcatgtcataatctttttttactagtatattttctgaataaggatgcactttccgacagtgtatgcgcaatgatttgaaagcacatacctccctagaagtagaattatttaggcaattgtcactgtccagttgttttgtctcagataaatagatatacatccaagttcagataatgacaatgtcatattggtggcgacaatggctacccacaattcatttctccctcaactttggttaatttttatggggattgattgcttgattgtaggttataatcacgggagaatgacaatatattattacggctgtagtacaccaaacatatggctggatttgtacattttattttttgctcatgttactttcatgctgctagttcatcttatcatgaaaaataaattgatttgtacatttgatttctgctcatgtcatgtgtgggtagtaactatgatatatgttaagtactaaatttgaacctatgatatatgtttgtgttgaaaaaaaagatttgtgtgagtcagtggatgataggcatggctcaaaatgggccttcgaagggtgttaaaatgcccatgggctctgctgattggaatgactacaacactagagttgtctatgagatttttgttgagcaagtagatgcgggtaatcgtccaaatacctatttatctaatcctaggtatgatgaagtcattgagaaatttgcagcaagaacaggtttgaggtacactaggcttcaaattaagaataagtgggataagcttagggttgaatacaatttttggatgaagttgacatctcaaacatgtttaggatgggataacacaaaggaaactgttacagctactgtggaacgttggaagcaattgaaagcagtaagtattttgaaataatgtgttaaattgataactattgtgccaaattaattgttctaacccattgtataatgccatgttatgtaggatacaccaggatgcaccaagtttatgaaggttggcttgcaaaatgaagagctactgcagaaaatgtttgaagacattcgcaataccagtgtcaaccattggtctttatggtaaggcactataccaacacccaccaatgagtcaattcatattgctgatgataatgagatcgatgaagagacagaggatgatgaaccaagtacaaaacgaaagagaggtagtggctcaaaggtggataagtccagaaagaacaagagtggatcccaaaagatggtagaggagatgtcaaagagtaatgaactctcttcacagactttatcatctatttagtccttcactaaaacaagagaggatcctccggattgttctataaaggatgttatggccttggtggaggaatgtggtgctgttgaacagataaatgagtatttcattgcaattgaaatatttatcaagaaggatcaaagggaaatgtttgttaattatttgcgcactcctacaggtcgctttggatggcttaagaagaagtatgaagtgaagtatgtaaattagttgaatgtggtgtagccatgaattgtatccctttaatcaagttatgtcaatgcatttcagaactataaatgtgtttgagacatatgtttgtatgggttaaatttaattctgaacaatttgtggttgtatcaccttgttgtttcagttgtattcaattatgagaacaattattgagtacctatgtcatgcactattgttggataaaatcaccttgttaattaatgttgtatacccatgaatgtgaacttatttttagacctactatgaacttgttatgcactactattggactgacttattttcagctatatattcatgaatgttgatatatctgtgttctaataatatttattgttttaatgtgtagatgtcaaagtgagagtaaaaatggttcatcagatgaagaatatgaatttgatttgcttgccatgtaattgtttgctattgctgcaagcaatttttgtacaactcgaagaattgcagagaactattactctctctacttggataaggctgagcctaggacatcacgtctcagtggaatgggatgggtgcaagaaactttggccacaccaggtgaatgctacaagatgcttcgtatgaatgaccacacctttattgcattaaatgattttttggttagtaaatataagctggaacttactgtacacatgcatacattagaggcacttgcaatttttctctacatactaggtgatggttcatcaaaccaaagggcacaaaaccgtttcaagcattgcggtgagacaatttcaagaaaatttgaaatactctacgtcgtagtggatttgggacgtgatattgtacgtccaaataatccaaattttcctactgtccatgacagaattaggaaagatcgtcgcatgtggccacattttaacgattgcattggagcagttgatggtactcatatctttgcattagttccagatgatgagaagattagatatatcggtacatctaaatcaacaacttaaaatgtgatggctatttgtgatcatgacatgagatttacctatgcatctattgggtaacctgggtcgatgatttccactatgcgcgtagagatttccacactcatgtcttcattacactatgtgcatcatggtcaaactcatgcggaataatcgattccaaatttacatcaacaatatatttatagacaatcagcacatagtttctcaattttaaatattgagtttaactccctggtttgatgcagagcagcagaggccgcttgtcttttacggtgatgacttctgatgcttgtgagataatcctgtctgcggcttggaagaaacttaactgaagaagtgtgtgtttagtggtactaaatggtggaaatttttttttttggaaacttattagagaaactcagtagtgtttgtctctatcttttggtgtgagcttaagatattttagagagaatctttcctgtcaaataaactacaataaaaggcagcacttttctataattttttttaaacttgtcacaatgaattgattacactatttgtggaaattggcaatgtgcctttgttgggccattttacagactatctgaaaatgaaaactcatagaggaatctatttataacgcctgaaaataagtatcctatatataggcgtctttcaaaacgtagatgcaaaagtaaatcattatagtgtattaaatgattctctctaacttacattttattaaatttagaaaaatataggtaactgaacaaattaagccacgatatatgcagctttgtgaaatttactcctatgtttttgttgcaatgagtacacaaactatgcttgtattcattaccggagaaaaggttttccaaatgacactggcaaataccagctagatcgatctaactgattgataatttcttatagaataatacgatcatctctaaccagaaaaaccactgaaaccttgttttccaacccatccacgagtatacgacaataaatttaactaaaatcttggcccattttcatgtacatatgtattttgtaatcttttttatatattatttatatttattcactataggaacctctcctaccgcttactttttttaaaaaaaaaaatcttggcccattgaaacgaaagggccaggattccagccatcctatacaaggcctcagttattttatattaccattcaaaaaagaaaaaacaaaccactgatcacagaacgtttttgaaggaaaagtagacaactagacatacagcgcaatatgaattatgacaagatcaaggtacgagaaagcatgacattgtttacatatgctgaagattacatcggcagtagcattaatatttctgtaaacaaaattctatgaagaacaattaatacatatatacagaactttcataaaaacggataatattttgatggatttataagaggaggaattaactagtacaaatcttccacatgattgacatgcaaaagccaaagaagctcgtgttaagtcttctatattttctgagttctaagcacccaaatgcacagtttgctcaacaaacataaaaggcatggagtagcagaactaaatatacgaaattgggaacatcagatgtgtttctctgtggttcacatatttttagcataaactacaaattcaggttgctagactagattaatcctatttgttcgattaactatatgaaaactaattttaagccacgatatatgtagttttgtgaaatttatttactcttatgtcactagtacagatccttccatctgtgacggcccataacaagactggaatttgcgggccgtcacaaggaagtaatctcaatcgggcagatatggtcgcacagccatggtatatcggcataaaactaaagcccgtcacgaatgacacttatctgtgacgggctatagttgaggcccgattgagatgagggttccatatctcaattgggccctaaaagaagcccgtcacagatgagggtcatctgtgacgggctccaactagaggcccgattgagatagtttattgcccatcacacatgacactctttttttacggccttttattaaggcccgatagagattacttgtatgcccgtcacggttgattgttttagggacgttacagatatttgttgcacagtataaataccccccaccacctagtgtaactgtatcccactgttcactattttggtgggaagctgtagggggcgattttttgtcctttttccaaggaaaatagaaattaaattcccaaaagtgattaaaatggatcaatcaagtgagtaatataaatcattaattgagcaatttcatcacgtcttacttttgcaatactaatattataatatgtgcctctaatttgttttttttttagcaattgatcgaagttggatgtatgccaaaaatttgaaacgtcattctacggagtactgaaagggcgtaattaattttatgaacgccgcggaggaggatcggataagaagaaacagtgattacatgtgttgtccatgtgcagattgcaagaataagaatatgtttgatagcggagaggacgtacacggtcatctgatacaacgaggattcatggagggctatacatgttgggtgaagcatggagagcaagaatcaggaagtggagcagcagcagacagaagtggtgcgcataatcaggaagatgaaaatgagcatgacatgtttataccttctccattaggcggtgaaatggttgatgtggatcacgatctgctgcaagacatgttacgtgacgttgaggacccagcccagaatgagagagatggaatgaaattcagcaggttggtaagtgatttcgagacgcctttgtacgctggatgcaaagcaaaacacactaagttgtcagttaccttggacctaatgaagctgaaggcaagtagtggatggacagacaagagtttcacagatcttttagtaattttgaaggctatgcttcctgttgagaacacattgcccgagatgacatacgaagcaaagcaggttctgtgtccactggggttagaggtctgtagaattcatgcttgtcccaacgactgcatattgtaccacaagcaatatgcggacttggatgcttgtcctgtctgcaaggcttctcgatacaagcgaaagaaaagtgctgacgaaggaaataagtcaaagaggggtggtccggcaaaggttgtgtggtatctacctatcatttatcgtttcaagagaatctttgccaacccgaacaaagcgaagttagtacgttggcacgccacggaaagaaggaatgatggtatgcttagacacccagcggattcgattgaatggaggaatatagatcgaaaacacaaagactttgctgccgaccctagaaacatgaggatatgtctttgtacggatggcatgaatcctttcggtgacatgagtagtactcacagcacttggccagttcttattgcgaactataacctcccgccatggttatgctttaaacggaaatatattatgttgtgcttgttaatccaaggtccaaggcaacccggcaatgatatcgatgtattcctggagcctgttatcgacgatctggagattctttggaaagaaggtgtggaaacttgggatgcatatggtcaggagaacttcaagctaagagttctattgttctgcaccattaatgactaccctgcactcggtaatctttccggacaaactataaaaggaaagaaggcatgctccgattgcaaggaacatacatgaagccggtggctgaagaaatcacgaaagatggtatacatgggtcaccggaggtggctcccgctacgtcacacatttagaagaaagaagaaaatttttaatggtaaaagagaatttcagcctgctcccaaagatttgtccggagatgaggtccacaatatggtcaaggacataagcaatgagtttgggaagaaaagaaaacgtaacaagacaaaggagaagggtatgtggaagaaaaaatccatattttggcggctaccttactagaaagatcttgatgtccgtcattgcattgatctcatgcatgtagaaaagaatgtgtgtgagagtttggttggcctgatgttgaacattcccgggaagacaaaggacgggttgaacgcgcgccttgatctacaggacatgaatattcgcagcgaactccagcccatacgagatgcagagacaggtaaagtgtacctccctccagcctgccacacactgtcgaaggatgagaagatcgcaatgttatcatgcttgaaggatattaaagttccatcgggctattcagcgaggataagtaagtatgttaaattggacgatctaaaacttgttggaatgaagtctcacgattgccacgtgctaatcacacaaatcttgccagttgctatcagaggcattctaccaccgaaagtgcgtcacacgatccaacgtctgtgcgccttcttcaatgcaattggacagaaggttatagatccagaagatctagatgggctgcagaccgatattgtgaataccctctgtcacctggagatgtttttcccactgtctttctttgatataatggttcatctccctgttcatctggtgaagcaaacaaaactatgtggcccagcatttctaagggaaatgtggccgtttgaaaggtacatgggagttctgaagtcttatgttcgtaacagagctaaacccgaggggagcatcattgaaggttacacgaccgaggaggctattgagttctgtgccaattacatgtccgatgccgatcctatcagagttccagcgtctcgtcacgagggaaggttgtcaggtgttggcacaatcggaaggaaaagaattaggcccgatcaaacgtcgtacgcgtaggctcattacgctgtgctccaacatatgcagaagttggcccatactttgaggagcacttagtgaaaatccgagatgagaacttggggcgatctgatgcatggattaacagagaacataattcttggttcaacgaatggttcaagaatcgtgtgacaatgtccacggatgtcccaaatgagacagtacagttgttggggatgggaccgtcttggaccatagacacatggcaaggatacgatataaatggatacacattttacaccgtcaaacaagatgacaaaagcacagtgcaaaacagcggcgtccgtatagatgcattccaggatcaagttgggtcaaacacatactacagccgcattgaggagatctgggagctaaactacgtcaagttcaaggttcctttgttccgctgccgttgggtgaatctacgcactggtgtcaaagccggcaaggaaggtttcactttagtagatctatctaaggtgggatacgccgatgaaccatttgtacttgcgaaacaggtcgagcagatattctacataaaagacccttcaaacaagaagatgcacatcgtgagggatggaaagcgccgaattgtaggagttgacaacgtcgtcgatgaagaagaatacaaccataatcttcatgtaagacctcacattgaccttgacgatgatccccaagagcctgtttacattgacctcacaaatgctgtttacatttgtcatattgtcaaaatcaatttcaagctgttagaaacaaagttatatagataaatgaccaaaataaaagttgtacatcttgatgagaggatcaattttgttgttgaccatatttcgatttgaaatcatttactatccgaaaatatgttatgactaataaaatgaattattatacagcagctatatattttgtactcacaaatataaagacttatctgggaaatggaaaaatagtcatcggtgacgggccttagttcaagcccgatagagattaatctatctctattgggcattatcttagggcccgtcacagatgagtcatccgtgacgggcctgaatgtcatctcaatcgggcattagtatggagcccgtcaccgatgagtcatctgtaacgggctctacggcaaagcccgattgagatgactcatcactctaatataactagggtttctcagatcggatcgaaaatttttctaagtcccgctacaatttcccgcctccttagaaccctagcaccgccgccaactcctcctttgccgccgtcgtcctccctcgccgccaccgccaccgagaccgccaccaccgccaccgagcccgccgccaccgccgccgagcccgccgcctctaccgagcccgccgccaccgccaccgagcccgccgccactgccaccgagcccgccgcctccaccgagcccgctgccgccgccaccgagcctctacaccgaccggcgtcggccttcctcgtcgtcgccgcctgcctcttcaccgacacgaacagcagccaccaccgaggccggcgacatccttcctgcaccgagcccgccgccgcctccaccgaccggcgacgccctccaccgatcccgccgccgccaccaccgagcccccccggccgacctcatgtgagtcctccatcgcgcctccctctgctacctgcatgtggttgataatgaaaatgtggatgttgggatgaaatgtggatgttgggatgaatttagtaatagatgattttagtgattgatgacttgatgatgaatagatggaatgtggtgcattaatgaatttagtgatagatgattttagtgatagatgattttagggattgatgatatgtggtgaacgaatgattttagtgattgatgacatgatgatgaatagatggaatgtgtttcattaatgaatttagtgatagatgattttagtgatagatgattttagggattgatgatatatggtaaacgaatgattttttttgattgatgacatgatgatgaatagatggaatgtggtgcattaatcaatttagtgatagatgcatgctatgtggatgaatagatggtatgaggtgaatttatgattttaggatttgatgatatgtttaatttatttatatgtgccattcaattaattctatcattgtgatatgcgcaatttagtttatttatatgtttcatttatttttataagtgacattcaattcattgtaatagattgtagcactcaattgtgttttttttgtttttttggaaaaaaagtagacaatgtctcagcaaggcgaaccaatgtcgacgacaactagtgggtcctcaagggcacgtactcctaggacagggaacaaaattcctaaggaacggttccgcataacagcggtggacgccgtagggttgcggacatctccaaggaaaatattgagccgatttaggtctatctgtggggtcatagggaggcagaaattcagtattctgcaagacgacttcaagctcgtgccggccgcagagaaggacattgcttggctaacgttcaaggagagctttgattatcctgcggagcatgaggaccgtctcaggtgggctgctttcaaggttatgggcactgcttggaagaacttcaagactaagctagtcggcgagttcgtctacaacccggcaaatccagatccaagagagaaatttccttggatcacggaacaggtctagtcggaattccatgcgaagaagtcgacccccgagtccagagctagaagtgaggcatatcgcttgctccagaccaggaaccagcatccgcaccggcttggtaccgccggatatgccggtaaggaagaggaatggcagcgtgaggatgaagaagcggaggaatcgtgcacaccgctcatgtttggcgatatcccacaccctcgggctaggaactgggccagggctaggtaccagaaacatgatgatggcacaatcttcatgccaaatgcagaagatcaacaagtatacgaagctatagtaagtgtctaatcaaactagatgttcgcattgtttcccatcgtgcagtttatttgaccccactaaattgtaatgcagaaggagttggttgccgagcaacaagccttgcaagaggcctgctctcaaagacgcgaggacgacctcctcacgaaagcgttgggcaacaaggaacaccgtggacggacacggggcgttgggtcttctgttccctggaagtatggatttccagactacgcgtggcagtacaagaagcggacttccaacaaggcggagaaagatgcacgccttgtagccaagatccgggagtcgatacgagctgagctgacatctggattcgacgaaaagctcgagtcgatgagggccaagattaggcaagagatccgaaaagagcaacagatcccccaggctgccgctgctgctgcgcacaaagagttaggaagtcccaccgaaaaacgcagcagttgcgcatcaactgagttggcggaaaatccaacatcggtcgacagcgccgtcgaccacataacggtaaccgtgaacttactcaatacatgaaagacgtaacgaatccatatgatatataatattctaaaaaaattgattaatctatcgcaggaaccaacgagctgcaccctcacagttagggtgatgccgaccttcactgttccagcagccgagggacttgcgtacaagccgaccctagagacaagagtgcatggagcgcaactcagggccggctgtgcaaaagttcaagtcgactcggtgaagcccgaatacgagctgttccctctgaagtatccaccgaacgacgaggtcctctcactaggaaatgcccgtggtaccttcatccaatggcccaaggacctcattgagatcagggttacagcgaggccaaccactgcaccaggcagtcgtccaccaaagagacccgcctctgctccttcagcccctcctgctcaagatcgtcatgcacaatcttacgatgtgcagttgcagtacgacacggattttggggaggaccgaacggaggccgacagcaaggcgattcatgaacccccaccgatgaagaagagcaggaaggcacactcttcccctcagagaattactctcgataaacccgaagcaaaggggagaggaaggggaggaaaggtgcagacctcgcttctagctccaagaaagctagatctgggcaagggccaggaagagactaagggcaaagaggtcaagaagaaatacgtcgctccacaggagttccaactaggcatgccattggttggagatgacgtgcttgccgcaatgggcaccgcttgcaaggaccttcacttatactacatggagaaatctaacgccaggaagccaagtaaagctaccgatatccttggacagcacgatggaaagccattccttggtccaacaaattatatcgtggtcgacttcaaggatcttttcgacctctacaagctccgagcggtggacacaagcctccttaagtgctactccttgtaagtattgtcgcccaactcattctggtaataacaatcggtttaacttccttacaagatcgttgatcctatgtgtaggttaagttggcaatggtgtcagaagcatgcaccggaagttgccttccttcatccacaagtggtcactgtcacaaatctccagaatgaccgtcaaggaatggtcaactacatctacgacaccttgtggtcccgccgagacaaggagtacattatgtgtgcctataataaatagtaagagtgttaactaaatatacacaacagcatgacacattccttgagtacttaattaactttcactatattaatgccgcagtgcccattggatccttctggtcataacacctaaatggagtacatgtcattacctgaactctagaattgataagaacgcatatgattggaccccaattcaactagcgatagatgaagcgtgggcctaatacgtgcaaagaggaggcctcaagaagacaggacatgacaccctcatccacaaaaaagacttctcggtgaagcaacaaataggtgaccagtgcggattccatgtgtgccacaacatgcgacttctgtatagagaaaaggtgaagactttggctgagtttgaggtcggtggtctcaattgtgatagactaactacattttagtacttatatatgatcgatcaactaatctggaattatgacaatgtagggcacaataaccaagtctctgactaccagctttgaggaggttcgtgaggagatagccagcttcatcctccgcgaaataattaaccccaaaggaatgtttaggcttaaactaaaatgatgaacaatgttgaacttctatgtttaggcaatgatgaacacttattatgcaactgtggtgatgtaactgtgatgcttatatttatgtatatatttcatatgtttatgttaagacttgctaaataaatatttgatccaattaactcggttttgcaggtgaaatatgataaatatttgaatggatttgaaatatgtgaatggatgtgaaatatgagatggctgtgaatgtgtggttgtgtgaaatatgttgatgtctgtgtatgtgaatgcatatgtatgaatgggtgatgctggggagctggggatattggatatctgtgtttgtttctgtcatttttgcagcgggcatggctagcaaaggcctgaggctagtcaaaaaaacaaaatttattttttttgtggattatagtcatctgtgacgggccataactaaatgcccgattgagatgagatcatctgtgacgggctatagcttaggcccgattgaggtcactagtcatctgtgtcgggctctagtttaggcccgattgaggtcagtagtcatctgtgacgggctctagtttaggcccgattgaggtcatcagtcatctatgacggactatagtttaggcccgattgagatgagtatcatctgtgacgggctctagtttaggcccgataaaggttagtagtcatctgtgacgggcgctagttgtggcccgatagagataggtcatctgtgacgggctatagtttgactggtcgtctgggtcaaagctatcggtgacgggctttacttagggcccgattgagatatattcattcgtgacggccgtttgcccgattgagataactcttcacatcagtgacttctagcctgtgacggacgctgtgcccgattgagatggggcttaccgcccaattgagatgagggtatccgttctagtgtgtttttttcactgagtattgtcaacagaaaatatatatgtttgtacagaatgacgaagcaaaggttttctttcctcatcaggcaaacatcaggttgatctaaccaattgagttcatacagaacaaatatataatttcttaccgggaaaaccattcaggacttgttttaatgggccagatcccaacccatccatatgtactagtttacaaggcaggaactttaactaaaatcttggcccatacacataaatgggtcaaaatttcagcccatgcgacacaaggtcttagtaatttgattttccccatgaaaagataaaacaaaagtgaccacagagcacttttcaaggaaaaataaagtacacacagcacaatattgatactgcgaattactaaaacttggtgcaaatattacggatacggtaatatttgtgcctgtaggcatctatatgtgcctgtaggcactatctgcaaaaaataaaatatacggatacggtattgtttttttatggatttgtaagaggaagaataatctgtatctgactatctatgctattctaaaagaagtcaaatggtggtggcagtgaatctggcaccaccgccaactctatttataatgtttttacataaatgtatttatataacgtttaccaactacttatacatgttcgttaatatagaaaatagttctacgtacatattgattcaatcttatttgatctctaaaattgtatcatgcaaatagatctatagggacgaattgttctaaatacctcacaattcattgtgttaagctctttgcgcttcgtctaaattctaagcatttgaatacacagtttattcagcagacatgtaaggaattgagtagtaaaaccaaatatttgtagtgggagcttcagatatctttctcggtggtcctgacagcttaagatacaattccaggtttttcgagtacacaaatcccatgtgttcaatgaacttactttgttatatatatgagaactttctactttgaacatactgtaacatcaagtgtccttttaacttaccttaacatcaagttacttccaattttagtcaatatagtactggttcatctgacataactttctgcctaactgaatccctgaatccattttaactagctgaccataaatcatccaatcaaatatgaaggcccaatgacatttcaagcgcaaaaataaataaggctgatggtatcaaacaagatcatatatagatcatcgtcatcttactagataaacttacatatattaataacccatacgccatccataccgttggaccatcagcatcatcttactaggcaaactaatatatactaatccatgaccagatcacatatcattggatcatccttaccatcttataatagatagagtactaatgcatcctaaaactattggcgtgcagctatatgtaacaaaaggggcacagcatgcacaaagtcataccacgatggaggatcttgtcaatccatgttgttgagcaacgtcctcgtcacctccttcctcatactatctagcttcaacatcgtcttgagctccagaaccctctgcttcttcgccatgccgttcatacggacggctgtaccgtcatcgatgaactccaatcccatcttgagaacatgtccacccaactcattggtgctgatcctctccacctcatcgacgagataaggatacagaggacgcagctcctctaggtccctgcggcccctggttcccgacgccggaatcgagctcttctccggagccggagaggttggtggtggcgcgacggggttgccccaaatggcacaagagagctcgaacctgttgtcgcctggtacgggccgaggaccggagagcattttgtcgtactgggtccgtaggcggcgcaccttctcgtaaatctccgagacggtgaactcctccttgtcgaggccgcggccggcgaggacctcgggcagctgggagcgacccgggggcgcgccgtgcttctcgacgtgcgcggcgaggcactccaggatgcggagctcgtccgcctccgaccagacgcgcgcgaacgcgaccggcttcttcgtcgccttcgcctttaccaactccccggccggtacggaaccctccaggcgctccgcccccagcgcgtcccctcctcggccggggagctcgtcggctggagcggatgaggagggaatcgcagaggcggtccggcggcgggtcgtagccatcgcggcgagggtttcgtcgccaaaagcaaagtggggtggtgaccagtctttgactaaagtcacccttcgtttccggaggagaagcacagcagttgaattattaaattaaacgccctttgggcttccggcttcccccatctagcgagggccgtcacgtcagatacttatttttataagtaaattaaatggacagaatacaatttattacgttggtgtaatttagtgtggtaatagagactataatctagctataaacatgtttcgatgaaataaaagagaagagagaagagcaactggctacagctacaacacaaactctaagatgtatttgtgtatgtcagatgggataagatattaattgtgtagtatatatttataggtaattattgtatgaattgattattaaattgactatagataatttggagccaacggttagctatactattaaacttgctctgaaacgctagttttagtgcatgaatttatctaaagcgtcccaaccacgaaaataaaaatactacatggggctaatcttattaatttaagtgttgactacgatacaattattagatcttatactcattaacttatccttagcacatacatgatcacctaaacttatgcgggaattgactgaccggttgagcttgaagccatcttagtcgcggtaggagtcgtcggtgatgtcgaggtcgtggtagcaagttgccggaggtgaagcagatggcgtcgcccttcaggccgccacctgcactggccgggaacggcgttggagaacgcctttcggtctccttccagcacttcttaggatcggcgttagggtttatcgggagggtttagtgtacttagatcgtcacctaagcacagacggcctctcccttttaatatagcgctagaggagatcgggggagaatccgttatggagaacgatgcgcatccgatcggcgcacgtagtggatgagatgcgagcgtatcgctcgctcctcgccgttagccgcgtgtgggcgtgggtgtgggtgggcctagaccacgacgtgtctctctggtctcgttaccaggagatcaaccaacattctcccacttgatcttctcccacttgatcttaatgctaacgagtccagtctaagtagaatagcgaaccaaagcaatgtgtcatagtaatcaataaaatgtcactatgacaacagtacctatagccactataataccttgataggaatcaacttaatcttattgggtgttgattgattcttatgcctctattctagaatcttgcttataggtcacctactaatcccatgccggcaatatgctcgttaaataagttgggtggtagacctttagtgagcggatccgcaagcattaacttagtgcttatatgctcaaccttaattgtttgatcttggattctatctttcacaacatgatacttaatgtcaatgtgcttggcagctgcacttgacttgttgttacttgaatagaaaactgcggctttattgtctcagtatatggtgagtggtccattagcgctgtcgaccactcttaaccttggaatgaaattctttagccataccgcctgtccggttgcctcaaaacatgcaataaactcagcctgcattgccgacgatgcagtaatagtttgtttggagcttttcaatgaaatagcccctcctgcgagagtgaagacataacctgatgtggatttcttaatgtctatgcaccctccaaaatcagagtctgagtaactagtaacttcaaggttatctaactttctataagttagcatgtagtgcttagtgccttgcaaatagcgaaggactttcttaacagccttccagtggtctagtcctagatttgactggtacctgccaagcattccagtaacaaaagccaagtccgctcgcgtacagacttgggcatacattaagctcccgacagctaaagcacacggaatcgccttcatttgttccttttctaattgattccgcgggctttggaataacccaaacttatcgcccttgactattggagcaggcgtgatagagcacttactcatattatatctgtttagcactttgtcaatgtatgatctctgagataaccccaatactcccctagacctgtctcagtgtatctcaatgcccaatacataagaggcatcaccaagatctttcatgtcgaatttagatgacaaaaacaccttagtctcatgcagcaggtgcttatcgctgctagccaataagatgtcatccacatagagtattaagattataaacttccacccttactcttcatataaatgcaattatccacttcattttccataaatccaaagcttcttatcatattatcgaatttaaggtaccactgtcttgacgcttgcttaagaccataaattgatttcttaagtctgcatcccatatgttccttgccttccacaacaaaaccttccggttgtgtcatgaaaacttgctcttccaagtcactattaaggaatgcaatcttaatgtccatttgatgtaactctagatcataatgagctactagcaccatgacaactctaaatgagtctttctttgagacaggggagaatgtttcattataatctaccccttctctctgtaaaaaccccttagctacgagccttgccttgaatcgttcgacattccctttggagtcatacttagttttgtagacccacttacagcctactgtcttgaccctttcaggaatatctactaaatcccaaacaccattagtgcccatagactttaattcatcttccatagcttcaagccacttggatgaactttcactattaatggcttcattaaatgaagtaggatcgtctgatttcccaatgtcttctccaatatagacctcatagtcactgcgaatagcagacctcctctctcgctgtgttcttcttaatggttcattagtgatctcagtgggttgtggagtttgcacattatcttgtgctacaggttcattaatatcctcaactagagcctgggccacagaagaagacgcctacggcacaatctgaggtacagttagattttcctgttggatggccgattgcgagaaccgaatctcctcaaggtctatctccctgttctgtaagctcccacggatttgatcattctctaaaaagactgcgtgtctcatctcaacaaacttatggacatggtctggacagtaaaaccggtaccccttagatctttctggatatccgatgaagtgacagcttacagtcttagaatctaattttcttaaatgtggattaaaaggcctagcttcagcaggacagccccatatccttaaataatttagagtcggtttcttaccagtccataattcataaggtgtcttaggtacggacttggtaggaacccaatttaatatatgggcaatagactttaatgcctccatccacaatttcacagacaaactggaatgagtaagcatgcttcacaccatgtccattagggtgcggttgcggcgcacagccactccattctgctgtggttctccgggcatagagtattgggctacaatgccattttcttgtaggaatttggcaaatggccccggaatttgcccatatggagcactcttgccatagtactctcctccccgatctgagcgcactactttaatcttaacattttgctgattctccacttgagccttaaaaatcttaaatttttttagtgcctcagaccggtcattaatgggaaagatataaccatagcgagagtaatcattagtaaacgtaatgaatgaatcataaccatccactgacgttattgggaatgggccacatatgttcgtatggattaattgaagtactcccgtactcctaggggctcctttcttcattgtcttagtaaatttgccttttatgcaatctaagcagggattgtcctcagtaaaatctaatgaatgaagtatctcttccttaatgagacgttccattctccccttcgaaatatcgcctaagcgacagtgccataatttcgatgaggtctcattaatcttaacattacatacaacatcatgagcattcattgcagaattatcaagagagagcaaataaagattgccttgctggagagcaagacccacaatctcatcattaaattgaataaaacattctttgtgtccaaaatgaactctaaaactgtcgcgcccagaagttcttttccctagcaaaaattcaattaataaatggttggaagaaattatttgtttaaaggcaagaaagaaaccctaaattaataaatgcaaataataatcggaatcggcatgtggaatttttcttgggttctacatgtcaaaatacgctaacaggatttttagtggaattttcagagcattggaaataattttaaccaattaaaataagcaaagtgcaatattaaatccctggaaaaaaaatcctttcttctttttctttttctttcctcctttttcctctcttcttgggccgtcggctcggcccatttcttcccgcgccggcccgctcctccctcccactcccgaagttctcccggcctccctctccctctcgggcgctgacaggtggggcccacctgtcagccctttccctaacctccggccgcccacgcctgcgccaaccgccgccgaaaccaccacccatcgccgcccgccttccccgccttccgcgccccactccgcgccctgcgcccacgtcgccgcccaccatccccactcctcccactcgcgcgtgcaccccgcaacggagggattcaaattcgaaactctctctctctctctctccattccccacgtcggcgagaaatccggccgcctcccggcctcgtccgtctctctcgagccccaataaagcttccccgcactcccctccacctttttcctctttccgccgctctctcccgtgccctccatcactcccgcaccgctacacccgccgccgccgccttttccactcctccggtcgccgctcgccgccgccgagtcaatctgcgccgccattagcttcgccgccgccaaagctaccccggccgccgcatccccatccaatcccgccgtcggggcccgcttctccccgcgcgccggtgagtaccaccattgccgccgccttcggccatggtttccgcccgccgtagaccacccctctccctctaatccttcccattttgttccctaggaggtcccggagatcgttcgcccgtcgccgtcgtcctcccgtcgctcgtcgtcgtcgttcgccgtcgtctccactcgcgccggccaacctcggtgaaaaattccccctcctccctctttccctctcttccgtgtgcgtcgccgtcctccgcgcgcgcatcgtcgtcttcggccgccgccgccgcttttcgcgccgtctgccgtcgccgtccgcgccgccggttgccgtcgccggcgaccgcgcgtgccgccgtcattcgccatgcttggcctgccggctttgaagccgagccgagccaccagccgcgcccctcccgccttgtgccactgccagtggggcccacgtgccggcgcccctccctctctctcttgagccgccgctcggtggggcccgcttgccagccgcccctctctctccttgagtcactgacccgcaggtcccgcgtgtcggcgccacccctccttatgctgacgtcagccctgggatgaattattgcgcaataaattgattacggcttttctttaatagtaaaaacacagagaatcttctaaaaatcataactaattcatccgagctccgtttaagtccattcaagtctcagtaaattcataaaaatgtatagaatccattaaaaatggttttgtttcctgtttcagtagtcttatagcatgttttgcttgtgtgctttgtttgtcgcgtagatttcggccgtttcgtcgattcgtggttgctcgaagacgttgctgtggtctcatcagtgcgagagcaaggcaagtcatacattgcaattgatcatattgtacccaatttacaagtatcctgcatttctattaaatattgcattgttttacaatatcatgtgggatgggtcctattactcagctatatgttgtttcccttacgcctttgataacttgggtattaaaatgactagatgttggtttaggagatgcttagccatgcttagttcaactagtgcacaaaaggggggtcacattaaagcatagactttgattattggcaatagctttggattagtgccaccgcaatggtgttagttaattaaaatacattacatggtgggctgtgggtgcatggttttgctagtcgtgcccatggcaattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtctcacccctagtttagcttaatgaactggtgtagttcaggtggttggttgggcctgttgcaacgtgatgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagccttcaggcttagctcgcttttatctctttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaaaaaccgcgttcggttaaacatgaaacagaaataaggttccttttgacagatggaacataaagaacatcatctagtgataaatgatggcctccttccaaaactaatgaaaggtctctaatagcttctacatgaagttcgtttccgtccgccactttaagacttcgctccccctttgcgatagtcctcacggaactcaattccattcttagcgagccacttcttaaagccattacagttcttctgaatgagccctggctttttgcaaaacctgcatattatggcacttgctgatggaccaggagcaggagaagctggtgtcttaggcttcccctttggcttgggcttgtgtggagagttcctgggtttcttactggtttcagcagcacaaatctcatcagccttccttttgcctttctcattatcaacaaggtaggcttgcttctttgcctttccgccttctgacactcctcctcctccacagagtgagagatgagctcggcgattgaccacttgtccttctgagtgttatagttaatcttaaatggaccgtagtcagatggcaatgagttcataatgaagtgaaccaggaaaccatcagagatggacatgtccatactctttagttgtgccgccatgttggtcattgtcatgatgttttctctcacactccccttcccgttctaacgagatgtgagcattctcatgatgagagcactagcataagttttcgaggagcccttaaagttctcctcgacattagcaatgtaatccttggcgttttcagcatctggaatgccgcctcttaatatacagatccaaacataaataaagcgtaaaatacttacagaagaggcacttagtcctcacaccgaaacgaaagcagcagcagcggaaaaggcgatcctagctgggcttcaactccactccacaggcaaaactcaactggggtttgagccttagtcttctaacttcgtcttcagctcagaagcactacacttctgaaatgggggaacaatagcaaatgctgagtacaaccaccgtacttagcaagccacaccaacaatgcagacgtgcaaggggatacaaggacggtttacggctatttgtataaaggcagttgtaaaacattttattgagcaaaacagtaaaactattgagtaattaaggtaacattcaatctccactaatcaacgctacaccacgttgaacaggcccaaccattccacctgaactacagtgcattgagtcaatttattgggactgagactaatcacggtgattctggttgatcgcccataaccgtgggcacggctattcgaatagttttactctggccagaggtgcacaattgtacccacaagacacaatccaccggcatgtaaccatgcccggccggacacgtcaccatgtcgagtgattgtgacaagacctttcatataaccccctctgaccaaacacaccacacctcaggtttcacccgcgcccccaacaggcagcgggcagtcccctttcatgcctaggcaaatcggaaagccgcataggccatcgcagggcccatccgaactccatcacgctcacccttgcctggatccgtcaaccagcggaaagctatacttcaagtcaagcagttacccattcccgcttgtggcaagcgctgtatgtcttccagtgcatcccgcgaaccggtccttaattgccatggttgcgaccagcaaaaccatgcacccacatcccaccattcagtcgcattttaattagataattacgaccaatgcaacatggtcgggtgtcttgagcacgcagcccgttctaatactaaaaaggtctaatactgcaattatcccatcaactgagctagtggttgttgaggacatcaacaccaacgatacatccacgcctccacaagtacaacttcatggtcctattacccgcgctcgtacacgtcaactcaactatcaggtgcattcattcttaaattcatatgattcttatttataccccagagacacgtgcactcttgttttactcaggaacaatggagaggatcaaacggggagaggatttgcgcgggatggattcggactgcagcatagcaccaacttctgatggccgccacgacttcatgcgaactccgatttaggtgtgcaagtacttcatgtccatatcagttctagagtggccgcaatcttcattttactactgagtccttttctgtccacggtgctgcgtcacctctttaggcccaatgggccgtgtatcaagttgggtccattagggacgcgtcctaggttgagagaacgaccccagcacccctgtggtcgtcctcttcctcttcttatagctttctccaccgccaagaataatcgggttttgtttagatcaaagtatagcatcgctactttgctgagttgatcccgtgatcgattagatcgccggattgcttgttactgaaccccacttgttacttctgttgattcaatccaacatctttgattcgcaaatttagttgatgttcatcttgttcttactggttctcgattgcttgcaggaacaaatacccttgtggttgggctgatcgtgcatccgtcgagattcacgacttatcactctggagttggtgtaacgattgcaaaggcgcaacatccctggatagttgtagtcggatcgccaacgtcactccatccaatcgacttatcactctcatcgaaagatcgggacaccctcgagcacatcaggtggtatcagagctaggcccttgtttaagggggtgggaatgatgaggacatcctccactattacccgctggcaaagatgcaaaagtcggcgatgaccgtgtgagcctctaaataatcccaccttgcttagcttgggaggaggaagccaccttaaaagggagagccactcttcccctattggactagtcttttagggagattgggcctttccctgagtaggtgtgcctatgaactgttggggtccgggcaacctcttaagttattgggcctcggccaaccccaactgggccggattgttatcagtggtaattaagcatggctaagcatatagttctagcttggtcacataagtaacatgagctagttgatttattacccaaggttgacaaaggatagatatcaaataataaggcacaagcaagcagatagacaatactcggatcccctgtaattagcaaaacatgcatatttatttgcaaacggtaaaacatttgtaaagtaggatcaaaatgctcaaggggaatgtgtgacttgccttgcttcatcaaaagaatcttctgaactcttttcctcgcgaccgcagacttctgaaataatggattctacgcgctggcacgcaaaacgaggaaaaactctaataaaaaccaagcaaacattgcataaaaagtaaacaaacatatagagctcaattttagatgaattatgcaagttgaatggcccaatttggagttcatatcaattagatatgaattttacaagatttgagccatttaaatcattttttataattattaacgaattattgcacaattactatttatttttacaaaggaaaaagggggcgctgacatcatcaagggagaggcgcgccaacaggtggaccccacacgtcagcggcataaggggacgggcgcacggtggactcggtccaccgcggctcgagcggcaccgtggacggcggcagtgcacgggcacggctcaggccggcccggccgagcgacggcgcggcaaccagcggcgacggcgcacgcgggcaacggcagcgcacgcgagagagcggagacgcggcgcgacaaggggaggtggcagccagctgcccggcacggccggcagcggcgcgggtgcatagcacggcaacggcgacccggtcagacagcccccggcgacggtggcgcgtcacgagcaggcccgggaggcggccgacgaaggggaggaagagggagagggaggggagtgctcaccgaggggcacgacggcgaaaggggcggccgacggcaatgaccggcggcggcggggctcctcaggaagacgacgcgacggagcttcggcgacgggcgtcgctcggaaaggggcggacgggcttggctgcaccatgggatgaaaggagagctgttaggagggggagaggtggctcacggcggcgtgagtcgctggccggagatgagaaaaaacggcggattctcacctcgagcggagaggccggggttccaacagcgattggagccagtagagtggtgccggaggggctgtgcggtatggcggagccagcggaggcaatagtgtcgcgcggagtggttggcaatagcggaagagtgtgaccggaggcggcgaatgtggcggcggcctcgggtttgccgtggaggtggttattcggtggtggagaggggaaaataggcggtggccgggcttgcccttgagacggcgaagccggtggaggttgccgcgtggcacgccggcgctaggacggcggtgatgtgcggctggaggcggtacaggcggcggtagcttggcctcgtgatggggatggtgctgcggggttgaaaggggagcacgaagtggatgccggggcgcggcatgacgcgacacagcttttggtggcagtggtgcagcacggcagaggtgggagcggctgtggcggccggctcgagggtcaccggcgatcggcagcgcgcgggagcggcgcagggagagcgagggaggcgacgggaagctcggggaaggaggaaaaatgagagagagagagctccggggttagtttttataggctcggggagggagaaatcgtggccgggatgggcggcaacggccggcatggtggagtggcgacgtgggcacgtggcggggggaaaccggcgccctttttttgggggaaagagagagaagaggtggaggaggtggtggggatgcagtccaccgcttgggcgcaaagggggatggcggggtggcgtgtggggcggcaatggcggcatggtggcggttggaggcgggctggaaggtgggaagaaaaacttacacgtggggcctcgggtccacctgtctgccggagggagggggaagcccgttgggggggggaacaaacttggagggggggagcgagctaggccggtctgagagaaagaagcatgtgggccgcgagagagagaaggaaggcttgggccaaaaatggcccaaggaaggaaggtgatttgatttgttttctttttattctaattgattaaatgcactttgtgatgttaaaattacttcttgagctccgaaaaatttacggaaaaatccggagagtattttagggcagaaagaatgttacaaaatattctcggccaacgatttttaaaggaaattttaatttcctctataatttcacttgattaatttgatttaacttttatttaatttctaaaaatacattatttaatgatttttagtcccgaacgaaaatctgggcgttacaaattccaacctcccatttgctcttcctctccctaaaactcttgctccatcgaagagaaacaagatcgcgccgccgccgggtgtcgaacacctggtgagcgggggctgcgccgccgccacagggcttctcggccgatgtgggtggcggggtgtggaaagaagttgctgttgctgttgttggaaggagccgggagctgctgaatgaggaagaccaggcgtcgaacacctacgagcgtcgccaaccgctagccgcccctgtttcggccgcaccacgccgcgcgccgtcgaactccgccgtctcgccatcccgtggtaagccctcgcgcctatagcagtgcctagtcaccctgaagctagcggccccctcgacttggggtgtgcgccgccgttgccatgctgacttggtccgccaccacgccatggctgagctcgccatggggagacctcgttccaatgtagcatcggcgagaattttccttttctatactccgtgtgaaacctagatggttaaatcgaggtcgcctgcacacgaatcaaccaccattgcgccgccgccgttcttgcgatctcggtgccaccgagcaccatcgcgccgcgcgtcggatggctgccgtgcctcgccgctgccaccggcgggtttcaggtgatgcaccgccacctttccccaccacgggccgagccgtcccggctcgagccattggatcgctgcgcgccgttactctgttcggtcgtgagcgagaggtagaagacgatggggaaaaagaaagaacgagagatagaaaccgtgtgggacccacatgtagttagcgcacagcaatcctccacctaatggtgattaacccacataatggcatgtggggtccctgttattaaaatctaagaaaacttagttatagattttgttacaaggactggttgacccccttgtcaatagggccggtcccacctgtcaatgacacagcttgttttccaaaagaaaataaaatagagaaaagaaatagggggatggcccgcatgtcaaccacagtgggttttggataatgtttcggattaaaaataaatcaattataaacagtaccatttcacaattattggtattaattcaaatttgaatctttaaacttacataactcactcattttaactaggattcgaatgaaacttgaacctaaattcatctaaaatcaagatctaattgttggtaccactttctcaatttactttgtactgtttgaatttttggtgattttatttgaattctaatcaaatctttcgcacgtaaatttagattccgaaggagttgctgagttaatcaaagatccgggtcagcaaatctgtgagcaaggcaagttatcactaatctttgagcatgttggacctattgcgaacttattttgatttaaataaagtttgcatgctatttatatgtgaatgtcctactttgttacatcccatacctttgatattgattatccatataatctttgtaatgcatgatgtcgtgtgtctttagtcaatatttgacaaatgcttagcccatgctaatttagacccatgcatattcatatttgtcaaaatgctttatgcttgggcaattaccttagggaaggtaattgacatacgacgtgtggagacatgagcgccacattgccatgacagtgatgagatgatttgtgaaagaaaattaaactaaacaaatattttcgactgggacggctggaggacttgggtggtgtccggtaaaggctagtgccatccctggtcaattaaggaccgagccatgaagttaaacatgaaacgtccccagtacaatcgtacttctcgagtgggtatagacctagcggagtaaatagccgagtggaggtagtatccctgcatattggtttcttttaggtgtgtgaagtgacaagcagtttgctagcgaatgcccggaatggatggccagtccgctggcggatgcccgttacggatggctagagactgacttgacaagactaaaagaagatacccaagagaagacagtcgatatggactgggttcaacttcaagaagcaacgttaggaatgtgtgtgtttttcccttcccgggaacgccagaactcctctcactgctagaaacttatgacgcctaaagtgcacgaggatataagttcatggagcatatactgcaaaagtgaggtaattgaaaggctttgctgtgacgcgtctcatgtgttgggacgaggctcatgtgttgggtagtcgaggagtatgggtaaagtgtacatccactacagtgtgagtaaaccaaatctattcaaatagccatgctcatggttaatgagcatcgggacatgtattacacttggctagactctaatttcttaatttgattgggtgggatatgcatgatgatttttagactggtggatcaacttctcgagaggttagaaggggtagaccccagaaaaccatgacgaccagtggcgggaagctatccttgggaacacaatggatggtggacagaaccatggctgtttaatgaactatagagataaaatttgatcagtttatgctaggtgttaggcttgtgaaaagaattgcaaaattggctttatgcaaataaaccattagcctttcattgaatatcctcaatcatatgcatcattgttgtggtggcttgctgagtacggttggtactcactcttgttatttacaaattccatcagaagctggtgatgatgtctcggatgacccatatgcttacgaccacgagggtgaagaagatggcggcgcttagtaggtcttagttacggtcgttgcctgtggcaatggcgtcgccgctaccttgattctgctgcttatctatttctgcttttggtatgtattccggaccgtttggtcctatgttctaagactgcgtgcgggcttatgatgtaataattcacgctagacaatcgcaattaatattccagcaatgtaatcgtgagtaccatactacttgatccagggaaatggtactattaacacgagagattcctgttataaaaacgggggtctacatggcgtgacccagctgtctcggacagaagcctaggtacccgaggtaatgcaggtttctcgaagattgtgttagggaaccaaccggcaacaagacaactgataacacaagacaaggagtagatttgtaataatgtgagcccctccatggactataaaaagaaggggacaagctacggatgaagggttggactctttagatcagtatacttcgctttgtagcctgaaaaggccttcgttgtactcagctgatataggaaagacaatgaaaccaacacaggagtagggtattacacctccggatggcctgaacctgtataattcctgtgtcttttgcttggcggggagctcgggctccacagatccgctcttgctttgatctctttctacgccgtacaccacaaaccccctggttgaatattcacacttggggaggggtctccactctccattgtccgaggaatcgctccatcgacagatactattgagagaaagcaacagcagtatccgtgcacttccgtagaggcaaacatgagcctcggataccctatgctgtgg

SEQ ID NO: 36531 - DNA, 52564 bp, Oryza sativa
  unsure (1)..(52564): unsure at all n locations
acacatcccaccaccaccaccgccaatatacctcataaaatcatggcccaacaagcattagctttaggcccagctgtccagaagcctagtactgcttctgtgactgcgcatacacaaagggactagctataattttgtcgataaagatgtaaatacagtacaatcataatgtaattgcaataacttttagaaatccccagtaacatgctattttcatgaagcggaggtcacaagaccgaatctcctcacccgtgcttactatgatttcttttcttcccaacttacatgaatattgaagtaaatctaatgatctaaaattatgtgaaagttatatcatagttacatgcaaattataatataattacattatagttatactgcatttacatttgataaattttgtaagcgtataacaaaatcgtccacgaatcacgcgagagactgagagaggctacaggggtgagatattagtggcgcatcagacacgactccttcttgctctttggtatataccatagttattgagaccggaccggcaattgaatcggcaaagccgtcggtttactggtttattggtctgatcggtcgaggtccaaagcggttcagtatctaataaagaaataactcctttgttccaaacacaaggaagcacatggcttggtggttggcatagttgcttgtatgcctgggaaaggcggttttctgcaaaatcgggcggtccagccggtctataccggtttgattgcacaggcggtcttttagatgagccagaccggcagaggcgctggttccggttttttccggtccgaccgccagtccggtccggtgtcaataactatggcatcttggggcagggcaggatatgtagaggataccaagcttgcagctcctactcgatcaggatcagtacttcagctgtcgtgtcctcgacgaccagttgcgcagtctccttgtagagacagggaacaacggttttggtggcactgaggccggagtaaggagcaagcaaacaagagtgccctcaaccggatcgggtcccggctttccctacaagaaactggcccagagcagcgctgctccctatagcagaattgccagatggctggactacccgggaggggagccggaggcgggacgattgaattgtcacccatcgagtattcgagggcgggatatgtagaggatacccagcttgcagctcctactcgatcaggatcagtacttcagccgtcgtgtccttgacgaccagttgcgcagtctccttgcagagacggggaacaacagttttggtggcaccgaggccggagcagggagcaagcaaacaagagtgccctcaaccggatcgggtcccggctttcgctacaagaaactggcccagagcggcactgctgcctgtagcagaattgacagatggctggactacccaggaggtgagcaggaggcgggatgattgaattgtcacccatcgagtatttgagtacataccatagttagttattgagaccggacctctcctaaaataagtgcagtcgtggatatccgtgtccaacgtttgaccgtccgtcttatttaaaaattttataatatttttttaaaaaaattagtcacacataaggtattattcatgttttatcagctaataacaatgaaaatactgatcataaaataatttcaaataatatgaacggtcaaatattggacatgaccaaggtaaaactgcacttattttaggacaaagggagtagataacaaactaaggctgtgttcgctagagagtgttcccaaccggtacagtgcgcacggaaaacagaacgatccattagtacgtgattaattaagtattagctattttttttttaaaaatggatcaatataattttttaagcaactttcgtatataatttttttttgcaagaaacgcaccgttaagcagtttaaaaattttgcgcgtggaaaacaaaagagataagttggaaaacctggggtaagaacacagcctaagtaattttacagtccatcaaaaagtatcggaaggtaccacactttctagggtcaaatctagtacctctaagtactaccttgagatataaaaaaatagtataaaatttaggtacctcgagttactttttcaagtacatgaaatttctcttatctttattttctgacttgtcgctaatagttagttgttttttaattaaattagcatgtgttggcttgctttattgaagactcccgaggtttggtttatgccatctcacttgtgatatttgtgcaatgtgcttaaggccctgcttggtttatggtactaatggattagtccctccattttagtccctaaggatccaaacatggatgactaaatatgtatattgggactaaaatccactagtccctcgtggaggtacttatagggactaaagtaacagcctctctcttctctcttcctcggtccacgtgcttttagtcccttttagtctctggatccaaacagtaggtactaaagtttttagtctagggattaattttagtctagtgattagatgatccaaatagggcctaagtacgtggatgtatatatctgaagtgtatgtgatcaattgtgacttatgtggaatgtatgcaggtgcatatgtgatcaccattttcttaagggcgtgtggtttgaaattccatatatatattaatgtggtttccttccctatttcgttgtatttttccttcaagttttgatttttctaatacaaatccttctgtgggcgaagcagtgagcggcaggagatgtgggatgcaacaagtggctgggccgttttatcacgttctgacggatagaagtgcagagcaagagaaagttcagaaccaacacacatctgtcgccgcagcaatcaaatatggtatacattgccatgtgaaaagcatgtcgatcggcaaaagaacagatgtggactcttatctgtcgaatctttatattaagtgtggacaggagaataatgaggacaccaaagaattgatgtggtccgagaggcatgcatatatatagaagaagaaaaaactaacgactggagatcgaatatttcttgtgcaaaaacattgaagcggcctcctgcacacttgtggtccaaataaactagctagttacatttaaatgggaaaaatatctgttttgtttggtacagagtaaaatgtaattttttttgccgcctattcctagaataatctaatcctaatttgaattatttgtaaaatatattttgacggagatcttttgttttctttttgaaagaaaacgtggctctatgttttaatctagactgttatattatgaatatgatcggagtacatcccatctcaacattgtaaataatgtttattttctcccactgttatgataatttcaagctcttgattgttcgcacagtaacttaatcaattatataagacaaggacatatagcaacacaattacagctaaaaatgggcggagcttagatgttaacaccaacctgtctacccggattgaagtcccatatttagtggtaggcgatattgatatcaacagtgagctgtctgcggtgactttatcaatctcaggatatgtaggatgtacgtgcgtatatattcataggagtgagtgtgtacgtgtgtatatgagcgtttgtgtatagtatgttttagaaaaatgggccaacggccggttttccaggtagtgatatttaacgtttcaatgcaaaatcatgtaaaacataggtttgcaaaagaaaaccgaggataattaaatagtacagaatagtttgcaaaagaaaatcatggcattaattaaataatagagaatagccaattttacatccatcaacctttcataaagtctaaaatcctctcttactatatagatataacccactgactctaaaagcataacatgcaaagatgtcacattatcatccactaaaaagatgttatatcatcatccactaacaatcattaaatttaaacatcatgtaaacatgctataatatctataattttataatttattaaattttagagcttttagaatgcaagcatgttaaatcatcatcccacatgatccatataatattttaatatatatcttcgttatttttacatgatatactgtgtacctctatagttcatcctcacttagttaatgatatttttctcttctctaattaagccatatcacatcaattatttttagtacttaaatgattaatctatggtcccaattatctctctacttttcttctcccattaatttatattacctcaattatttttagcctttagatgattaatctaggtccaaactatctcaatacttttctactttcataaagtcatatcaccttaattagttttacatttgaatcatcattctatatactagttaaatttaaattatcaccgcgccaccgccgctccaccactatgagccgacgccgcctggccgcggcgccacgcaggatggccgcgcgccgccgctattaacgaccaaaattggtaaatcatagattggatccaaagtaagaactgaaacggatttgaagaagatctgtagccttagaaacagaacccgcatcggctaagagttgtatcagctaccgtctgcatcggctattacccgatcggacggggaggagccgatacagccgatcccggcaaagcagtcatgggatcgttaccgaggatggttcaaactctacgcaagtattgcaaagcatggattgaatccagaaagggcaattgtatctattcattaggggcaattgtatctattcattaggatattttagtagtttccttacagatatttttggtaagagtccgcctaagggacttgttcatattttgagttataatagagatagagtcgtgtccggcaaggacatatcatgtattttgggtataaatatgacccgatacattgtaaacaaacaacatcagttcaataatattctcagcgcatcgccacctttttctactttcattgtttcgacgagttcttgctttcgagttgggctgcatcggtttcgatcttcggcgaaaaggtaaaatttgttatggcggtttacgttcttgggattagtgcttacatcttcatgacactctaatcttgtttatgtgaatctccgagttatcatatatgctatataatctagatcgatatcactatctaacttcatcggccggcccgtatcatcgaagatagacgattgggctagatattgatgttgaggtagattatatggtgtatctcccatcctgaaaaggctatcatcgtcctgtttagattttatatttctcttcatgcttaatgctgcatcagttaggtttgatctattaagtaatgatctgaatcataatatctagcttgtcttatgatcgctaatagagatagcatcggattttctgccgatcttacctggtttagttatcttgttcattatatgttacttggtatactaaatctgccttttatattaagatctcgctcatttgaaatatattaagctatattaccggtctgattaggttatcctggtattagatcgattccttgttctttatatttcgtctatattgatatcttagtataaggtggtatcggagtactagccgatacatgtcagatttgccttatcggctatgctatgaatatatataatcttcaccttgaagtacttttacacataagtggtttatactatctcggtatactatccgatctatcccaatcacttggtttaaacatattaatatctacagccgatcaggtggatctagcttttctcatcttatatattccattgccaatctaacacgtgttgcatcagcttaatattggacgatacgtcatcggcaatccagccgatcggctgtcatttatggatttaactttgtttcctctttgtttcttgttgcttgcaggatcataccaactagcacgctcagaacccgaaagcaattctttggacctgccctagagtattaacaaatgatgaacatgcagaaccaacttttacattcatttgtctagacacgctgggtacagtgattcagaggtacaagatagtgctgccaaacaatggagagctagggacaagctcaactaaagatgtcgaacccaaggataataagcaggaaggaagtcctgaagagttcaaaaacttgcaagatcagattggttatgttgttcgtcacgcattgatcaactagtcaggagtgcttgtcaatactttaactaatatgattaaatatgtggttgatggcacgatagttgagcatcaggctaagggaccagtttttcttccagaaggtgtttttccacaatacaagactctcagttctgataaacatcggcctatctcaggtttggccccagaacagccgatagtgtcagtcttagctcctgggaaacatggtgcgtcgacatcggcgccggggcaaccagggtttaatcctcacgttctggtcaaacaacaaccgcaacatatagggcaaaacatcccccgaattactccagatcaagtcgcctctatgtttaggccaaggcagccggttattgagccgattccacagataaccgtggcactgcaatcacctattccgtaactacatcaacctgttggctctcaatttgttcctgatcaacatatccatatggtgcatcagtctccttagcatcacatggggggcaatgttaacttctagtatcagcctcactcaccttaggtgcagtatcggctagggggatcacctctaccccaatatttgcctcactataactagttagaccaagtgcaacagcaatttcagggggtacctcaacagaagcctttggctgatatgatagccgacatgatgagggatcagtttgggctctattaactctattttgttaatagagttatgagcctatggagtcgtgttagaatcggaaatgtttaagtaatggttagccgatatgagtagtgtgggagtcggagtctgtaataatttccttaattagatatagagttttagatcaattcgatcgtgatagagtcagacttagtattgcttataggtataaatatgtgcacctggggtctttgtaaacaataacagttcaatattcaacttttagggcatcgccaccctagttttgctcttgacaagttcttgtttatgagataggctacatcggtatcaatctccaacaagaaagtaagttttgtcaaaatccttcgcttgtattgggaattagtacttccttggttatgttcgatatactagttcttcttttgcttgcattgcttatcaaatatattggctcttgctctgattcgttctgctttctaagtttatggtttctatatcagtcaccctgaaaaatgttcatagactcgtttaaatccgttaagcacaatgttaaccccgaactattctgcttagctctaatcttctaggttttcgtgtgtttattacatttactcaagttgatagattcttatcatagtttcataagagttttagccgatgaagtatctgcttaacatattataattggttgcatcgattaaatttgcaatatttattataatcagctagttactgtgataatgtctcgattaggtccgatctatctagattgtgataaataatcatagtttttgatgatttatattctatcttgttttgattgatatcagttaactttcttctatatagagtgttgataagttttatttcaaacatatcagctcatattcaaagatatatttatttactcaagattctatcttattattttcactcttatcccgtctcggttaagtctgatctatcaagattgattataataatattagaagattttataaatatattgtatctaagtttcagccaatagagttttattattctgacttttgaattccattagttatagccgatcgatccgaaattccatcagtatcggcatgggcaaaccatactatatcgaccccatgaacgattggcccattgatctaatcttctttattttatccttgttagttgtattggcattgtgtgaaccttatttgataggacctgcactagagcaagcaaaatttttaggccttcgtgtgtacgacgattttcacaccaacagctttctcctgtctgtgggggtagacgcctgtgggaggcggaaccagatctgcaaggtggtggcaatgtagacgagctctatgcggataaaaggctaggggcaatcggtagcatggtgccggcggacctcatcgtgtccatccccctttgttggacggaaggacgtcttgtcggccagacggggttggtgaagccgatggccctcgttagctccacggcatccgctgttcccctccgcttgatcacggtgcggttgccattctagcaatagcattgatcggtgtgaccagatacggcgattacggtttcatcagaccaacgtcggtgatgccatgatgcgccaaatcactttcaggtctaggagaggattctcctggcgaaaatctagttttttgcatgttcagaatagatgccttgaccttcttgaccttcgtagtcattcaacctacaaactctgtataaattggctgtagcattcactgctggagaaaacccacaatagtcccggtttgcaatgctctttagtctcaggtttcaaaccaggacaacgaatccaggactacattttttttcttttttttcattgttttttgctgtttgcatattgatttcgaaccaaactcaacaataagatcatccacattcacagaaacatcacaaaatcatccacaaattcccagattggatggacatactcaaattgacatcataaatttacagatgcaaagacttcacaaatcaataaatttacagataatcaacaaagacatcacccgcgccaggtaccttccctctcccgctccgccaccagcgccagagccgacaacgcggccgcgcgggccactggtagcacggctacgtggggctgccgccgccgctgcgcccggccgccaccgccttcgctccttcctcattgctagtgctgcaaagaaaaggagcggataagagagaggaaagagagagaggagagaggatgaaaggtaggagaggaagttaaagatgaggaggaggaaaagggtggagtttgcgatcaaggaggagaggataagtgcaagggattatatacgacgcgttgatacggaactaaaaatagtagggtgccagacgctttttgaaccgggactaaaaatcagttacaccaaccaggactaaagatcataaagtggtgttgggttttttaaccggggaaaaaaagatttttagttccggttccttttttttttctgaactagggcctgaaagcccccctttccattaatggaacggcacatagagtcttaaacaagctaccaaaagagaaaaaagaaaagcagagaggttcagtagaaactaagctgaaacctgaaaacagcaggtcagcaagcaaactgaaactagcaaacgttaccaggatcccaacagcagggactagacaaaagctaagtgagtgagaactcaggggggttacatcggtagacaaagacaagatttcagagacagaatcattccaatcttcttgcacagggcctccattcatatctttagttgaagatgtcatttgccacctgctttaccagcctggcccccagctccaatcttcttcagtttgcttccagtttctgcaaaatagcccaagatttaattagattaccgactaaatagaccacctcaatgggatcttttgggagaatgttatcaaagcaggctttatttcttgttttccaaatagctcagatgacagcagcagcccccaccatcatcatattcctcatgtttttatcaaaactggttaaccaggtaccaaatagctgagttttattcagaattggtttaatgtttaaagcacatatcacaatgttccatattattcttgcagtagggcaatcgaagaaaaagtgttgaatggattcttccctagagcaaaattggcacaacttatctccttttctccaacctctcttgtacaggttatctttggtaagaattttgtttttaagaaacaaccagagaaagactctagtcttcagaggtatcttaaccttacaaatctttttataagggaagacaaactgcttcattttgagtgttaagtaaaaagatctcactgaataagagctatcttttgttaggttccggttcccattggaatcgggacaaatgtgatttttcaattacccacaagagatcagttctccagtattgatttttaagcaaagatcataaataaagaattaaatttcaaatatagtgttcatttaacttttttcataaatattcaggatataatttatttaggaggaatataacgtcgttctcgcgtaacggggcgctgcagggtgtggcgcggcaaagtcgcgagaccgcgcggccaaccagcgataccgcagcaatacgccaatcattactaatgatcctgattagcaattaagtagtgattagttaatctaattagtgattaattaatttgctaattgataattaatcactaatactgctctttcggtctcgcatgttggttgtgcgagaccgttcggtctagcatcttccacaccatccgtttcgtcacccatacgtcgttttcgtgtatagattgtacgagatcgacggaatagttttgctaaaaagttgcgtcctgaatatgtgaaaaaaaattgaatgaacagtatatttttaaattgaattccataaattccattattcgaagaaatagaacatttacgccagatatggtttcattttcacaccaaaccacccctaacctacaaacgaaccaccataacactgacggacgcagacatcacaacaaactctaattaaacttgatgcctatatatatagggatatggatgctgcaagtggaaaataacctcattggagaggctaaaacggaagagcacactagtggtttcacttgtgtcacttgcactgactaattgtacgagctcgccacgtactgtctcaccagctagcatggcgacatcgccgttgccacgttgggcggcgacgccgagcccgtcgcgcccgctgtggcgttcatccggcggcggtggcgccatcgtcagtaaactcctgcgttccccattcaccaccgtgctcgaggctgtccgcgggcgtgctgcccccgacgacacgccgcctcctgtacaagctccaccggcgccggagcacaactgcgccggcgcgttcgacggtatcgccgtcgtcgctggagatgggagggaggagcggctcgacgggggcgtgttcctgacgtgggaggacgtgtgggtgacggcggtggacagcggggggaaggccgccaccatcctcaacggcgtcagcggcagcgcgcgccccggcgaggtgttggccatcatgggcccctccggctgcggcaagactacgctgctcgacacccttgccggtaacacttgtcgatctcagtttctctctatccatatgcatctctctatcgacctgaggtttacacaatttcactcgtcttgtgtgtgtgtctacatatttgacaatccttatagcaataaactgtcgaataatatatattctccaaccacactattagtaccatacatcagtaaaactacgtacctccccgcaaaaaaaaaaaaaaactacgtacctggggtgctctttcatttgttaaagttctacagatcacaacgtaatctacaatacactagtcagaatttcatcctatatattcataaaagtttttaaagaaataactatattaaagtgcttccaatgacaaatgtattgatatatatcattttcacagatcaatttaattgtagtatttttcttctattattaatttaacgtttggaggtttaactatatgcataggacgttatctttttgagaatagatttttgctaatgtgaggtcgtttatacctttaaacaccggaatatacaatacttttcaacatttctgtggatagtgggacattgtcactgacatttgagcctcactacccttgggctcatatgtcagtgaccaagtatagagagggaaaaaaaaacgagcacaacgtaaccaaggaagaaatatgttgtagaaaaaatagcaaaatcaatttgagaaggtgacaaatgtgtatatccctgtccactgacctttctgtaaaattcagtcagaacatgacgcgatttgggtccaaccgtaacgagtcttccacgtttgaaatattttttttttgaaaggaatcagcacgagactgtgctatttcattagatataggcgtaaaaaaatacaacccctagaggcaaaaaaaaaaaagagctgtacaaattacataagcgctatgattaagctggtaagaattctccaagtcgccttgtgcctgccattatccaggttcttgcctcttcctttatttttgccataaggttgggggccgccgttttcttgtgctcgaagatcctttggtttctttctttccagatttcccaggctatgagtaggattaaagatcgcagccctttcttgggcactttccttttattggctaacatttcccactattcggtgtcccctttggcatggctcccaattgctcggatccaattgctgataagccacccagttggccgtcagtctccagatccttctggtgtatctacaggaagctaaaaggtggcatgccgtctcgttcgtcatacggcataggaggcacactccgctatttggccatcctcttgtagctagtcgatcggaagtccagactctattttgaatcacaagctacgcataaagtttgcattttgcaggggcccaagatttccaaattaggggattgaagttggtgccgactgttcctagacactgagccttgtatgccgaagaggccgagtattctccatgattcgagagcttccagacgatgtgatccgactcattttggtttagcatgatgtcctgggttgcgctccatagggacacaagctggctgatcagttccactgtaaaagtagtgttcccatttagctccaatttagctccaggtcatcgatccaggtgtcattttcaatgccttcacgtagcgatttgcttcttttcttggaaattgcatagacgagcggcatgctgtcctttggtctttgcccatccagctaggcggactcccaaaagcggatcgtgtttccatcccctattgttattttggtagctgcggcgaagagaagtttgtccgtttcatcacacggtgtctctagtcccacccacggcttggtggggtgtttccattcatgccagagccatctcagtcgcaaggccctcgtaaacatctccatgttcagaacccctagtcctcctagtgtggttgggaggcacgtccttttccagttcaccttgcatttccctcctgtaattttccacgtttgaaatatatgcacggtgctcctgtttgtagtttggttgcggtcacccgcgatttgtgaagaagaagacgaagaataaaaagaaaaagaagccgtccattacttaatttgttgcatattaaagaattctccgaatttggcaccatcgtcctcaaataaaaaaaaagaacacattaattggatttttataagaatggaactctaccagaggaaactaaaaagaatataaaaaatttaaagaatcctgcaaatcttttttatcacggtaaccatgcataattactgtcgataattcccctgatgaaaattaacggcgttcaggaattgacacttttattttcgaaacgacctgcacgatataatgcgaattttcacattgatatagaagaaaaaaaaaaactccctccgttccaaaatattaaaactgttagccctaaagatttgtactaaaatataacaacttctctatcaatattctcttcccaaccaatcataatccttcaccattcactttttctacctaactctactactcaaccaatcacaaccctccaccattcatttctacctacgaatacttataatctagaatggagggagcacaaaattataacactgaagggtgtaactaggaaaaaccaaaaacaaacacaccaccactgcttgctagcggctcctaacacaacctcgaagatggcacagtaccaaaccgactaccgctaagcgtgaccaatcgttacgggacaagaaaggggatcacaatgcaccaccgagaaccaactccaaacaaaagattaatgatgtagtggggttgagcagggagagggtgagacaagaagatccgctcatcccccacgccaagcttgtgacaacaaccaatagaccacccaagaccaagctgaggggaggccgtaaaggtggggaaatgtagacctccaagacgcctttggcaccaacgtcgcccctccaaaaggactgagcatggttataagaaccgggaccggactggcagttcgaccagaaaaaaccagaactaaggctgcgtcggctccgcaaacggaccggcgaaaacccatcaaaccgggtggttttttgccgaactagaggtggttcgactgctgagggctgctgcaatgagggattgaacccaagacctccttgttcccatggaaagactcatccaccacggcatgtcgcctattgtggtagtattgtagcacacatttatttaaaccattttaaactggtggtttgaccggtccaaccaacaaaccagttaactgagtgccctaatggttcattaccggcccggtcttaataaatatggtcaggaggggagaggaaggcagcccgacaactccacaaagagggatcacgaaacccaaacacgtcatcctcagataactccaagctaggctttcacctgctacatcctctcccgcacctgtcatcgccacccagagctccaccaaccaacgacctccgctagcctacaactctatcgtatcggcaccacagtgatggtcagcccagaccagccagcaccacctcccaccgcctagcatgacgcgatctcccacgaggccgcgcagatagagcaccctcttccccaatcaccaccgtcatcgtcttgccaaaagagctcccttcgatcggaaggggctagccatagcaggcgaggagcttcatggagagaaaataaaggtctgattggctagaaggacagacctgccaccagctgcagcgcttgctatcgcccgcatcgcctcggtcgcacctgactcaaccggtggtctcggtcgcgcagccaactctaccgttcaacccacttgtgcccactgctcccaccaaggatatgccaaatccagtcattgggaaactggatccagccaagacggtgtcggatcagcagcaaccaaatgcaccgcaaccgccttctcagcctgctgcacggcatgcctatggtggctaggttttcgcccccgacccacccacgaggggacggcgtgagggaagaaattgtgtaaaatttaattttttttttctggaattggtactgttggagcgagatagaaagatatttgcacattcctgttgcgaatctttgggccggtaggaaattaaagagaatggcttttcttcgaagaacacgtcgatatcgtgtacacagatacacagcacgtaacttacgtgttgaacgtattgattaccaagttgatgtggtggaagtggaaaatgattgcacgatcgatgctgatcgctgctcggccatactgaatcgtacccgttaactatttcacattgaggcagttggagggtgaattaattttctgatgctgactgaagttaagtcagccaacccgctgttattagcaaacttatccagcccgccattaattttcttttttttttagaattacacagtacaacgcagacactcataactcacgcgcactcacccctatgaacacacgcacgtaaaccctatctctatgagcatcttcgaagactgggctagcaaattcttgagagattgacgaagtcaccacaggcgcctcgctgtcgacgggtacgtcgcctaccactgaaagcacagcgccgataaatcctggataattcgctcccatggggagtcgaacccaggacctcaggtgctactgaggtggttgcagacttaatcttctttatgtatatactcgttccatttcggggttataagatgttgtgactttggttaaagtcaaactgtcttatgtttgaccaagttttttaaaaaatagtaacattttcaatctaagaaaaatttattatgaaaatatagtcaattattgatttgatgaaactaatttagtattatattactatatttatctaacagtttaactttgaccaaaatcaaaacgtattgtaacctgaaacggagagattatatgtataacacccatatgggcaccatggtctccgggcaccaaggtatgaaataaaaaaattcactcaaaattttaaaattttgaattttaaataaataaataaatatatgtatgcatttatctatgtatatatttatcgataaatatgcatttatttatatgtatttatttatcgatcgatggtggtacatgtttggagaatacccatctcaaacttcttctgcgtgaaaattattaatacagaaaatatgaactataaagggagggagaaaaagaaagaaagtgataagaatggcagttttaacgatttgaaacacatgattttcttttatcagagtataatcatctgatatcttcttctgaagatttaattacaataaataaatagaatagtatgatcggatcatatattagataaatagtttaaaataaaatataattaaagtgaagagaagagaatgagaagaaactagccatatacggtctgtggtaatgtcagggtgcccaatttttcttctcttaattgggcatcagagaataagtattttcccaaaaaagatggtagtggttgttggagttctaaattagaaagatcttaactttagcctataaatcaatcactctcaaattacaaattaatttctgacctgtcggatttgaagacattgataattcctgtctttgcttttctttctcttcttcttctctctgtttctcttctctttacctcactagatcacgtcggcctttaggtctccaccggcactgccctgagatagccgaacgaaccccttctagtgcttaagccgatcgggggcgaattagggttttagattagatagggcaagaattgagtgtcctctcctcctacaatttgttctcttttatagcattggtgaggccgggagcttatcttgaatttaggaatcaaaaattcttttaaccgatcacaaaacaaccttatctcttatcttcttatttggttcggattgtgtgctcatccgaaaaatcaaccaatagtggcgtctacgagtaacaaaaattcatttggtggcataaaaggaaaatatattttcttttatacatagaaactcaatatcttttaaatggcatataaggtattccctctaaaatagggacaccttatccgttagtacaagcaactaagattggcttgtggttgcttttaattttgctttatagatcttgatattgtacttataccatgtttatcagggtcctgctaatgcgcggatgatcgctgggagtgagcgatcacccacactcccctccgcctatgccgattcctccctcttctcccctttctcctccccatcttatcttcctactacagtacaccacaaaatttttttaaaaaaacaaaagttagaaaaaattatggatagaaatgctatatataaaaaaattgaatttaaattcaaattcaaatttgaattcaaattcaaattcaaatttgaatcgggtatgtaaccttttgacttataaccttgggatctataaactttaggtgtataaactttagatccatagaaatactatatatagaaaatatttgaattcaaattcaaatttgaattcagatataattcaattcaaatttgaaacgggtctataaactttaggtctataaattttagatgtatagaaatactatatataaaaagtttttgaattcaaattcaaatttgaatcggatatataaacttttgacttataaacttttgctctctaaactttagatgtataaaccctaggtgtataaactttaggtgcataaatttactaaaataggaaagtaatgcggtgccaaaaaagaaaaccaggtagagcgagggaggggggaatggggcgatcgctagccaatagctagggcgattgatcgcccattagagtttccgtgcttatcatgacttcctaatgtatcttttttatgtgtgaaaactgaaaaaaaaaagaaattcctctctcctcttactttattttatttgtgatttggctctccatttatgtatggaagcaaattagaaattcctctatcctctatatatagctattttgatcccccaattatattgtttatctatctcgtatcatcaactttatattacgaggcatgcattaagctccaacaatggtgatgtccataatgttagcatgccaccaatggcatgcaataagttcccaacaacactgatgtctatagtgttaaatagcatgccacctattgtaaaagataatgtggcatcagattaaatgaatgaaacgatgaaactagatcttgaattgagacccagtttctatataatattaagggtattgatcaaatatttgatgttaaattagcacagtaaattggtgatatgtgtgcaatagaatagtgctatatatagtttctagatgatgtggggcatatagacactatatattaacagtgtcttacagcactgggacggtcgtccttatgggagtcttagtgcttcttcgtctcagttatagagttccttctttttttctcacggttatattaaattgtgtctttcgagctgagtttctgttgtaatacgccgtatttcagttcataacatcttatcgatctgtactctattgatatacacaggaagattggattcaaacttgaagatgaaagggcaaattctggttaacggtcgatgtcagcaacttgcatttggaacctcggtgagttcaagtgagaaaactattggagcatctaattaatacagcccattttgattagtattattgaagagtctgtcacctcctgatggaaaacgtacgaattaccccccgaactatcgcggtcgtccgaattatccccccgaacaacaaaaccggacattcttcactcccaactatacaaaccggacgaattaccgccctcgacccaatccgcggtggttttggtctacgtggcgtacacgtggcagtccagtcagcattttatttttttaatggtgggacccacatgtcagacaccactttctttcttcctctctttctttctctctctttgttggtcagcagcggtgcgcacgccggtggctggcacacatggcgcggcgcgggggcgggctggcggacggcgcgcgggaggtggacgggatgggggagaggcgggcgccggcggccatggcagagaggcgagccatggccggaagcgtcgggaggaggacgggggacggcggacggaggcgcacgtcgggagctggagcggcgtcaggaggaggacggggaggaggaacaagagaggctgaagagagaggcagtggtggcggaggaggaggccgttcccgcgaccgccgctcaccatttcctccgcgcccaccttctatcccggcggcctcccgcctcagcgtcgcgcccgtcgcaacctaccggttgcccgccgcgcggaggggcgggcggcggacggtgacgcccgggggcgcacagtggacgacggcgcgtgggagcaggcggtgggcgcctgatggcgatgcacgggggcaggcgatggacggtggccctgtcgcactcattggggtggggcgaggctgcggcggcggcgacaactgcggtggaagcggcgctcaaggtcctgcaggcgtacgagctgcggtacaacgccacggtggccggggtcatcaactacgcgtcgacggcggggcagcaactgctgtggacagcggcgcgtggggaagggggcgtccaccgcactgccgatgtgtcggagctccacatctcgccgcggacgccgtcgccgccgctgccgctgccaccggagccggccgagctcgtcgacccgccgccgccgcccaccaccggcccccgcacggcgccatgcgcgccgaccgccctgagcccgacgacccgagagagagggggagagagagacatgagatagatagagtatatatatgataggtgggccccacaataaaacgctgactggattgccacgtgtacgccacgtagaccaaaaccactgcggattgggtcgtggggggtaattcgtccggtttgcatagttaggggtgaagaatgtccggttttgtggttcaggggggtaattcggacgaccgcgatagttcgggggggagagataattcgtactttttccccttctaatccccccatagtcgagaagaagcgaacatgttcactacgataaaaataaattaacatatgattctagccaaatcttttagccgtgtatagatgatgattgcaattttgtctacaataaaaatgttgtgaaatttcacatggtaaaaaattacactattaataacagggatatatatttagctagtgtaatagtataatcaatccaatatgctaccgaacttctttagacttagggggatttacaatcatgacactgcaaacattaactgcaaacattaacgtagctcaaatattaaggatagagccagcgagagagaacgagaaaaactggtgtctgatctaaaaacatgaatgtattgtgaatgcatgaatcaatcaggcgtacgtgacacaagagaacgtgctaatggcgacactaacagtgcgcgaggccatctactactcggcacagatccagctgccagacaccatgactatggcagagaagttgcggcgcgccgatgaaacggtgagggagatgggactcaccggcacgctggacactcggatcggcgggcggtcaagcaagggcatcagcggtgggcaacaaaagcggttgagcatctgccttgacatccttacacgtccccggctgctgttcctcgacgaacccaccagcggcctcgacagcgccgcctccttccatgtcatgagtcgcatcataggcctcgctgccagggagggcatgacagtcgtcgctgtcgtgcaccagccatgcagcgaggtgttcgagctcttccatgtcctttgcctgctcgccgctgggaacaccatcttctttggcccagcttcaatggctgccgaggttagtcgatctagtgtagaatcattctgtgtatatagtcgtttaattagttaaatgttatcgctgttttcagcttgcaatagttggtttaatttgcagttctttgcttcaaatggctacccttgccctccaatgaggaatccatcagatcattttttgaggactgtgaacaaagattttgacaaggttagatatatagttggtccaagactccaattcaagcactattaatgaaatatcatgttcttttggataatgagtaattatttacaaatctgtcctctgcaaacagtatctgcacaatgtcacagcagcccagcaacaaaagagaaaagaacaaaaataaaataaaaaagatgctatgaaagtacgggaatatatcctatgcgcacaaaattttcatgcatactccgtgtacatcatctagcaaatatcacagaaaattccataaaagcatggacacatacttccaataatattacacttatgtgtaaaatcttatcttcaaatttgcatatatgtataatattgttgggatacatgtctaatttttctataattttttcacatttgctcgttgatgcgtacaccatcaaatgtccggcaacaaaactgggtgacaccaatttgcttgcttttgacctgttacctttcaatttgctaacacacaggagagtgaagacagactccggtgcatgccagctgttgcagatgaagcaatagacattttggtgaattcatacaaatcctccaacacttcggaagtcgcaaaacaggacatgcgtcacataaacgagatggtttctgctctaaacttgtgtacatattatatttatatgtacaacatacttattcacaattatacatgtttgggatatatgtcacaagttatgttcatattcttttaggatcgggtgacgattggaagaaaccgagctggttttattaccaagacacttgtccttaccagacgttcatttgttaacatgtatagagatattggatactattggttgcggatggccatttatatttccataagtgcttgccttggcaccatattttacaatatgggctatggatccgattcaattcgagtaagtgaagataaaatgttggctgttttcacacaaatggctgatagagtatgcatgtaccaaacatatttattaattaattttaattgattcttcatttcaggctaggtcatcaatgttaatgtttattagcaccatgctaaccttaatggcaattggagggttcccatccttcgtggaggatatgaaggtatttatgaattgatatgtcattagcagaaagagcaaacatgtttactctatataatttgttaaaatcgactgaacacacatatagaccaacgggcataaatagtaaaattaagtcagtgaacttggatacgatgtctggaattgattattcaaattcatactactgtaccaaaagattcaacaaagttatcaacacgaataaaaattttccatcaaggacatgggatagtgctatttaattaagagagagtaatggaaataaattcattttcaatttaggatattaagaaatcatgtgaagcatcgcatagaaaagccttaaataatctctcttatgcatcctaataaaattcacaaatacttgcaatgtcttttgactctggataaaaatatttcaaacccacagctttcatttagtgaattgagttatactcaattaccattactaatatttaaatagccatgtaacactccgtccgcacttacaacatattgtaaacaatcaatatcagcttacaatatagtaaatcagattctagaattagtaaatcatgaaaataatattattgagatccaatggagcacagcttaatattcattaatttcgaatttcaagacaatcagattgtgaaaaataaactaactgagactacataccaactacaactcagtatttattaatttgttattaatatttgtcaattcgtaaattttagattgttaaataaaaactactacaacgcataactccaactgagtacacctacctatattataaactccgaacttaacaaatcgaaacactatttgttggacattctctggccataggtttgatagatgcacacatgattaatgtgggaatttttaccttttctagcttgtaggattaatgcagggcttcttgtgaagcctctacttattatatatataaaaaaacccccaacttatttactaaaaattccagagtgaaaatttaataattttattaaaataatttaaatacttcgcatctgtacaataggttacatttcatgtagataaaaaaaatcgaaatatgcaaggttgatttatcaaatgaatttgcatttgtgcatcacatttttcttaatatgtggtcttatatatctacctttctcttcctgttgctcagatctttagcagggaaaggctaaatggacattatggtgtaaccacatttgtcatctccaatacattgtcatccacaccatatcttcttcttattgccataatacctggtgcaattgcgtattatcttagtggcttacaaaggcaaattgaacattttgtctattttacgttagtactttgttcatgcacaatgctagtggaaggcctgatgatgatcgtagcaaccatcgtaccagatttcctaatggggatcataacaggtgctggtatacaaggtattatgatgctcacaagtggattcttccaacttcctaatagccttccaaacatagtatggaagtacccaatgtactacatctcctttcacaagtatgcactgcaggggttttacaagaatgagttcttaggtttagtactcaaccttgaaggacccataacagttagtggcgagaaagttattgctgagttatttcaagtggaaacaggtcattcaaaatgggtagatcttgcagtactttgtggtatgattatgacctatagactattgtttgtagtgattatcaaggttcttgatatagtcaagcccatacttaaggggatgacatttaggtgcaacactaaatgcattcatggcatagagaacctttgcgccccctcgtgattcttgttggaaaatagtatatctaatattgtaatattgcttggtgcacttatatacagcgagaaaaaaatgtagtattgtatttatattactcaatataagtatgtgactatattgtgaacagattcactactggagaaacgctttttagtcccggttaggaaccccctatagtaccggttttctaaccgggactacgaatccgggactaaaagatgtccagttttagtcccggttgaaataaagagactaaatctttagtcccaattggtgctaccaaccagtactaaagttaattttttcttttttttcttttctggcgccaaatatctccaaatcattagaaaataataaatcacaaatcatagattgggttcgcacatcacagattgttcacacatctcaacatcccaaatcatccacatcaacaactcaatatctcaacatcccaaatcatccacaacaacaaatcacagatcattcacacatcattctcaaatcacagatcaaatcaacaaacaatcattcacataacgagaaggaaaaaagaaaaaaaaatccatgaagcctgccaccacacggccttccgcgccgggccgccgtcgctctgccaccgcctgaccgccgcctccccagcccagcatgggcccgaccgctgccgcccctccccggcacaggcccggccgccaccgcccccacccagcacgggcccggccgccgccgtctgcttctcccgcagatctgaggaagagaagagaggaaaacttaagaagtgtggaagtggaaggggagaggaagagatgagagtgaaagaggaagatgaggaagagataagggagagataaagagtggaggggaggaagagataagggtgaggactctcagatgcgcgcggagagaacgatggaagagagagagagagagagagagagcgcgagacgtgggaaactgatttgtagtcccggttgtttataacaaccgggactaaaaatctgattattagtcccggttgtttataccaactgggattaaaaatagtgggggacctgccacgtcgtgacaatgaataaaccggtacaaaagatgatctttcgtcccgttaccaaccgggattaaagatcattgcacttttaaaccgggactaaaaatgctttttagtcctggttttttaagcaatcgggactaatgttgtttttgggcaaccgaccaaagatggtttttctagtagtgattccttgcacataatgatgctatatcaaaaatatttttgattctacatgatatatgtggagaaaaatatatttattatcttgccaccattttgttgcaacgtgtgcaccgagcctctggtaatctagatctggttctaatagtcgaagcagcaccttgatcatgaatcacaaataaagtaacttctgattttggcggtgataggatctaattcagctagcaagccaattaagattgattgcttagatcaccttctgaaaactaaaaaatagaaccttgacagccgaaattccattttttagtccctacaacaacaaagacacggcaacgacggtgacaatggtactaacctcaccagaacttaaaactctaaacatactaatgctaagaccagcaacatgacacaacggtacaacgcaaaaatcaacaaagcaaaaattaaaaagaacaacgcaacaacgcaaagatggttaggtaatggatgaaaccttttttttgaatggctattttctggttataggaagataaaaacacaccgagcaactaaaactctgataccacttgatattaccctgagctcgaatgtatgtgctcaaagctctgattgactagatctttcggcgagttaagataactacaatttgggagagaagttgtcgactgtcacgcccagaaattcccgaatagaattccaagcagaatgtgcattaaacccctgtctaggaccggctagggtacacaaatgacaaagttgacatgcagattcacgtcttacaaacatataaaagtcttacataaatgcagcacaaaataaaagcgagcttattctagagcttgacatgaacagcgggcgacaccattccacaagcatccttgacggcacggatgaagcctactccttcgagtaacataacctccatctgaagcatactccaactctggggtgggagacagaccaagactgagtactacccactatactcagcaagtcataccggaagagaggtatgatgtagtgtatatataccaagggagctgagggtttatttgcataattctagcatttaaaagtaggtgttgaaagcagtaaaatcgttttaatgaattaagcaatattaatcatcactgcgcaacactacaccacgttgcaacaggcccaaccaaccacttgaactacacaagttccattaggtcaaattattatagatgagactaatcacggtgaatttgattggccacccataacacccgatgagactactgaaacatgaaacaaagctatttttaatggtttctttgcattttcctagatttactgagacttcaatgggcttaaacggagctcggatgaattttctatgaattttagaatattctctctattttattactattaacagatactccttaatgatttattgcgcaataaagaaccctgctgatgtcatcaggagggaagcggagccggccggcgggccccacctgtcggtgcacaagggcgccggtccgcagtggaccgagtccaaggactggggtgcggcgcaccacatggcacacacatgtggcattgacgtggcagccacgtgggcggcagccgaacggccccaatctaccgagcggtagatcggacggctgcagcggcacgggcacagctcgatcctgggccggccagccgtggcgggcagcggcgcacgatgcggtagtggtggcgctaggagggagagggggaagaaccgagggttctcaccgaggggttcggccgacgcggagggagacgacagtagacggcgacggcaagatgagtgggtggacgacgtccggagcggtctaagggagctaatgagaggacttagaggaagagaagaggtgcgaggcgagcggaaatgccgtccgaaggcagcggaaatggaggggctcactggtgtgctgtgaaaggttgttcccggtggcggttgacgacggacaatttgcagacgaggtggccctcgcgctttcgaacccgcggcagcgatgacatggctcggctcggcgcggcggctagtggcagccggagcggtggcgacggcggcggagatgggggcgacggcattagagtggtgggtgcatgggagcgggggtgacatttataggggcgaggaggtcgggcgtggccaggaacggccccgattttgccggcgtagtgggggaggtggagagagagagagagaggtgggattcgaaaattgaatcctggccatctcgcgggcatgggtgcgtgggggagttgcgcatggggtgcgggaggtgggcgacatgcgcggggaggtgggggatgtggcgcggaggcaggggtgagcctgtcggtgccccaagagagagagagtgatgaagggcggacttcgggagggggcgcaggcagcaaggaggattggggcctgcggcccaagaaagaggaaaaagggaggggaaaggaaaaaggaaaaggaaaaaggatttctagggatttctttaataacatagactgattttaattggtttaaattatctccagggctctgaaaaattccgctaaaaatcctattaatgtattttgacatggagaatccaacaaaaatcccaccatgtcgattcccattattaatcgcatttattaattaatgattagctctaggcttgatgaaattcaaagctaaaggaaggaggacttcaggatgtgacaaacctagcccccttaaacggaatctcgaccccgagattcggaaaagctggcaaagaggtgcggatgggcggcgtttaactcgtcttctctttcctaggtgacctcttcctcataatggtggctccactggaccctgcaaacctggtgtccttgtttctggttcttctcacgctggtttcaaggatgcggacttgtttctccacatatgtcaaatcctcttgaatctcgatgtgcttagaactagcctattccttaggtacgctcaaacatttcttcagttgagatacatgaagcacatcgtggatactagccttgctagatgggagctcaagctagtaagcgacttcacctctgcgttccaaaatcctgtatggtcccacaaagcgtggtgccaacttgcctttgggttggaagtggtgcactccccggagtggcgtaactcgaaggtacacatagtcccgggcttcaaagataagctatcttcggctgttgttcgcgtagctcttctgccgagaccgtgaaattcttatcctttccatgaaggttctgacttttttcctctacatcactcaataattcggtcccaaacaattggcgttctcctgtttggtcccaaaatagacggccatttgtaagctggcctgataactattgttgtaggagaactcgctataaggtaggcttttattccaaactccgccaaaatcaagagtgcaagctctcaacatatcctccagtatctgattgaccctctcggtctaaccatcagtctgattgaccctccacaagggtcctgctcaacggctcaccgcgcacacccatcaagcacgacaggggtcttcatcaaggggacccgctatcccctctcctctttatcctggccattgacccattagttgccgtgttggaaaaggccaccgacctcggctatctcacccaactaaatgggagaacaccacgcctacggatgtcactttatgcagaggacgctgcaatgttcgtccggccgacagtcagagacatgagccacttagctcaaatcctacactccttcagggacgtaaccggccttcagacaaatatgaaaaagagccagatcacgcccatccgttgtgttggcatcgacatacaagagatcttacgagtcttccctgcaaacatcactggcttcgcaatgaaatacctgtgtctcccgcttgtggtctccaagctcaagaaagtccacatccagcctctgttggataagtgcaaggccagattggcgccatggcaaggttggatgatgacagcggcaaggagaacaactttaaccaagtccgtcctaagatcgcaaacaatctactatctaatagcttaaaatcccgaacagtatgctccattcaattgataagatgaggaggaaattcctatgagtgggaggagaggatatctcagttgggaaatgcaaagttagttgggacaaagttagtcggtgtgctagacctggactggttcacccgagcgctaaggttaaggtggttgtagtatgagtggacggaaccgaacaagccttggaatggcactgcactctcctgcgactagatagacaaagacctcttcgcaacggcgacgacaatccttttacgggatgggtagacggccagcttttgggattcgcattggcttgagaataagaagcccaaggatatcactccagctatcttcgcagcctccaaacgcaaaacaaggacagtgcatgatgcccttgacctcaacacatggatccgggatattgatctgctgcgtataactgaggcggatcatctgtgccagtacatctgcctatggacattgatacaacgtgccgcccccctaattgatcagaaggattcaatcgtctggaagctgacagcaaattgaacctactcttctaactcagcgtatagactgcaattccatggagcagcaggaacgatctatatccagaccatttggaaatgttgggccttgcctaaatgcaaattcttcttctggctagtcatccaaaacatagtatggatggcagataggttgcaaaagagagggtgggctaatcaacatttttgccccctctgtcgcaccgtgccagaatcggctctacaccttctagcaaattgcagattatccagaaggatttgggctgaactacaaaggtggacagggttagaccttcggttgcaagattgggatgggtgcgcaacggtagaagaatggtggtattaaatctcacgcacggtgaactgcccaacaaaggcccttaagttgatgatcatcttgatttcctgggagctgtgatgcgaacaaaatgccaggatcttcaggcatgcggcctcaactcccgccaccatcatcgccaagattaaagaggaggcacggacctagatcacaacgggagcagcaaaaatcattgagttaatctctgcaggagagtagtgcctttctgttttattttttgggtccgattttcagtctcggaccctgttaatacttagttggttttttctccttctctatcaatataaaagtggcaaagcttttgcccttccttcactaaaaaaataaagaacttcatagtggaaccaaaggattagtttggtagttggcatgttgtgtgtatttgagcacaccaaccattaaccccccccccccggttggcttagctcttgctattcgatcctacaagtggtatcagagccttgttttgttctttggattttaaccgatctagagttttagccatggcaaacaagtttactactaagcctcatgtttttgatggttcggattttgcttattggtgtgataagatgcaatcttacattatggctgaggattatgatgtttggcaaaaagtttcacagccacatgttattcctgaacagattgacactattgctttgaaaactgagtttaataataattgcagagctcgcaatattcttttgagtggaatttctcgttcggattttgatcgagtttcgcaacataaaactgccaatgaaatttggaatgctttgaaaaacattcatcaaagaactactaacattaaagaactttgtcgagatcttttgaaaaaggaatacataaaatttgagatgaaacctggagaagctttggatgattatcttggtagatttaataagattttgagtgatcttcgatctgttgattctgcttatgatgttaattacacataatctgaggtttctcgtcactttttgaatggtcttgatatgtctatttgggagatgaaagttacatcacttcaggaatctgttgacatgtctactttgactttggattcactttacacaaagatcaaaacacatcagatgaatattctttctcgtaaagttgattctaagtctagtgctttggtttcttccgcgacttctttggatgttggtgcttcttcatcaaattctactgttcttgctttgattcattccatgtccgatgagcaactcaaacagttcgaggaggacttggctttggccgctaacaagatttctcgagctatgaataatgttaggtacaggaaaaaaggtggtccaactcatcgctttgaatgtggtgctcttgatcacattcgttctgcattgtccgaagcttgggagaggcaagaaggaagacaatggtggagagaagaccaaggacaacaaccccaagagcacgttcaaggggaagaagactaaggagaatctcaagaagatgtttgatcaagttttgttgatgcgaaaaacacacactggcctggaagatctgcttaacttcagtgcaggtccaaaatcttgcctttaggttcgtgagcatgccagttgatttgatcctgcaatcaacaagaaacaaaacaaaagaaaccacggttaaatccataaacgatagccgatcggccagcagccgatgacatatcatttattcttgagccgatgtcatatgtgaatcgatcggcagttacaaataagcaaggtaagactaaatctactcgatcgagtacatatattaacgctatacaatctttctgtcgatgtatatttaaatcaagtgattgggatagatcagtcgccatgccgagacagtacaaaccacttaggtcgaaatatacattaacatgaagattataaacgcttatatcatagccgatcagatagatctagcatgtatcggctaatactccgataccactctacattaagatattaaaacagatatactatatcaaacaaaagcctaatataatttattgtgataagatcttaacgcaaagggcagacttagcatatcaattaaacatataaaacataaagctaaatcaggtaagatcagctgaaaccccgatactatctctcttgataatcataaaacaagctagatatcacaattataaataacacataatagatcgaactcaaccgatacagcattaagcataaaggcaagtatgaaatctagacaagatgatgagaatctacaggagatgatagatacatgatacaatctagattaataacaaaatataactctactgattgtttcctaacaaccagaaccagccgataacaagttatataatgcaactagcatagattgaaacatgtatatgataactcgacggattacttagacagggttcaagtatcataaagatggaagtattaaccccgataacgcaagccgccataacaagttttacctctagttgaagatcgaatcgatgcagctcaactcgaaagcaagaactcgtcgaaaaaaacgaaagtaaaagggtggcgatgcgccgagattgtattgaacgaatgttaattgattacatgggctcgggtcatatttatacctgagatacaagatatgtccttaccggacacgacgcttatctctaacaaactctaagataccataagtctttgcggcagactcttgcccaaacatatctctaaggaaattacataaaatatcctaattaatatatacaattgcctatccgagagccctatctccatcgcggcaatcttggtgaacatcttgattgattctagaaacatctttgaaaccgccattatcagaatcggctgcatcaccttcatcggctgtatcaatcatcctctgtccgatccatctcagccgatgcagactccagctgatgccttcgcaaccagatgcatactctgtttttctaatcaatctctttatcgaatccaccttgatcccaatgtccaaccccgattatgacttaccatatttggttgtcaacaagtctatgctgcttttgagccactaaccaatgtagatggtgagagtgaagatgaagataagggaaagaacatctccggtgtttgcttcatggcacgtggtgaatcgaattcagagtgtgaagacaatgatgtgagttcttttgaggaagctattcttattttaagtacaaaaaataagaaatgtgagaagatgtatagaaaacaggaatatattattaaatctcttaattctcaaattattagattaaaatctcttattcgtaatgatgaagactgcaaaaattgtgaagttttaatacatgaaattgaaaaaaaaaattagaggtgtcaatgttgcacatcatttgaaaaaagaccttctctttctcttggatttctcttgcacacacacactttggatgagttgtttttgactaaaaagttgttataaaaatatcaaattgtttttcatgctagtttggtatttaacatgatttgtgccaaaaagttaaaacaacaacatggtgttttggattgctcaacatgtacaccaaacaagatgaagctaaaagatgcattaggtcatgttgagtacatggaggaaattgtgaaaatcaatgaagtgctttcttcccccaaatgtcgtaaaagcaaaggtgtcatggtagattgtgaaaattgagttaatttgcaaaaagagatttcttatttgaaaagttatttggaaagattttctgatggtaagaaacaacttaacatgattttggatcaatctaaagtgactagttacaatatgggtgttggttttgatgttcatgactatttcaccaaaaatcaacctaatgttttgagtgtgactgaacatggtgaaattttgacaaaactaagttctaagaaaataatttttaagtctactggaattatgccctctctttctacaacactaaaagaaacaaaaacaaatctttcaaaaccatcttcttctaaagaaaagtatacttgttctttttgtggtaaagatgaacatcttgttggttttgtttcagattagctcataaacagaaaaaggagagagaaattgcagttgcaaaattaaagtggcaaaaatctggttttccctcatggaaaccggtcagaccgcagtgggtcccgcggttagaccggtgaccggtcaaactggctactgagcggtggtcagaccggcggtacagaggcggtcagaccagcagtaccccatcggtcagaccagcttcggagagatttttctaaaaattctcaaactatttttgcatgtggatgtatgcctatttgatctactggttgtgtgtctcagtattggattcctaaatttcttttatctaaccctagtactgaggctttgacgtcttcttgtgtgtaggctttggtggcaaggaaggagaacgtgtggatcgtggattccggttgttcgtggcacatgaccggtgataaaaattggttctcctccctcaaacaggcatccaagactgaatcgattatctttggtgatgcttctactagtgccattcttgttacaggtttttgttaaggtaaatgacaagttcgaattgaaaaatgtagctttggttgaggacttaaagtataatttgcttttagtttcacaaattgttgatgaaaattttgaggttcactttaagaaaactggaagtaaagtatttgattcttgtggtgattttgtgctgaatatttctcgctatggaagagtgtttaaagctgattttgaaaatcttgtttcacctgtgaaaacatgtttggttgctaagtttaaaaaggatgtgatgctttggcatcgtggacttggacatgctgattttgatcatcttacgaggttaagtggtttggatcttgtttgtggttgggctaaacttaagaaagatcttgatttgatttgtacaccatgtcgtcatgctaagatagttgtttcttcacatgctcctattgattctatgatgacggatgcaccgggacagctattacatatggacactgttggtccagctagagtgcaatccgttggaggaaagttgtatgtgttggttattgttgacgatttttctcgatattcttgggttttcttcatggcaactaaggatgagacttttcaatattttcatgatttgtatcttcgattggatcttgaatttcctggttctttgaaaagaattcgaagtgataatggtggtgggtttaagaatgcttcatttgaacaattttgcaacgaaaaaggtcttgaacatgatttttcttctcctcgtgttccgcaacaaaacggtgttgttgaaagaaagaatcgatctttggttgagatggctagaacgatcttggatgagtatcatactcctagaaaattttgggctgaggcggttaacacttcttgaggtcaaaacttggaaaaacttatgaacttcgatttggacgtcaacctaaagtttcacatttgcgtatttttggttgcaagtgctttgtcttgaaatctagaaatttggataagtttgaggcacgctctaccgatggaatgtttcttggttacgctgcacattcacgtggctatcgtgtacttgttttggaaactaacaaaatagttgagacttgcttttgatgaggctagtccaggtactataccagaaattgtaggtacattgtcacaggttcaggggaggatggtcgtatttttaaagacgagagcgacgactttgacaatgaggttggctcggccggtcagattgggcgccaggcggtcagaccgctagcacacgtccagtcagaccggcgtaggatgtgcggtcagaccggccaggttcgtcgggttctggttttgttgatattgatcgtgatggtcctccagaggctacaacttcgactagtactggtacagaacatgaaacaacttcagaagtcgttgctcctttgcatattcaacgacgacatccgctggaacaaattattagaaattttggtgagcggactacaaggtctaaggactcatgatgtttttgcaaattttgcgtttgttgctacttttgaacccaaagatgttactcatgcattaactgatgaatcatggattaacgtcatgcatgaagaacttaaaaattttaagagaaataaagtttgaattttagttgaaccaccctgtggatataatattattggaaccaaatgggttttcaaaaataaacaaaatgagaatggtttaattatgagaaataaagctagacttgttgctcaaggttttactctggtggagggttttgattttgatgaaacttttgctcatgttgctagaattgaggcaattagatttttgttagcttttactgcttcaaaaggttttaaattgtatcaaatggatgtgaaaagtgcttttcgaaatggttttatacaagaagaggtttatgtcaaacaaccaccaggttttgaaaatcctgattttcccaaccatgtttttaaattgtctaaagctttgtaaggcttgaaacaagcacctagagcatggtatgataggcttaagaactttttgcttgcaaaaagttttcaaatgggaaaggttgacaaaatgctttttgttcttaagcatggtgataatcaacttttcgctcagatttatgtagatgatatcatcttaggttgttcaactcacgctttggttgtggagtttgctgagactatgcgcagggaatttgagatgaacatgatgggtgagttatcgtactttttgggattgtaaattaaggaaacacctcaaggtacatttgtgcatcaaacgaaatacacaaaggatcttttgagatttttcaagatggagaattgcaagccaatttcaacaccaattggttctacagctgtgttggatcctaatgaagatggtgaagctgttgatcagaaggagtatagaggtatgattggatctttgttgcatctaattgcttctaggctagacatacaatttgttaagtgtttatgtgcacgctttcaagcttctcctcatgcttcacatcgtcaagcagtcaagcggataatgaggtatttgaatcatatacttgagtttggaatttgatattctacttcatcttctatatgcttgagtggatattccgacgctgattttgctggttgtagaattgataggaaaagtagtagtggaacatgttattttcttgttacatcattgattgcatggtcttctagaaaacaatctactgttgctcaatcaatgctgagtctgaatatgttgctgctgctagttgttgttctcgatcagattctttgacttatatcaactttgaaagattatggtcttacttttgagaaagtacctcttttttgtgataatactagtgctactaacattgctaagaatcatgtacaacactcatgcacaaagcacattgatattcactttcactttttgagggatcatgttgagaaaggagatgttgaattgacgtttttggacacaaagttgcaacttgctgatattttcactaaaccattggattcttctcgctttgcttttcttcgtggagaattgggaataattcattcttttggcatggtttgagggggagttttgtacatcatggttttatcaatcaaaatttgacaataagaaatattgagaacaaagagctttgctttatacatatggtattttcttgtgcatgctagcaatactatgaaggtttatttgtgtctagcatagcttgtatgtattttagtctttttataaggcctagatattgtttttaagggagatgatgcatgacacttaaattctataacttgaattaagaaaatatgcaatattgatgctagcatatggtttgatttataaatgcttatatatgtgctttattgaattgttattcctcaaatagctttgtaatgtctcattgtgcaagcgaataaaattatctatgagagaaaaaatgaatacgaatccttagaaacagtcttgacgacaaggacgtattcgatgtgagcaaaaataatgggtgccgaatccttggaaacagtcttgatgacaaggacgtacccggaataattgagagaaaaatatgagcaaaaatgctaaaataaaagttataaattctcttggttgttttgtgctagagctaatttaagaaagagtgataattgcaataggtatatatgtgtagtgtttatttttcaacctatgtgcttctaaagatgttgcattataaatcgtatgaaatcatgaattttgattgttgatttgaacttagttgtaaaatctttggttcatgattatactttaatgcatgcttgctatattatggatgggttcatcttctttttattgcaacacatgacttgatatgctatatgtatgctaagctcttgaacataaatgaacataattcttatgcttcatgaaatcattgtcaaaagggggagaagagaagagattgtgcatgtttttcaagtcaagggataatttctttgttttcaaaagtgagagaagttttcttttgaattttgagcatggagtacacagtgtgttttttgctttttaccacttttgtttttatttttccaaacaacaaaacatatttgatgggtttgccaatgtgttcatcaagggaaagattgtaaaatcaaagtgtttttcattcttattctgtgatgaacaatcgacatatgtgattattggttttgatatttggagattattggcgaagtagttttggagatgattggatttgctggtgatctgcaggtgttgctgattgtcgggtccggtcagacaggccaatggttgccggtcagaccggtgtgtattgtgcggtcagaccggtcagcccgcgttctgaccggccgactctgtgtccatttcgattttgggttgcttgtttggatattgttggaggtataccaagaacttgggcaacaggcccagaccggaggcaagcggcgaaggtcgaggagaaaaccatatgggcgaaagccacaaggcgaaagccgtggcttggaatgtgccaacttcaccaagcgaagaccttgtcagagggccgcgcgagcgaagatgatgaggcgaaagcctcggcacaaaggcacgggtttcgccaaagtaccgaacctcaccgtcaggaggcccagcgggctacttacgccttcgggggatttcggcaaatagatgggccaagccatttaagcccaataggggcccatacatgtaaaggacacagtgtgccctcaataatgtccctatcataaaggtaaccatgtaaattcacttgtaaagtctaaatcctaatagggggaacctgtaatagggctataaatagccccctagggccagataatagggtgatccaaaaatttttcactaagcaatactattgtctttcttttccaactatcaatggatgtttcatgtttatggcttctagatggatactatgcgtatactatttttcactaagcagtactattgttgagagaaccacgcctttcgacgtgaagcggttgtctatttgacaacagatatccatagatgattcatgtttatggcttctagatggatactatgcgtatgtaatactgttgtttgctaacaatgagtcaagttggagatagcttgatctcggaatatggtttctttgtttgattcatgtgtaggtgtcttgatgcctcgggagagtactgccggtgatggatcgagagtcgacttggagataaggcgatatccggacggtcatatatcatacgagatacttaggctaaagatcaatgcacgtggttggtgaagattccatatggcatacgatggagatattgtgtgcgtatgggatgcgaagtcgaatttggaaggagtccaaatttggtatgattggagtttgtaaagttggtttcttgtacagaaaggtttcctaggaggattaggacttcttgtatgagtttggttcatggttttaggctgcctacctcatttataaatagagagggagggtgtggcctcccggtatcgcttttgagagcattgagttgagggttgagtttgggtttcgagtttagtcgagattttcgtgaggagtgctgttgttgcactttgtaaacacagagataagtaataaagttgtcatctacatcaagagttcttcgatttgtgtttgcttgggtttggcggtctaaccgacgagacactggcggtcagaccgatggcatcgcggtggtcagaccggcggagtagcagcggtcagactggcggcggcttcaggcgacgacagctgatctcggcggtcagaccaaagatacaatatcggtcagaccgatggctttcaggcggtcagaccggtgcaactacttcggtcagaccgcgatccgtcgaaattgagggtaacttttatttccggtaaaagttttggtttttgggtacaccaaccattcacccccctctggttggctaagttcttgctattcgatcctacaattttaagcaattacacttatagaaacttagtctaagatggccggaccgatgaatacaatgcgcgcaacacagttttcactgaccagtaggcattttctctatagtgtatgtttccagactcagtattattaatgaatcattcagacttattatattaagtgatttggtacaattcagatatgttctcagactagctgggaaatgttatcagtaatcagttggatatgtattatttatcgattatcgctgctgcatataacaaaatatttccaacaaattacataactttcacgcaattgagaactatgaacaattcactatcgtgtttcatctacaaaaaagttacaatttagctgagccttcctatttttctatgagtacacacttggacatttgcacatctgaaataggtgggaagctagtgaaatatcatcttcactttataatttgccttcctagcagttctgttcgcttgaatgggaagatcacttggtgggggaagcatgaatgtactccagttccgtaaaataaccagtctgcaggaacatgtcaaaatcattgatattttaaattaggggatgacttattgctctaatgatatccactgaacaaataagctggaaaacatgcatgataatttcatgcagatcatcttttttacgtagagggacgctagctattcaggatctaaaagttctatgttacttggcagctcaagttacattaataaaaacaaaacaagacttaaagaaacctaataagtatatgtgtgtgaaaaatatgagagctttcagcggtgtgttttgaaaaatattaatatatcatactgacatcaattttgccacaattgcacttctagtagcaacatgggtggtaatcatattattgtatcacctccaattactgaaaggtgctattttggagatacgtctagtttaaatttcaaaatttaagcatcaggaacttttaaaagtattgagatcagatgtatgaaaattatattggttgatttgtcttttgaaactaaatcataatattatagtttatttgttttacaaataagagtttgtggtgaaaactatacttcaggcagtaccattgtacaaaatggctcgttttcatgcacagagggatttatatttttttcttttcttagttttttgttttttagaattgtaagtactagtttatactacatgttttaggttttagcacctctgcagggccactgttctttactaagatataaattggccctgccctgcttttggttgatacggtataaggatcagagtaagtctatgtactgtactgattgcaatgtaatataagtggataaagattaaaagaaaaactcaaaacccaatttcctgttgctttggatgcatgcataccacacagggtaaaagttaactcactttgcagaatcacatgaaataaatactttttcgtaaaggatcagattacctttttcagaaagaaataagtctcaactttcctatccatgtttacagcatccaagtcctatgtcagatatacaacctcaagtgtaatgtatgtgctctaatatattatgcagctttgaaggccttcttcgaaataaaggttctaaacggaaagaagaaccaccattttttaacttcttagcgtcatacatttcattccatgcttgaactatctcgtcaatcttgaagctcaatcctgcagaacaaagaaaatgtatcagctatccatgtaccaaccttatagctagttacagaatgttaatctgaaactcacatgtttgttttactaattgtatgatataacctgactacaaattgtccaagaagtcccagtttctcaaccataaatagtttatcaggttatgctagtgaaccctgatatctaacaatgcaatgttgtaccgcgtggtttgcacacatagttcaccttatgttattgaaattgattgttcttggctagaggtaaactacaattgttcttggctagaggtaaactacaacctggatagataaatcttatgcatttgtgtctcagtaatggattcttgatagattacattagccttgtaaccctgctcggtaagtcttccacctgtgaagaatccaattgcagggaaatcaggtggaaacaactttgcttcttctttttttcgcagggctggcgaaagccagccgaagtttattaagaagagggggaaacaaagtatacaaaggttacagagaactttgcttcttcactcattcacatttttacttactcataaactgctgcagtcgtagaagcccagtgtttgtaacaacttgtaattttaataagaaacaagtcgaacaatacaaacaggtcagttgtttttcatctaccatgacaattatgcatgcaccaatttttcttactcactagctattccaaaacaaaaccgtttagtatcgacccaaagtaacattttaccaaaagttaggtcagaaaacttgcaaaacaaaagtagcaatgttaactgaacatttcacgaactaattattgcaatgtacaggaaaatttgcttacatagacaagatgtttgggagtagatgatttagcaggatttcaataaataaatattgagtaacgcgtaccttcctgcgttttctcatttgcacagtggttctttatcatcacactgatgtcaggcagagatgctcccccagtcttaaatttttcgattgcttcagtaagactttcctcccagctggataatcctaacttgaattccactaccgaacgctcatagagaatggtaccccatgaaatgttcagctgtgatctcatatttgaagcttgctcaaacgcttcatctgctgagaactcctttaaatgtccattcaaacccaatttatccagtaaaactttctcctttttggatttagatagtccttttacacgcagatattctattccttcccacatttcgatccccttttccatattgtcctcagcatggttgaatagttcaaggacttcggttcccattcctatcttgcatgcatctgcgtaacgccatgaaagctttgcttgctcaaactgttgctgtccgagtgcaatgagaccttcataaaagtctggttttacgtccactgcctcctcaaactttttcccagctttgacatactcagcgcatgcccattcatatgcatttttgacctgcagaagtattgattcctgtgaagcatcatcagataaaagtaatcgcttctttgcacgagacatgtggacgttgccccaattgaacaatgctaaagctgccatttcctgaaattttgcctccgcggattgaaatatctcctgggcttcttcacttgtgatggtttcttccatggcttcatagtacagcctcataccgaggtcacgtagatccacatatgcatcagaatcaaaaccaacatgatacttgaatagacgggcaaattgtaccatccagtcatctgtataagaattcttttcaccgccatgcctagaacttccacattcagacatggaattgtgatttctttctaacttactgtaggaggtagtgggcatgacaagatccctagtgatctcacgatcaggacttacctcctttatatacaatcggacaggctttagtggatctagttcctcaacccatcgcagttcttcagttgaggtaattgtcaccaagtcaccctctttgtccataaatttaagaaggattgacttcaagtgaggagtgtacttatagcgagctatgtccatcagctgcatcagagttatatgttctggaattacaacgatccgtatgtcatctccacaaacaaacttcacgctcttcattgccctcttgttaacatctttgtgattcttatgcttgtctctaccatggattgttggcttgagcgtggatcgcttttcctgcttatcctcaccacgaccaatatgcctgtctagaaaatgcttttctcggctgccgttggcatacctttcaaacttgtccgtgtgcttttcttgcatgccgagactattggtttgtatctgatcaatatgcttttggcgtttgtccacaccactacagaatggatgggtttcctgcccatgactgcctctaacatgtatctctttaagatgcttctgatgcttctctttaccatgcttcaggttgacacacatctcttccatattcagtgaagaatgctgcagtactgtcttcccatcgttgctggctcctcgactgcactgcccttgcttcggcctggtctcctctctgtacttctcttcgctgctccggttttgttttatgtgcatctgctcagtgtcgttttcttcgggtcttgcatcattctgcacatggttgttcccattgcatttctcttcctcggcagcctcatcatcctcttgcatatcctcttcatgaatcatttcccacacctcttcctcaactatggagtttctgaatttgcgggataccttcctcttgatcttatcttttgctaaaatagccttaggctcctcagccacaggcgaaacaatctgtttctccagcaaaacgtctttctcctccatcagctccttgatactctctgatagctccaatgcagttacattgcttggttctaagctcagcaccttctgtacatccttgcaagcgagatccagcttatccagtgcttcgaaacaccgtgctcttttcagtaatgctttcgtatactttggtgatgcctccaatgccagattacactcctcaattgcatgatcaaggtcctcaggattcatgtgcatgtagcaagcagcagcgttgcagtggagaaaggcgatatcattgtgttcctttggaaggagctttatcgcctcgccaaatttgatggctgcctcctcatagtcccttctctggaatagcctcgtcccctcatccttcaattcaatagcttgtcctatgatcaggactgcatcatcattactgacctctgggaggggattagtctcttcaatgttgttgggttggctgttcctcgagctgctttcaccatcatttgctcctaattcacttgtttcattccctcttggtgtagtagtactctccatgctacaagcctttcaatctcccacacaaaagaattgactcagatgatgatccgataatttcttttggagcaccacctctcctcctcttgctgaaaatcaagaaaccgcggaatctcccgctcttctttccgattaaatttgcaattggaacaagaagaaaaatcaattgatatggatgggaaagagagattgggcagcacgattcgctcctccctctttcccatgcaaatggaaaccttaccctatcctggcaatcccatcgagaatgcacgaaatatagttatacaagaaatcaagctggtaattggtgtcctaaaatttgatcagaatggaaatggaaggaaagaaggaaaggagcaaatgggaaagcaaagcacaaggaagcatactacaacgaaggagagcggacgtaggatgggatgctagcgaagggaagccacacactttttgggtgccacctagcagtggccatccatgtttgctttttttggtatgtctctaactgccattaagttcagctggttttaaatccttgtgtttggaacttggcgcaacttttgcttctctggttagcacattggagaaagaaggggctgtctgcgcatgcaaactatgtttcctaattttaggaccggttcaaaatagattatctaaaattagtttcctttaatatacacttgttagttgtcacaaataaagtagaaatttatcacaaaattcctcgttgtggccaatctaagttagaatgccatgatgtggttggtccaaccatgctaaaaaacgagctgctcaaaacccaaaacacaagctgacctctaaccaaatcctctagtggtcaggtcacgacatagcgtcggacacttcaccctcaaacactgtttttccgccattgcctatatttagcgtaatctagccaattatctctaatgtattgggccatcaatatattccaattcaggcccatttgggccaaatattcatgtgtggtgggattagtgccaatatgacaatttagataggtttgggccatcttataaacccctgcattccaaccataattctccgagttaactcttttacactaagcaagaacgaaatgatgatgacaaattaacccttttacataaggctcatacataagtagtgtgggatgcccgaccacacaggcgccccaaaaatttggggcctaaaattttaggggtcaatccaatttcatgtgttctcgtatgtttcaagatattcttatcctatttatgtaagcttcacatcccctcccgtaatctctacaaccgattttagggtcaaaaatctggcctcctattgagccacgtggcacaataaaaatttagtaagacatctccagaaaactaccacgtgtccatgaagaggagctaagagtctgcttcgttggaagttgtctcctgtacacatacatgatacacctatcagaaatctctagaaaactcgaagactctccgacggagagattacctggtcgttggagaagatgaagaggtaacactcccgtgcacatcatggtaaataagtgtgtacagttcatggcacaaattctatagatttgcaacttttcatatggtaccacgaaaaaatgacgagtattgtggctcctttaaacaacatttagaacacctttaaataatgtgatttgctacactaaattttaacttaaaaattgattgaaatttttattcgaatgtaccttctttttgtttcaaaaaattgaactagattcttataaaactttgcaaaatttatattaactttgtatttaacataatgtcattttaataatcaacacagactccattatacatattttatcattgttttcccaaactacatatctatacaaattaaaatacaactaagttttcatcaaaaatctatcgatatgatatttacaatttaatagcttatgatatggaaatttgaggatgtcgtctttttgcaacaaacataatgcttcttaataacacgaaaacgaatgcaagggctataaaaacaagcgtcggcacgcttgttttctagtgatctagctagaacgagcttagttttcttgccttccataagtcctcgattgtaattataaccatctcaataccatgactcatgacgacgacgtgcgcacatattctaggtaatgaggatttcatttttatacttcataaagagaatatagtcatcaggatgtaatgatttcctaagtttaaaaaaccattgccgttgatggttggtaagctttctcggtcatccatgtgtctatatattatgttctatatattatataaataacttgtcattagacgtgtactattcttttttaagagtgggcacattagatctaccgatagttcttctacactgatagaaaagatcaccagcaacgacatgaatgagcaaagcatagcggcagtggatacctatacaataaattgtaaatatgtggcattaagtgaaagtggctacatccattgtgtatttgcaactttagtctatatacatagtacaaagtaaaatcaactcttttgattaataatacaaacaaacgagcgcgaacaagtcaacttttccatgaccaaagctatggtaacaagtaaataagcatcatttcctatatatattttttaatagaagacggcaagagaattgccggttatattaggaggaaaaataaagttttacatcgggggtacatagaaacaaaaacaaatgggtacactgcttgacatcgcgtgtataataaaataggaattaaggtggtttaaaagcaaaatctctgtctctgatgtcctccaggatggcagagatggtatgggctatgtttggtgattggtccctgaaaatcctcgcgtttctcatgagccaaatatgccaccaggttggtacaagcgctccaagtctttgccttgcctgtactttcgatgatgaagatttgatgttcagcacgtaatcctagatgttttccagagtagagaaggcagggatttgcttttgtcgagagacttcttgccatatttgctttgttactttgcattgtctgaagaggtgatcagtgtcctcaaaagcctctgtgcagagctggcaaatccaattgcatggccaatgtctgattagtaagttctcagccgttaaagtcttctggtgtaggattagccaacccaggaatctctgttttgactgcgcctcagctgtccatatcattttaaatgatttgtttctctcagttccaaagaattgggcatggtaggcacttcttgcagagtagaggccatctgtagtttgtgtccattcaatcttgtcttcagtattcactaatagctcaacatggtgtagtaagcttcctagttgtaccagctcatgaaggacttcaacgtctgttatttgtctgaatgaagcaagccagacattgtttgtaaattcagttttgacatgcctgtttttcctgattgccacctttttagacgcaacctgattgccaccttgaaaaggtttggtgagatgtcttttggacacaggccttcgatccagttgtctttctaggaaagagtcttctccccattacctagggtgatctttgtgcaggcatgaaagagctgtacatcagccttgttgtagggcaaatccaatttttcccaaggcttagaaggatcagtccatctcagccaaagccatgtgagcctccaagctgaagaaaatttttgaagataatgaattccaaggcctccaaggattgataaattttcgatgataaagaattccaagcttgccccaggcttaatgttttctggcttatcccctttccataagaaggccctccttaatttatcaatccttttaatggcccatttggggattggtatgtagattatgcgatctactgacatgagtgctaagcctaacatgatcaccctaatacggaattcttagattactgaccggtgtttgaagccattgatgcggtccttgtccttgtcggtgtagacgaagtagtggtagcagtaggaacgccggcttgatcctgaattggtcaccggcgatcacttgaggggtagcgacggccttccggtcgccacctacactatcccagaaccaccacacgttctccctccaacgctcagttgatcggatagggttttgggattttcgaggagaagaaggtcgtggagagatcgtcacctaaccacgaaaccagcctcccctattagtatagcgctgagggagatcgggggcaatccaaattatggaaggatttggcgctaccgatcaatgcgtgtaatcacgtagttatggaaattgaattgcgttaatcccggttggaaaatggcgtctgagattttggcaacgggtggaaaaccgccgtccgagatttcttctcgatttccatgccaagagatattctttcctaacattctccccccgatcttgaggcaaatgagtttattcttagaaaaatagatttactaaggcaacgcgtcagggtagttatcatatcctaccaagactccggtacctatagttcactatatagttcactatatcttaatgggaattagttaggactaatgcccctatttccaggatcttagtcttaatcaaaggcaatcagttattcccatgccggctacatgatttttaaataaattgggaggtaagcctttggtgagtggatccgcgagcattgacttagtgctaatatgctcaatcttaatggtttgatcctggattctatctttcacaacatgatacttaatgtcgatgtgtttggcagcaccactcgacttgttgttacttgaatagaatactgcagctttattatcgcagtataatgtaattggtctagaaatgctgtcgaccactcttaaacccgggataaaattcttaagccatatggcctgccccgttgcttcataacatgccacaaattcagcatgcattatcgacgatgcagtcaaagtttgtttagaccttttccatgaaattgctccctttgcaagagtgaagagatatcctgatgtagatttcttagtgtctacacatcccgcaaagtctgcgtctgaataacctaggacttcaagttcttcagatttattatatgtgagcatgtaatccttagtgccttgcaaataacgcaagacctttttaacaaacttccagtggtctaaaccaggattggactaaaatctgccaagcatcccgataacaaatgctaagtctggacgcgtatagacttgagcatacattaggcttccgacagctgaagcgtatggtaccattttcatttgatctgattctaatttatttttcgagctttgaaatatccgaatttatcgcccttaactattggagcaggtgttgcagagcacttactcatattatatctttctagtactctgttaatgtatgatttctgagataatcccagtactcctttagacctatctcggtgtatttcaatgcctaaaacataagatgcctcaccgagatccttcatatcaaaattagatgacaaaaattctttagtctgatgcaacatagtaatgtcactgcttgctaacagtatgtcatccacatagagtactagtattataaattttacacccttagtcttaatgtaaattcaattatccacctcattctccttaaatccaaatctcttaattatttcatcgaatttaaggtaccattgccttgacgcttgtttaagtccatagatagatttcttaagtttgcaagccaaatggtccttgccttccataacaaaaccctcgggttgtgccatgtatacatcctcatgcaagtcaccattaagaaatgcagtctttacatccatctgatggagctctaaatcataatgagcaacaagcgccatgacaattctaaatgagtctttcttagagacgggagaaaaaatttcattgtaatctatttcctctctttgtgaaaaaccctttgctacaagccttgccttgaaccttttgattttccctttggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36532 - DNA, 4477 bp, Oryza sativa
  unsure (1)..(4477): unsure at all n locations
tgctaataattggctggcaaattcgcataattcaccgccgccaccgccgcgtccgtttcttcactctccgtctttccaagcagcatgacgagaggcaagaaggggatgcagcccaagatcagtgcgttcttcaagcgtcaggcccccgagcccgagacgagcaggttcttcatcttggtcccctcttcaaatctgttagctgtagcgatccggtaccaaatattgccggattccactctagtagcgaatttctgcaatattccatcaattagagcgaatattaaaatcgctcgtcaggttggaaaaaaatggttgttgatttagttctcgttaattcccaagcatgctgtccgacattggcatgttcctggattcagatttgataatggactgatcaatctttgttgatttggtaagtggtggcgacacgcatagggaaggaacctgcgggatggaggtgaagaggcccaagagctgtgcggatggcaaggtcctcaacaagaagaggaactacgcgcagttccacctggagcttgggcagcccgattttctcctccacatgtgctcggtttgtggcatgatgtatgcccgcgggaacgacgacgacgagaaggctcacaaggcataccacaagagttacttcgagggcgtcccgttcaaggtgttgcacctgatgtatatttgtgaatctcactcttctgttcatctcgtgttataaatttctgtgaagagtttatgacaaatgtttgagttgcagggttggcgcaatgaaaccgtggtcgcgaggtctgaaggtggggatcggataattcttgtgaccgatgaaaattcatgtgctcggaacagcaaggtattttgcctgaatgactaactgtattgcctagatagttgaaagaaatcactagttggggtcttggggaaatgaatattgaaaagagtgggttcctcatagttctaaactgtagaatgtgtgtctttactaactgcgaagtttctgatccaattttgcaaccactttacatttacgagaagttcagaagcagattgcagacattttatgattatgtaatgtcatgtgaatatttcaggtccaggaggtgatcaaagtggtacagaaggagctggggtttggtgaaggtcagctccttcacaagctttgtaaggtaacatcagctcctagttcaaatatgacaacatctatgcacatatattcatcctaatgggtaaaacctcatttgcgttgcataggtatatttgttcatatctagtcagaggatagtgggatgccttgttgcggaaccaatcaaaacagcacataaagtgattccaggctccacagaggaaaacggcactgatctgcctgttgataaaattgaaccagtcaaaacaaaccatacattagagttcgggaaaatcagttttaagagggaagtcctgaaacggcatgatcattcagacaagaacaaagaagagtaccgagatcctggtgctataatatgtgaaaaggaagatgttcctgcacattgtggatttcgagcaatttgggttgtaccgtcacgcagaagaaagcgaatagggtcacaactgatggatgctgctaggtaagttctaagtttgatgcgcattctcacctactttgcttcacttagcatctttctttttcgcagcattcctgcaatgcccgtcttgaactcttgatagcatacattgttctttttggggggaatacgcaaaaggcttgcgcatcattgcattaagagaaggatagcatgcattgttctctgtaacaacaatgtatagatccatcatagcacgcattgtcaatttggacaaattccaagcttttgaccagattataggactaataaaactatttgttaactgacatcacactgcaaatatcactgaattatttatctgtctgtccagttgttctcttctatgctctgcaagcatttccaagagtttgatattatcttatcttgctaaggcactctccattcgtcttctgcaggaaaagcttcctcgaaggcgagactttgtgcatctcacagtgcgctttctcaccgcctacttcctccgggaaggcgctggcacgcagctattgcaagaccagcgcattcttagtctacaaggagcaagatgcataggagatgctgcagaagatgttacatatctgaaacttctcttcccattgtaaaaattgctttgctggggatatatgtgaaacataaacaggcatgttctgcttttagtgtaagtctaagcaccagaagcagtgcgtttttgcaggatctctatgtattgacacttggatttcctgatcagcagcattttctgaatatcatttcatattagtagcttgcaatcttccttggggaagatgagatctttattagtccttgggagttattaacaggcagagttatcttctagtgttaacctctgtctctcaatactctcaaaacccaagaaaaacacaggggaaacagtacaagccgctgcaatcatatgggaacatgtcacaactttggtcaatatatacagcagaccgatgatacaatgttctgataactagtcagaatcaacaatgggcgacactgatgcttgtgcgccagaataatacatcttttagtgttttctcctcgtcaatggaccatggatggctgcatttgagtactcatcaaccactgattgtgtaagtgatggacgcaaggatcttagcgcggcctggaagtgaatatcgtcacatacaaaacgctctgacctcagactttccctcaaggcagccattcccgcctccctgcacaggccttcaagatctgcgcccgtgaaaagctcggtacgctctgctaccttccaaagatccacatcatctcctaatggcattttgcgtgtatggatgcgtagtatttcatatcgaccttccgcatctggtggtggaacatacaaaacctgcagttaaaatgaaaaaaagaacatgattttgtttgctatgtgtgagggagagggagagggagatcgggataccatatcgaaacgccctgggcgcagaagagcagcatcaattgcatttgggcgattagtagcagccaatacaataattccctacatcaaaaattgcaagatacttttttagtacaaagaaagggcatatatgagatatgacaaggagagtcacatttgaatgccatcgtcaatctaaatatgtaagaggtaccgtagccagttctaaaccatccatttccgtcaatagagttgataagagtctttctccaaccgtggcattgccactagagttcccgctgggaccagttctgaacgattacaaactccaatattaacattcactggtcagatgtggaaattagatttacatgcgcagaagcaaagttttcataaattgattctactatatgaaaagaacatttggggaaccatatccaacaaaatatgcttaacacttctgacacctcttcaacttcctaatcatgtacaccatggaaaagatgcaaatattattattacgtaattatagaagatagcctataacaattcatgcacattcttatgatgattgtacagaatcatttttaccaatatcatgcatcatgtatcatagatctcactagtatgtgccacaggacaacaagagacaagatataaatgtgcaccttttaggggcaattgcatcagcctcatcaaaaaatataatgcttggagaagcaagacgtgccatctggaatgtacgtcgcaacaaagcttcaccttcaccaacatacttggagtataactcagcaccactgtttgaaaatgtgtaagaaatttagaacaacatagaagactgtatactgaactcaaaatgatccggttagcatgttctagctatattatttggactagcgtacaggacaacgattcaagcagcagaatttgaacaaattatgccagcttggtcttaacagtacatgaaataaacatgttaagttcttttgcttcctctaataactccttttcagtacatctgagattaagtgatgtttattgaatttattacaatataagcatcacatcagaaaatattatgcgattcacaggcttctttttgcatgttggaaggatgaaatgagaaaaagagagaacaatttttacgcagcaaaccttaatgaaaagaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36533 - DNA, 16492 bp, Oryza sativa
  unsure (1)..(16492): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatcagactggcctactcgtggaatttttcatacttgacgtaaagcatacacgaaaaagatgtgctgcattagcatggtattatgagtgatggcacatcaaactatctgattatgatgcctatctaaaaaaatgatcacctcattatgatgtctggcacgtttgaaatcagggtattcagaatatgttagctgtctttgctgattggttgtttcattgcttaagagaggttcttgcgttgtcagaaagtcaggtttcctacgtaattttcaagcagagtcagtctctacagtaccagtagtatcagaaattcagaatcgaactaccgcacgaattactttgcttgaggtgaaactcaacctgaatttatgccagtaccaaaatgaatcctttcgagttacaaaattccggaattcggaggcaagtacacctcatcactctctcgtagtacacaccaaacattttgtgcattgaagaactgcatgcaggcagggtagaatttggagcgacgagtgtgtgtacaataccgtgtttagttctaaagtttttcttcaaacttccaacttttccattatatcaaaactttcctacacatacaaacttttaatttttccgtcacaccgtttcaatttcaaccaaactttcaattttggtgtgaagtaaacacagcccaagtactcttcctgctgcgtcttcgtcgagcaggccggcattcatgtgtctgcaccgcacatgcgattctatcatccagtggacaacagatcataaagcctcccctaccccagcctgctgctccgtttctgcctgtcctcagtcccctctcctctcgccggggccacagtccccaacgcccggaaggtttttgttttctttcaccaatggcgaattggcgatcatggcgtacgttctctctctgcttcgtcatcctgcttatcttgcgttctggacttctggttatggttaggcccagttagatgtttggtgaagcccagatagttcacttagccaagtgccatgaaccaggctccggccatggcccatttgatatatagtataatgtactagtaagatgcactattgcttttgtgttcttccacgcgcgattttcttgtccgaaacaaagtacaattacagatgcttatatatgtgcgtgcatactctattatagtggcatgccttcaagatactagactagaactttatgaactgctcggacagggttgcttgttgataaatagcattcgcacctttttaaaaagagcatataatttaagattaacgaagtcagcgcatgcagcttattatcgatgggtgcattatctatcattaaaatagtttgttgtaaatgctagcttcatcttggacctcttggtgacacaaggaaaaaatagtttcaacataacgttcagaagaaatacaagacgttttttcactgtccagttctatgctttgaacaacgattaatccaataatatttaattttgcaaaaaaaaaattactgtaagtgaaatagtgtaacagaaatttatggccaaagctctcttggacagtaataatataccttatatagttattttttcatgaatggagttggattggactcagttcaaattgattagagctatatgtgcttgttgcttaattggatgtgtgtggactgtgatgccacagcagtagaaattgtctgtaatattattggtgtggtatcagccactgaacatatggtttcacatgtgcgccagagagatatgtatctatgtcatgtatgggcagcacctaactgcagctaggattaataaatatgatcggttttcgtgaaaaacattcagtttgtgaaaccgttggtggtcggtttgtaatttgtaaaatccatttctttttctttttgctagttttcatagtcatttggtttttgcaaaccattttcactttcagaacggtacagtaaatcctgactgcagcacaaacagtaatcattcgtgttttgtaatgatgccatggccgctacatgcatgcatgcatgtcgatccggtgctttaatgaaaaatccagtataatcatttctgcccggcctgacctgaaaacttcctaatataggcaggctcgtggtttccaatccgggagtctttcgtacaccatgcagtaaatacgtccgtacgtcgtcgtctactccacatcccttcatctgtccggcctgcatgcatgcctcgctgcgccgcagaggtcacctctggatcgagcaccctcctcctctggagcaaaccacgttcggtcatgtgggcattaattcccacacaatacacagtggaatcgtggaaacgcgcacatgatccgtgagactgtgatcgatccacgcatcatacactccagccggcgcggccgctcgatcgcccgctcctgccgtgcaacggtgcagggctgcagcctgcaggccacgcgctagctggcttacaccggccagcgcgagcgcgctgcaggctgcaggacgccgtgcgcgaccgcgagcgcgagcgggcgcgcgcgtccggggttaggaggacaccggggttctcgctctcggcaccgcaccgatggatggaggagtacgcgcgcgtcgtcgtggcctcctgggctcctggctggttaccgcggcggccgcgccgcggtgagcggggagggagtacgtacgtacgtacgtgcagcggtgcagcaggggggtgcgtgtgtgcatgcgcgcccacgcgcactctgtgtcatgtggcctgcaggacgccaggtcgtaccagactgcaccaatcacgcacggaattaaagctagccacggacacgtacgtacggcccccacaagctgatcaaaggaatcggtgaaaagagagaagacaagatgccgatcgatcgaccgggatacgcctgtcgatcgatcctgctcgctcccaggcgtgtgtggacgtgttgcaccttgcacgtactgttacgtttcttgggtcggtttcatctccagctccctaccgggcaattagatgcccagcctctttggaacgaaggaaactaaattaaacgggattaattgcttgattttttgttgcacattaattttcaatttgatggtctctagctctcgatcgatcttgggctgtgtgtctgtctcacgtttcttttgttaccgttctggctaaaattaaccaatgttgcccacctcggttgttaacaatcgacaaattaaagctcacggaaaggccatggactaagtgctgctccatcggtttgaaaaaggcacaacacactacgaccctggaccatcattaggcatgcgtaatgcgttagcatgcacaccacaccctggactagagcatcatccggcgatcgagaataacactggtcctatacaaaaattaagctttgattagtgttctcaacactaactaatctttagttagctagtactcctacaatactaggctaagctagcaccacgcacgcttgacgccgtacatgttgcgcatgcacatatatatttacatgcacatatgcgcatgcatgcactgtactgtgctgtgtacaatgtattcgttcgaattaaagggaccacgaaaacgctttgttcagtttaattgcttagttgtaccggcacatatattgtttttgagcctgctttgatcaaagggtaaatggagaataaaactgatcaaggaccacaccgaggtagctagcgtgccaaatttgttaatgcgtgagcgcagcgctggctctggcaagtagcaagtcaagtggcagctggccaggatgcgtcctttttaaccgcgtccctttcagcaattttaatagtatagctaactactcactctaaatcatctatagtcaatagttaattcatataatagttacctataacatatagtacacaatttaatacctggtcccacttgtcatacacatatgtattttgaagtccatgctgtagctagctataaatcagtagcccgctactattctctctcattttttatcttctcaaaatatgtttatagtatgctattatacctgctctcattgatcattgatccagctagctctaaatctacagggctcttacttttggagacgaaaaagagagttaacttttgcatgctttcaagattaccagcaggccatgcatgcacgcacaccaccacaagtgtatgcccatattcaggatcctgacgcaaaaggtcctcttcgaggaatttgatatttcgagaagctggtagtgagtaacaaagctaggaaaattttgaaaaaaaaacttaaattgtttagttgggttctagttataggagaagtggagctgaagctataacaatcaagccagtagtaccccacccatcctaaatcataaagagttttaggattgaagtaatcaggtaggtgaaattgaacgagagaagattgtgattggttgaaaagaaaaggtaggtggagaatttgaatagtggaagtgggtgaatgatagataaaagaatatgggtgaaaatttatcatatttgatatacactttatattgttgtattttgcaacgaatggaataattaactttttatggcttctatattccatcctcacttaccgtctcaattcttgtggctcaactttctttaagtactacttacagtactcgtagaacataagagaaggggtagtatacgtaacatattatccgcgtatgaattttgatgaggtaaagatgccaaaagaattaacataccgctgggtgggccatcttagagctctaggccggtcatgcgaccgcctagggcccaagcctatatggggcccatcacgaaccaacccagctagtaggatgttgttgcctatcctcacgtctgactcccatgtggtcacaccttatttcatcgtggttagtgtttagagtgagttttgtgatcttctcatttgcttaattatatttagtctgaaaattgggctaggattttgttttgttctcgttgattaatttacatcgtaagttaggtgtttataatgtttatttacatcattttcgacactatatgatttataacacgtatatattacaagtaaaaatatatttggtcttgagggcctattacaaggtctctattagggcctatagagagccggctctggttgacacgtacgacttgacatgagccaaacctacttgtgtacgggacgtcgaagccagagtacttgggtataaccctttgttccattaaaaaaaacactaataggagatgtgacacatccttgtactatgaatatggacaactttctattcggatttgtagtattaggatatgccatatcttgtgctaggtttgttttatatacatgttggaggagtaccatacctgcgccatcaacaatgtcactattcctatgcttcctgactttcagttattcattgagagcatgccacattagctcctgctagcaacggccaatggacgctacatgtagtactatagtcatacgaagaagagctgcagaggggcatggttcatgccttggggttgggttggggcaaaattcggaatcagatacataaatccacaggggaggcatgcatgccactcaccagctacagctagctatgtatagggcttataactagtgaggaccggagtacactcctagtctcctaccgttgcaactacagccttggcacacatcgtgttggtaccgtcaaattgcatcagcatatgcagagacatgcagcgatggagggcattccagaatgctggacttcacttccctggtggtcgttagcgcagagctcggtagatccgctgtggctggctagctagctaggcgcccatgcccgcgtgcatctctcatccatttctctgtacagggatgggtgcccgttactatatatttgcaacacattatagtgaaaaaccaaatactattggaacttttgaaacaaagtgaaaccaaataaattaaatttaagttttgaggggctaaaactaaaaccatgattaaactaaagtagaataatcattaccttccatgccagcccacgggcgtcgcgcccatatgataaactaaccttacgtaagacaacagtggttgtttctgagcgaacacttgatcaaatatccaatgatataagaactgaaatcttgctatctttttgcaatatatgcatttactgctatgtcatgttggggtctgtacgaaatgataataatttagagaacacctatgagttctatcctcttatggcaatatatttgttagtatctccattaattgtgtctgtgattgagcaacccgtgcattgggatggttattaggaatattgtaggagttctcttgccctatgggtcatggaggatgattctttcaggtgcttgaacaaataaagttaaagtacctagcatgccataaaagcgtgtcactacttacgattgaatataacctttaagtgcggatcattttaaagtcataccatgtagaagtaactaagataaaattgtcttcataaaactaaacgaggatgtgttcaaccatgattgagatgctttagctgatgggatagctgtcgataggacatgtcttcatcatttaggttaaagttaaaagtgtaacacgccatctcgtgaatcaattcaacccgaaataatagtgtaaaatatgaaagttaacacatcattttaccatgaaacattaacttcatcttttagactgtgaacaccctaggaatttttttttcaaaaagaaaaactgatgtgtactctcctcgaaaagaaaagtgcaaattaactttgacactatattgttgtacagccctcaaccgcaagggttagcttagccgcgcgatgtgggggcatgcatgtgctccgtgtcaagcccgtactggccctccccatattaatacccttctctcctggagagcaaccccaccaccctaattccccaatttgggagcaataccggcgcggctctgatgttaaccttagcttagctgggccgatcggtcgtccgccccagcagcacagccacactgtcacgactaattcccacgccagcctagcttgctcgcgcgcccacctcaattcgccgcaggtcagctagcgcgcggcgcggcttggtcatgcatggcgcgcagccaccacgccagacacccactaacccacctgaccaccgggatggaaaccctagccccgcgcccttcccggtcgagcttgctgctgctacttgctagtagctagctagctagtccaggtccaggctagcgcatgctaccttcgcagctggcccaccaccaccacctccggtgcacctccccctcctcgcgctctcgcctccccctgcctatataaatccactggccggtgggccggtccggtgtgcacgcctcagcttctcgaccgcgatccgtcgccgtgtggttggtgtacgttgcggtctcttcacgcgctcgcgcgcgcggcgaggtatgtgtgtgtccgcgggtttcatcgtgggggtgtgagctagctagctaggcgagcgtgagtgggtgtggaggatggcggtgtctccggccggcgggcgggcgggccggtggcgcgaggtgacagaagagagtgagcacacggccgggcgtgacggcaccggcgggcgtgccgtcgcggccgcgtgctcactgctctttctgtcatccggtgccggccgttttctccccctcccgcggctagctaagctggcctctcggcccctcgccggccggccggtcgccgacggaatcccctgtactgctccgcgcgccatgagctgttccgagtctctaggctctttagattaattcgatcccctcttctccggcgcaatcgtgcataggcgcagttgccaggttctagatctctcacaatcgaattgatgcatttctgcgatttttcgttcgtgttccagcgccgtgaggcggtgtgtatcctcggtttttctagtttgccaagctatttgtactcgactccttctaaaatctcggcgaaaaacatttcgttcgtgttcttttgggtaatccaactagaggagtagtactagcatggcactgttcggatggggaattggagtcggtgttgatgcctgtaccgtaggagtaccagcgcttgctgttgctgttttccatatctcctgcgtcaattcgtacgacgcccttctcttcatcttttgcgaggagcctagctactagttgtactagtacctgctagtactagccatcttttccattccccttcttgggaaggaaatgcaatatttactgcgccattgatggatcttggctcttgggagaagcaaatcatcgcaggaatctcccagggcatgtttgaaattttaaccagatcgagatcttttaacttgtttcaacttgttcctagcttcgatcttcttctgtagcgccccatccagtgttacagtcaaattaagcacacaagtgtggagagatcagctagctagatgatgaggatcggaggagaggaggaggaggaaggaggacaggcaggaacagtacggagacccagatctgcttgggcggcttccccttatcatcagtcagttatcttctgctgtctgctggtcctccatgttcttgagaattaacacctcacatctcgctctggcattcaaagtagggagtaatggtgcaacgatgcattgtcccccaatggctccaaaaatgtaggatactgttgggccactgttccattcatggtgctcgtacttaccaccctctctcggttcagagtccatatatatcccccactagtttgacttgagtttaatttgctgggctcctgtgacaagatcggaagaaactctccaggccacaagattcaagtctttgaaaaaaaaattaaggccacaggattaattgctcgatatatgtagtccatggacaaagctaagctatagcaaatgtacttgctgatacgagtcttgaaaatctgaatttatttttgagatattggaatattgtgagtatagaggccaagtggttcgacttaaatttttccttaattaaggtgaaatattgcctggatttttgttgtcctgataaagtgatttgatgtgcacgcgctagctggatgcagataacaatgaagtttggctaagagtcggtctactaatgacatagctagagaaggcatgcattaagtttacagtgcaactagtcatgcacggtgagataatacaccaaaaactagcaagtgtcaaatatgctagtagctggtttctctgctgaaatgggtgaggtctaagtgaatgcattgttttttttcacaaatttaaatgtatatatattgtgaaagtacctaagttagtatgcaatattgcatgcgataagtatagaatttatgtgccgatagttagcaattgatatttttaactgctcacttcaattcatgcatgtctaataggaatatctcagatagcatattgttctagctaggttccgtggcaatttcagttgttactggtccacttgaaagtctatgggtcgtagttaagtcacaccttatcgatgcaaagtacgatatctctcctctcttgttcatttttccactgcccataaatatcttgtttataagtatatatcaaagaatcagttactaacactggatcatggatcttacatgcatacctgctgctggtttttataagtcaagaactcgagcatgcacatgaaattgatcattcatgcataacctaattaaagtcttttcacaaacatgttaatgatcactttgctgcatctaattttattggagtactccatgcatgtctctatcttatgcatgccacattatctttttttttaatccaacaattatatatatatgactatctcttggattatcgatcccccctcgattccatggcattaattaacatcatgcacgaattttactttaattttggccacttactaattagttctagtaaattcttggtttatgaccggcatccttaatccatgcgtttgattaaaaaaatgggaggattagctaaacatatacgatcatgtttagaaaagcatataccatgaattaatttattcatctcatacttcttcccgtttcccatttgtaaataaaatatttaatgagaactaagaatttatccgttttaaatgtgtcacgcaaggattatttaaatgaagcataaggttaaataattaagtataatgcatcataaagtaattttaccaagttttatcattcactttaattgaggacatcatgaatataattgatgtaacattatcttatatactaatttaccattgtgttcgtgaaaactaaccaaggcatttcttacccttttttttcaattaatttggagtaaatccatgtgggaagaaaactctacaataaaagttcttttttcattttgtgttattttatgatattaaccaaatgtggtttatgtgcataaactgtccattgatttttcttaaggccaacagcacatttgaaaggtactaagtttatatatgggtggctaatatataatcagttttcccgcacatttgaaaggtacttatattcaattaactataagaatgtgtttggataatgggaaatgagaggtgggattgggattgggaaatgaatgaagggttaggattaagtggaagaggaagaatgaatggttaggatttaaagatgtcttttaatgggtgggaaatcatttccctatcccattagccaaacgaggcctaagctctttgaaattatcatcagtttccagctagctagttcttggcaaaaatcataagacaagaatttatctatatatatatatatcttggagataatgccgagttaattaaaactgcaaatatgtacacctgataaatttcatccacttgctgtgagtattgttttgtaggtacagagattttaactagtccgtccttaaaaaaaaaactatatatgtcaaaggtttaagtagggccgggaatcgattttgcactatactttagagcgtatatatgtacacgaaatggttgcatcttttgtgttctatttgtaacctgatcataaatcaattagttaagatgaaagaaagggagatattgttatcaacatgtggccttagctgatcgtctttgttttacttcatactcaaacatagttttgaatagatatgattgagtatggagtaaaatcttcgtttgagtatgtcaaatcttcgttctgatgatagttcctgttcaaccatatacttgtgaacaggaactatatatgtcaaatctattcaacaatatctattcaaaagctatacttttttgtttgagaattacacagtacaacgcacgcgcacccacccctatgaacacacgcacgcaaaccctacccctatgagcatcttcgaagactgggccggcaaattcctaccactgaaagcacaatgccattaaatcctgaaaaattcgcttccatgaggagtcgaacccaggaccttagatgctactgaggctcttgtaaccactaggctacacttgtgaactggaactatgtcaaatcttcgttctgatggctatgttcttccattttagttgattttgcagaatatatatgatcttggagaaaaacaaattgtcgtggacaatatatgttctagcaactcaattcgatcgcagattataaaggattgatgcatactacaagctagtcctttgtatatttttaagcacccatcatatttgttgcacatgactgaaattaagagtaattattagctatgttctgtcgttttaattgattgtgtagatgagaatatgatgtgtttccaaacaattgaatcaattctctccgcctaaataatacttgatgctacgagcccttttcttttgtattttaaagcaccgggatacatatcttccttacgatgcatatttaccatgcatgcatgcaacatatgtacttgccatggtgcatcgatgaatctgtatcacaccctctagctagctagctgctgatcaatgtctgaattgtcgctttatttgagattcttggagaaagcaatggctgcttcgacgtggtctatcgttttctcggtgatgccttttaataagatagtactcaatcaacatgctatcttttgatcaggctcaattaatttgcccaaaaaatctcttgaatccaagctaaatcaagatgctagttgttgcaacttgcaactgatggtttatcaaatcagaaaggttgatttgtgaatgcgtatatggttcgaatgaaatcttgctttcgcatgcaacgtatacactgacgtctgtctgaaaccatagcttgctctcgtctggtattctagatttcccaggctaattaatcaagtcgcgcgctgcaaccataacttgactactattcttcgcctggaaaaatttcacttgttctgatcaagtttatggagcaaaattaagtgtactgtaccgtaaatggacggagcagcacacgggctggcagcgatcggaactagcttgaaacgcaacgatggcaacggggaggtggaagggagcgatagatgctattgttcttcctcgtcgtcccctctgtttcgcggtgagttgagctcgcgattagtgttcagatagggtaggctcgtcgcgcgcgcgcggattctttgatgctctctttgacctttttctttttccggcgaccgcgccggcgccatcgcgcggttggattggtttggagcctgtagcattctgcacggtccgtggaccgctgggctgggctgggcgattctgttctgcgtggagcgtggagcgtggagctattctcttggctccggcgagctctccatgaccatggatgtgagtatatcctcctccgctgggttgctccttgatctcgtggccccacctgggtcgcgattacagttaatctgaacccgcctgacaattttcttcagccaatttttggggggcagttcgattcagacaacaggacttgctacaggatagcggtctgcagccgccattcttcctgatgatagtcgattgatccgtgagtcattcctgtgccccgattaagtttgtcatggaacacataagtctgctcaattttgaaagaaagaaaaatagaggaactgaaattttcatcatcagttcgttttgtcatctcatctaagttgtacaaaggcttctgtattttgctaggtagcactgctcatcagaagggagaattttgttctgcgacgaagaaattgcaatacccccagagtttaataaaatccgtgcatgattacatgattaatggaaaactgccatatttcttccacaaatcaattcaagcatcgttacattttaattcccacagaagaaggcttcacaacacgggatgctatcgcgctaaacactatacatgctagcaattcagagatctgataaaagcaagggtgaacttcacaatacatgctaacaattcaaagatctgacaaaagcgagggtgaacttcacatgccaactcagtactgcaggtttggaaacaagcatcacaaagaaagaatatacatcattacatgccgccgtttcatttgtcttgaaatgctaaagtctaaaatgtcctacgctacaacgtgacaagtaacaacgatcagaccacacctaaacgctacgataaacaaaatacacacatgcttatacatcatttgagcatttccccctattcgctatgaaatgctaagttcatctattgtacgtgcaatatcagcagctagtccattggttccattcatctgctgttccgtggcacgattgctactgtctgaattcgtttcgctcccaacagttgtgttagaaccagttgctgcagcagcgcattcagcaaaccggtagcaggagatcaagtggtcattggtcatgcctgaaacttgcataaacgtgtagacaactgttgggcctacgctacggaaccccctgcgaaccaaatctttgcttatcgcatccgctttagatgttttgacaggaacctggcggggatacctgaatctgctcaaaataggtttgttgttcacaaagctccaacaatacttatcaaacgttccaaactcctctacaatctgcaatgataagcacaatggattagataagccactgtgtagctcaggaatgtctttgggtaaccatcctacgtttttttgctttaagaaaagcatgatgaaaactgaatcggacactgaaacgccaaggtaaagccaaaaaactttgcttcgggatggggttaccaaattttatgaagactttacaggagataatgttatatcaggagggggttaccaaagaacttaaagcgtgatttgtatcattcttattccaagaaatgaactagagacctctttatgcaattaaaaggttcaagagtgtaaagggccaaccttgagtatttggcgtgcattttcaatgacaccacgcagtttttgttcagataacaaggtactgctaggacttccaggtgcaataatcttcttttcacttagtttagagaccaatacagggtcaaaatccatgaaaacctccctgtgagacatacttgaatatgttatttgggatttgccaacacctagtactacaggttcaagtacatcagaaatgcaaaatgttacctgaatataggtctcttgttcagaattgttggccatgtaagttcagccaatgcacctgagagcaccagcaactcaaacaacaccctgaaagtaatagagtaatttacacttgattcttttaccaaatggaagagtatcatatcaaggttgatgatattcacatacttgtcatcatgaactggaactccccattcttcgtcatgaaatgcagcataacagggttctgcacttgtaagcaatgagtgctcatgtgttaagatatgaaaatatatgctacataagatcagtttgataaacaaaatagagattacttggcataggtcctttagaaaatttgttattacccaagtccttagtaccaaaaaatatattcagtaaacaagaaaagatgaaaagaggaggacctgaccttgtctcgctcaagttcaatgtcagtcttataaattggcaagacagatgaaaaatgattccaccatcatgggcataatttcatcccgttttgttactaacacatgtttcttataaaactcacaagtttatgaattaatgcattcttgtgtttatgagagacatggatcggcctgcgtgcaggcactgtgaaatgcaaagatatgggtaatacccaaagatatggtcatttcaacagcaagcttcttagagttggtcaccacaaaatgttctcggctcccatccccaccccaccctagagaagatttattcaaccttaaaggtctgtatacaggattgcaacatgaaacaagatgactacagtgtgatgttacttctttgtgttcgcgaaaagtgatgttacttctttcacaagaatgacagattttacttagtataactccttgtgattgtagtggctagctacatgtctacacccgcaccatcataaaacatagtaatgtaaccacatacagaaaacatttctgtaacatttagaatcttgaagatcggggtctgcccagaagacagaatatgctctggccattttttacccagtgcatggtctttaggatctagcatttctaactcacaaatggtgggccttttgttctaaattttagtcctgatgaatcatatgattatatcctctctgcaacaaaaccatcgaacaaaaataactgtactagagacaatgcaggataaatttatgtcgacactggctgaaaaatgcaagcgaatcgggaacacgcaccagtattagctgtcacccatgaacacctcctcttcagaccaggcacatcattagcagaagccaatccaacctccctttccagcatggaaacaatcttgtgatcagtctgacagagagtcttcttcttcctagccccaaacgtcggcctcccaatccgccccgtggacgcccggctgcagaacgagtccgtggatgcgtccgacgagcacgacgcgtcgagcgacagccccgagcgcagcagcagctcctgcctgcgcatccctgccggcacactgagcgagggcagcaatgtgggcaccgcggcgggcttcttctcctccgccgccgccgccgccgcatccctcccaggcctcggcgacggcttccgtccccttgtagcggaaaccgaccgcgtcctgctccccgcagaccgcggctcagagtctccaccgccgccggaagccggcgagagccgccccctcgcgttagccccggacattgcggccacagctcccctccc

SEQ ID NO: 36534 - DNA, 17447 bp, Oryza sativa
gcccccccaaaaaaaagcctcccactctgagctgagctcgcggagacgagaccaagagcttaatcacaaaacctcgggggcatcatcagcgacgcacgacccagagatgtagcagagctgtagcaatggcgccgcggcgcgcgagccgagacgaaaccctaggcgaggtgaggggggaaggggaacgcgaggtgccgaggtggagtccaagcagcaacagcagccgcagctcaaaatttactgccgctggtattggtgggtggtgggagctcgctgttttttttttcttttttccctttctttagcggtagatttggttcagagaggcagagagtagttttggcctagcggtgtgcgcctgtttgtttcaactttggagagtttgaggtgagagaacggtggttgctgttctggcgcaataatatgcggatatgcaggtattgtttgtcaccagatattatatccaacctagttgctgtttctttacgtattaaattatagtggtttaaatatttatatttaatttcaaacaggaacaaaataaattattcaaatgttatcaaagtaattgcatatccagattcatggatttatgaaattaggaacactcaacacccaacaccgaaaaatcttatatttgaagttgtgccaaatagggcctaagccttctcaatgtatggtgagtgttaatataggtcttattgagtttaaaattctgagaagtagctgatgagagtatagaaaagttgggtgtaaattttcagcttctggttttgttctttttaaatacagctatatattttcataatcttagtaaaaatttggacttgtttttagggccaaggattatagaaaatgatgtagctgctagaaactaaaaaacacaagtgtgttaatatataggctgcgtaattaaccatctatataagaactctccactcgaatagaagtatccatatcttcatctagttccttaaatcaaagtagccaagagaagttttacagcacctgctacgtattggtgcttagttaatcattgatactttcaggattaaacgactccttcgggagcgtatgaattttacattatttttacaaaaaatccttcaaagttctcgtgaaattctttccaaaccgaatagaccctaaaatatctcatcctacatggcaagataaaatggttattttttatgaggacttccttaagcactttgcattagagatgggctagtatttcaacgcaatacaaaattagagatggagagtttttattagttcttccggggactttacaaataccttgtgaaagtcctgtaaaatttctgtgttccagacagggagcaagatttgtccggaaaaccggttaattggtgcatagtaaaacaatagcaacaccacattacataaacatagaaatttctgaggggcgcaataaaggacaggcttctgttaccacaccatgacttttggatcttggtagcaatcagacatccagtaatgactacagccaccacatgctggtcccagatgagagaagcatcagcaaaaaaatttggcacacattggtccagtactccagtggactccttgtattatcatgtagccggactataggagcctgctcatccagttgttttcttgtcatggatgcgcatgtgctaccaaacaggagtacagtgttactgcatgtctaccctgcacggcatcggcatccgccattgctgacgtgaagacaaggtcagagcaagtagggcaccagtaccacactaccactgaggaatacaccaacgcatacggctaaaacacatgcaagtacttccccgagagaacaacactgatccagtacgtttgtcttacagagcaacagtgtcacaacaacaaaagatgcgtgtgccagatgtacgaggctaccttatcggcagcgacgtatgcttgaaaagtataagctctcccatttgcagccgatgcaactccatcacgatatgatctacaggtatctttcattgaaacaaggagggaaaatgtatgtacaattgcgtgctggcaaagctgaaagacgataaatttccagtgcagcgtctgcacgctgcagtagaaaactgaaaagaggggggggggggggggggggaggaacagggaaatccattttacaaggggaaaaaccttctcttcttgaagtaccagatgaagcagcagaatatgactaagccgcatacgcctgtaatgacaagcgtccattcgaacgcatgtggtacattaaacaagtccacctcaaagttcatgccaaaaactcccgagacaactccgaagatggccaccacgaatgtagccgtggtcagcagcagttcaaattggatcagttggtttcggacgttgtcctgtaagaacaacatttgtgatgatcatgtgagcatattttcttgtccagatagagagtgaccaaacaggctaaaagaaatgaaaaacaactttcatttctcttacatactgaacctaatagcagttgcacactgctaatatcagcaatatgaaagtctgtgaaatcatatctctagccgagctactaaaccttgcagaaatatatgatagacatgatatctggggtaaatacatggtggaaacccatatctgtaatgatgttagtctaagataggaccttcggtttattcttaccaacaggccctttgtgcaaaagaaataccaccacagcagaatacgattgtgcatcctataataccaaccagaatattggtgaataaggggcatatgcaaacatgcatgttgtacagaaactgaccactggctgtcctctgtaatagggaaaaaatctggcctacagacatttgaagttatagtgaacagatgtagtgatacagaagatctttttgttgacattgaaaataagctaaccacatgctccaacagcctgtcaactgttgtaatcttctgacatctgacccaacttacaatctgtctactgtctcaccccagtcccaactttaagttaatctcagttagcatgttaatagattttcattagcttaaatggaactaatgttattgtgagcggattatactttatatttactaacttagtcttactgtattatcatgcatcctccaaaatgctagggagtaatcagcagtaacgttgtccaatattttttctttagtacaatctatcattcccatttggagacacctttttagataatatttggagacacttgtgaatgtatcttagtttgtcttgtgcctttttctagtcaactgtaacaactaaatgacgggttaaaagaagctatatatatgtcaaagtaaacatagtatgatggtcagataattgtactcctgattccaacaattatgcatttgccatatcagtttcaagaatacacaaggcaagaggcatacggtttactttgagtatagagaaattaaatagcagtttcagatgagaagcaagcactcgcagtattggataagaaacaagccaattctgttgtgagattggaaattgatctgctaccaaattaactatcaagtatgaagaagatatttggggactataccagttgtatgttgatgaaatcctctgtatcatcaatatactccttcagctgttggaatatatatatatatatatatatatatatatatatatatatatatatatatatatatatatatatatatatatatatatatatatatatataaacataaaatttattagcccatgtagttgtaaaaaataaacagaagggcataaaaagcgaggcttcgtaccgaagttaacttgctgagggtgtaatcaatgaccacgaaataagcctctaacaacatttcaagttcttctatgctgtactgactactgtctgcactcttgaagctgtcatgcctacttctggcaaaactcaattccttctcaagccttcgagaagcagggggtgaggaaactggcgaaactggagcagagaaagatgaaccaaatccactattgcccatcccctgaaacgcctgctcctctagcaatgatgcttccatcctcctcttcttctctgtgaggtacatttcagccatatcaccatcgtcgtccatcagctgctctatctcatctctgaccttaatgggggaaatagaccaattattgaaaaccaatttaatgtttgccaaaaacaaaactacattgacacagtccatttaccttttggacccttctagtcaatgcaaccagcttactctttaggcgccgcacacgttccaagttaagggtactgattttcgttgtcaattcatccagtaaaggataagcgtcagcctccaattcgacagcctgacaaatatgcaaatgtttttggttctccagttagataccgtatcattatgcacaaaagaacactattaaaagagcgtagcacaagacgatcactgcaggatttgccaattgatcagcaaatctgtgatgcattacttcattttgttcacattcaggttataggcaatcactcttgaaggcaaaggaacaactaagtatgagatcctgaaaaattagtagttgctacattcctgaacttttatcattggggtcagacactaccgtttagttgtatgcaacaatgtaagatcatatgaatacttagtatcgacataatgaacgttgtggacagtgatcttgcccactgcctgattcacatgtcaccttcctaccgctgtttaaacagagaatagctaaaataaaagctattgtttacatcatacagtgtcctggtaagtaaaaaaagatatcgtttagtggaatctactggtctaatagacattgcagatgcaaatgcttcactttatattaaatcataattgctagagcagtgcaattgttaatgaagtagtagtagcagacgccacgcaagtcaatacttctcaattgttaatgaaatcaataattcgcaagcaaaggtttccagataatacgcagtggcacctgtgcgtcgaggaacgagcaggcagcttcgagcgcgacctccagggcgatgaactcgaacggcagatcgtcggcgcggtccacgaggcggcgctgcagctcagcgacgtacctccgcacggcctcctccgtctcagctcctccccccgccacgtcggggtcgcgcaggatgagcgcctcgtcggcggtgatgatgcaccgtatccgctcgaggttgcagacgacggcgcgctcgcgcccgaggatcgcggaggggtagacgaagagcgggtcgaggaggcggaggtcgcgcgcgggcaggtcgagccgccgcatgagcgccggcttggcgacctccaccgcctccgacgcccccgtcgccgcgtccacgcgcacccacgaccgccgcccgccgccgcgcctcttcagcccgtggacgtcgatggccacgccgcccccgccgccgcccgccgcgggcgcggcgcggcggtggggcccattggccgccgccgccgccgcggcgcggggcggcaggaggagccgctccttgggatcgtggtccatggccgtcgaggtctgtggtggggcccggctgtcagcgtcgggaaggcggcgtgtgaggtgaggtgaggtgagtgcgcgtgcgaggaaaagggatctccgcgaacaatgccacgctgggaagtagcgtggtgcgtgggggtgacgtggcgaaccggatcggggtgaatcattgtgggatggattatttttttagtttacacctttttgaaagtttgtttacgaatagatccctaaaaaatattctagaatggatcttttcgcagctccaacttcattggcgctagtgttgttagcaaaaagaacctatttgaaaatattttataattaaaaataagtctttaaacacataagttctcagcagcaagccatccctttatgtaaatgatttagcttccacgagaaaattaaggggacactatcaatgtctgataccgtcatgttggacaacaatatcattaacgttgggaccgtggaaaaggtctattctcgaaataatttttttaatctatttataaaataagttttcagaagaaaagaaagggtgaacaatccagccggggagggcctagtggcgatttggggagttcgctgccgttggtaggccgaggcttcaggcccatcaagagagtattgggccacgagagaacttactaatggaaaaagtacaccgaaggtcccacaatttgtcatcgggatattaaaaacatcctcaaaccacaaacccagatatgcggggtcccttaaatatacaaaaccggtcacccgagatccttcagcggctttgaccccggttttggtctacggctgagttagcatgggacccacatgccagcgtgccacgccaacttttccctttcttttttttttctcttctttttttagttctctttgccgtgacggagtagcaacggacggcggcgagcggggctaagcggcggccggcggaggcagcgtgcaagcgcacggcgaccagcgaagcggcggtggtggcaggaggacgcgcgcacggcgccggcggatggggagcggcagcgtcctccatgtcgcgtgggcgagcggaccggcgacggcggcgagcgggagacggagccccgaaggcgcctcgccgccggtgagcctagccagccccagcacgtcctcgatgtcctccatctccatctccagctgcggtggcgcgtccaggccagttgtgggctggtggctagtagggttttttcgcttgcaactcctgcggctcgaacatcgcgcctactggagaagctagctcgaacatggcgcgccggagcgacggcatcagctcgccggctcgcaagccgtcgttgccacggtcgcgcatgtcgcgtgcacgctaatttgccttgctgctgctgctactagggcggcggcgagcggtgccaagcaagttggcatctccgtcgcgccggtgccgaaccgctggtggaaggcctcaacgcggcgctcgtcctcggcatacgaagacgagggcgaggacgccttcgcacgctgcggtccgccggccgccgcccgggcgtctgctccctacccgtcggccggcatgcgactgcgagagaagagtgtgagagagagagaggggggagaaagggagagaagaggggggaaaggagttacgtggcacgatgacatgtgggtcccacgcgccacgtaggccaatactgggttaaaaccaccaaaaaaaaaaaaaaagatctcgggtggccggttttgtatagttaaggcaccccgtatatttggttttgtggttcgaggatgcttttgtatcccgatgacaagttgagggacctttggtgtacttttttcccttactaatccatcatgagatgatgggccgacgcagcctctcgccgcggtggctccggcccagcccgcctgaaccctagaggggagcagctcagctcgcgtccgtcttataagtcgccgccccgcgaggccgctagggttttctcctcagccgtcgtctccctcctcgcttcgcgtccgccgccgccgtcccggagaggtaaggtaagcgtcccccgccgcaactaccaccacctccgcccccgccgtcctcgtgctcgtgttcgtcttagtcaagcgcatttctgtgctctgtagccgcgcgggatggagctcgcgtctctcccttaatctgagggcgaggctggatccgctacttgcgcgcgcttttcgtcgatttcttgtagtggatttcaggtcgttgctcatccagtagttggtgcttttcttctggagattcaatttaggatggcgtgttacacagtctagtacggtgaatctttagaactgtgggtgatgtttagggatgctggcgatattagtgtgctcgttatggttgatttgaacttgatgtagttgtttgttgactattaaggtggttttttttttgtgtgagttctgaatctgttgtcttggttagcttttggtggttgattggtttcacatcagaaattaccctgtttggattataatacaggatacattttgattaccacataggatgtatcgttgctgttagcctgttactagtactcttatacttactgaaatggtagggccgaacttttgcctgattgcttatttagatttacttggctaatgtgaaatgtgtgagcaagataccttttcctcctgaagtgtataacgactctactgtgaagcagttctatgcttagttaggtggctttctctttctatattagtaatgtattatgaaatagctgaattcgcaatggtgtattgtttagtttttctgtttcatacttctgatatcactgttctctttgtgtgcagttcaagaggcagccctgtgaagctccaatggctcctaaaggtacacagatgatattgctggatcatgtttacatgttcttttgatttcagaccatgtgcaaattgcttcatattggttgtttttaactatttctagttttgtacatcatattattatgtagtctcgcttgcactatataaggtcttagtactgaataagttcttttatgcatatttgtttaaaataagtattgaattgctaagcattgatgaatatggtccattggaaatgagtgtattcctgtagtcgggttgtataattagtctatgaatccatttctgcctggcttttttaacctcagcttggtgcttaattaagatgcatgaactgattgttttattttgtgtctagctgctcctgccaagaagggtgatgccaaggcccaagccttgaaggcagccaaggctgttaagtctgggacagccaagaagacgaccaagaagatccgcacatccgtgacatttcaccgccccaagaccttgaagaagtctagggaccccaagtacccaagagtcagtacccctgggaggaacaagcttgatcagtaccagatccttaagtatccccttaccactgaatccgcaatgaagaagatcgaagacaacaacactctggtcttcattgttgaccttaaggctgacaagaagaagatcaaggctgctgtcaagaagatgtacgacatccaggcaaagaaagtgaacactctgatcaggttagcactttccttcatacttcattttatcgcttgatttgctaggtagtgtagttaactgaccctacttgtcttccaggcctgatgggaagaagaaggcttacgtgaagctgacaccagactacgatgctctcgacgtggccaacaagattggcatcatctaagttagggtgctgcagtagtcttttgtgtcctggtctctatgtgattggagttttgtagctattacttagcgaatgcctcagtggctaagttatcactattttgctgcacacttccatgaatttgatataatgcaagtgacttatcgtgagctattatatgctttgcagttgatcacttgattgtaccgttgattgctttacgagccagctagtattttctttgcatgcccaaaattttgctttactatcccagtttttcaagttagtactataatgatctgatcaagcattcttacattatgatctggtaccttagcttggtttccatgttgctgtttgtgttaagagatcaattgttgacctcactatgtaactgacatgattcttgatttgttggtgaagctagaactacatctgtcaaggctttataatacagccacctgaaattacttgcacgtttgcgtggcggggccacaacgttgagattcgaaatggattgaggtgtcacggcagaaatgggagatgctactcctatctttcctttggcgttcggttcggccacacaacgccgacgtcctcgccggagtggccgcaccactcaccctaagccgccgcgcgctgagcggggaggacacgaatgaaacgcgatccgattcagagctagtctgttaaaccaagtagccattgatgagaaaatcgaaaatttctccttgccatgaactgaacagatcgttcagagtctaatttgcaaaattccggaccgctacccttgacagcggcatgctctgtaggggtcaattatgaatactttccccatcttttcagtcttccagtttgttcccttctctcccctgccccaactcaggacggccgcggagctccggcgatcccgcggcggcgaccggggatacagtcatacaggtagtaacaagtaacagaaacgagtcctcgccgacgatcctgaggagggccgtcacccgccagttcgccactgccggcaatacgagtcctggccctctctgcacgcagcggatagaacggagacaatagccggtcacgccactagttgcagcaacaatcaatctcctccaaaacaatctcctgatgacagagctagcagcactcggttcagaggatcccagaaatccaggttgcttccacaaggaccacaactaacatcatgcatggccgagattgaaacacgaaccaaaatctccctgctattctgaatgcagagcaactgagaatgcctacttgcacagcacagtgtattcaaagtgaacaaaatagcatggcatgcgttcatgtaggcttcatcagggaattcagatcaaagcatgaagagagatcataaaaagcagaagagatcataaaaggcagaatgaactactagtctgtaaaggcagcttggcattttaccaaaagagtaccactagtcaattaaagcattttcttccacgagactaaacaggatcagaaaggaatgtgcaacgaattcaagcgacccctcctccaggccaaatctccgtcgtcaatgcaccaagtacgacaagactagtcatcaatggaaagcaatcctacgaaggagtaaatccaaggttcacccccatctccgcatgagaaggatcgagatcaaagcgatatgcttttgctgtggcggctggggacggtgccggtactggtgctggaagtagccgccctcgcccccctgttgccctctgggtgcaggaaccgaaccagtatgacgctcatgttgtccgtcgatggtgggtctcgtgtaatggcctcctgaagaaggctctcgcagattaccgacagctccaccccctgtgttggtcacatcatacatatatgtcaaggcaaaaggaataacaacatataactgtaaatggacaaggtgcaaaacatggtgcacacgcttccatttttagactatacaaacggcaatccgacagaaaattatttaactaggccaggcaccatcccatttagaggatagtctgtgctaaatgtcagagctacattcagggcaagatatgctggacaaaattataattctcagtatgaagacatttctacaggcataatctgcacacggataaattttcctcatctggtagcaaggttactgttacagtgtatcactggagagggggcggggaatgtcactcacattgtttaagtgaaggcgtacaaaatcaaccacagcctggtttgccaagacatccctacaaaaccaaaaaaaatatgtaaatatagagcaaacagctgcaagttacattaattgtgtcaaagagtaatggtcaggcagggtgaaattcctatcaccactccatcaggtttcataaataatttcctcatccaggaacttcaagtttagtccttatgatataaattagatatattcgatggtcatttccatcgaactgaacaggtgaaactgaaattcatgccaccaagttaatagtcatctggacacaataaagcatccgaacccatatatagggaggtgcagacatttgacctctccaatgctatcatcacactaaactaacgaaaggaattagacccaccggttcaacaactgtacaaaatgactttatgtacatggtggtaaagtagcctagtcagtaaatcaaactgagctgaacaaaatctgcaaattttgtcggtaaatattttgaacaaacaaataagcgtacgagagagaattgtcatttggagttcctatattctgcaagaaatcatgaacatgggagaaaaatataagaactgtttctgatacttttagctgaggacttaccagactccatcacatgctataacaagaaactcggtatcatcagttaattggtcctgccagagacaaaaggggatcattttgcatcagctcatatccagtgggacaaacttaacttcaataacacaacgtagttatccttacagctcgaatttcaggagaacaagtcagcaattgttgttcaggacgcaactttttgttgttcttgtaagataaatcccctgtataaagaagaagaataccagttacaacacattaaattgtttgtgtatgacctcacaccgccaacaaacatataagctataccgattgctcttgatactgcaattccattattaacacggtgggaacccctagaaaaagatacggaacctcctgcagctactattctctgagtttcctccggaaaatttggtttgtgatcattggataaagcgattgccttcgaatacaacagaaataaacagaatagttaggtgacattagagtgcatcatccattatgaaaaaggaaataccagctaggcatttgaaaacaaaagtagtcactgcacctgaccattccttgagattacacaacgagcatcaccagcatttccaacaacgatctgcgtatttctaatgagaaccacacatgctgtacatccttctgctaatggtccacaatagacaggtccctggaaaacaaaaaccaacttgaagtaaataacaaaaatataaaaaccttagattctcgatctacagaacaattgagatattaccagcacacaaggagcacatctgagccaagaccgcccagctgttctccaatactcgttgccactaccatactcagttaattccttgcttgccgcctgatttctcaacatctcatccattctgcaacaattaaggaggaaaaaggattacatattttatatttggatgcacaacaggtgcaataatgaacaccaatgtggcgatggttgtttcttacattcttataaaaagaactcatgtggcatcaaaatatagagttaatggattaactagctgtaaaaacaacctgaaaaaggattgcctcaatgcattagcaaggttactgctaaaatcttcttgctccaaaaccttattgtgcaagtgatttgcgcaataccttgctacagcagaacctgaaatagaagttaaataattgagatactcatcttacataaccattgcgcaacattactcttgagtgcaatgaaggttgcatgtacatggatattataaattttactagcctagtcctccccccacattatgtactatgtagggtgagcatacttttcaagaagtcaaactttgtaggttttgaccaacaattagtcaaagtgctttctcgtcatattggttttgtagctatgaacaatatattatgtgagacatcaaagttgaaagtgtagctttaaagaagaatgagcatgcctaaagaaaatatgccctatacaatgagaagggagtatcccctcaatcagtacaataaatttgaattttgctgtttatatggggatgagattgaagatcaaacctccatggccatcataaacaccaaagaatgacgtgttagtgagagcatcaagattttcaatagtcgcatgctggagaatagaagagtacacaaattagcctttagaatttcaccaaaattagttgcaagccaaccccccatttctcctacaaaagactggaaggttactcacggcatcttccatggtgctacggtatccttgcatagctgatgaagcataagcaagtacagtgttccctccagaatgagtagactttgttatgtcaggaacttggaggggacgttgaggttgagccatagcggagtctgcttcgctgaaacataataataggaataaaatatccttaaattccatactaagatcaggttacagatcacctaaatactagaagtaacggtgaaaatacgaataggaattattggggcagaatgaatagaaaggttaactagcttgaatttgaactgcattttgcagaaacaaaaaatagatacgcggtatgccactgtttgcaaagctcaaagcataactccaatattttggacacatattgttgatgagcgagcaagcaaagatgactcatgactctaaagcagtccatacaaagcaattttttggtagacacaggtcccacggatgcattccaggatttttttttcttctttttatatcttgcatttataatcttcaagatacacaaatgccatcattttgaacccaagatctagcatgaaagttagacctaaggtgaactatgatgatacagtaaaaaatacatagaaatttagcacagcataatagtaaattttatcagtgcattccaacagagggaagtgaaaacaaacacaactgcatcatacaaaaagtagacaagattacaatcatcttgcaagaataaaccagacaatctgaagaatgaagaaattcactcgaggaagtataatcaaaacatatggtaacgactaatttagggaattgattaaaaggaagtataatcatagattctcgaatctagcattcaagaacaagaataaacgagggggagaaaactctgcggtcccaaatttcagttctactatggtctaaggatggatagatgtttaccaaaaacgaactgccgaacaatgtaacactgcagtagtgcacaacccccggaaactggcaacaaaatggaaaagtgttaatacgcttaataaacagaacgcgtcgatcttgcaggaaaaaaaataactcggtcagcaagaagggaatcctaatgaagatttggcatataaaaagcagaaaattaaaccaaataacaggtaaaaagcacgggcagagacatccagtttccgctcgcccaacaagaccagcaatcgcagcagaagcccaacgataggaaaggatgttacaagcctacacgttctaaaaccctaaacccacatgaagaaatggcgatctcgaacattccggaacagaaaatagtttcaaatggaaacaagcgagagatcgagacgaagcagccaccctcgtgttgccattgcgcatctgtgtagcaccgtaaaaaaaaaagaaaaaaagaaagagatgcatccaggaacagatggtgggaagaacaaaaaatcaccgagttaattccgagaagactcggatgcagcctcctccaagaaaaccaccgatcacgactgaaacagcagccaaaaaagcaacgataatgaacacgcgaacaccagaagatctaagaagggtaaaaatctcacgaactttttggagactgaagggcctaaaaaagagagacgaagctcttgcaccgtacaccgaagggatctagtagacgagaacgacaagaggacgcttcgatccgacggtggaacgagcaaaacccgtgggagttgcaaacacggaggcgaacggagatcaccatggaatcgcggtgctcgtccgcctccggcaacttcagttcatcccatccacgaaaaccaccaccagtagcagcaaaaccaacggcaccaaaacccgagaagaaaaccatcgtcagcatcagcaacagaaggtcagaagcacgcaagaacacacacgacgacaagaacggagcgggcttaccaaaccagtagcacgcacgcacgcaccccccaccgcacgatgacgagaaacaccagcagcgagcgagcgagcgatcgacgttaccaacaccagtagaacacagacgcgcggccgcaagagcgagcgagagagcgagatcaagcacagcgaaatcgaagcacgaagagaggcgatagatcgagaattcacaggttcccccgcgaggaagagaggcttctgatcggtggaagcaaacgaacaaaaattcagaggagagggagagatgggaggagagagagagagagagggagagggagagatctcctcacctttggccttagcgcaagcggtcgccttccatgcaactgagggggccttcacttatactacccgggcgtcaccaccaacaccaaccaccccccacgcctcgctcggctcggctcggctcggctcggaccagcaacggcttcggctccggctcggctcgcgcgcgtccggacaagccccccgcccgcgcctttcgcgaggggtttaacctgaccacattaggaagtttgttactggtaactacagaatccaatgcagcagtgcacgaacaaaatctcaagaaacaagaaggattcgtagggggttaagagcgaggtcaatatatagccaactactggctccaaaatatctatagccaatctaatagtctatttatacaatagttaactataaaaatatactgcaccattaatacacggtcccacctctcatacacacataacatcttaaagtccgtgttgcagccggctacaaatctgtagctcgcttttttatctctcttcttttttcttctcgatatatggttacagccggcttatagcatgctattgtacatactcttagaaagaatatgtgcatattcggtggtaggcgcaattaatagctaaaccccctggttaattgctaaaccccctggttagtctttcggtggtaggcgcaattaatagcttgatgacgtaactaagcatagaaagaataggagcatattcagatgggctttgtcacgttggcttgatgcacgtacgcatatctaagttcactgtagcctgcactgcacaacctagccttctttttcactgtgctagctgtacctcattccccatccaaggttaattttctccgtattttttaatttatttctggaggaatactctagaagcacgagaaaatatctcgagtttgtttttttctaagattattatttttggtgttaaatagactttcagcattttcacatttgagttgaataaatgagcaattatggcgattgatctcacttgaatctactagtagcaataacactaggaaacgtctagcaagaaggggtggcacacgcaaatgtatctgcaaaaattcccatcgagaagccggcgtaatcaggcaacgaatttaaataatgttgaaattttcctctcgagttcatctgaaatgcgatttggggagttatgatgtgctcaccgatttcacacttgaagcagcgcacgagggccgcagcacacgggtgcgtcggaggagcgcggggtatcagggagagcctccgaggccgcggccgcgggaggccagcgcgcaacggcgccgcccacggcggcccagcaccggcaatccgcagggttgaccgttgaggcagcatcccacgtccgccgccccgtcggcggcgcaccggacgaggaacgtttgaaatcgcggagagcggggcgcggacggcatggcggcggcggtggcgatgagaagccactaggct

SEQ ID NO: 36535 - DNA, 42067 bp, Oryza sativa
ggaggcggcgaaggaggacgaaaccccctgctcctcgggcttcgtgtcgcgaagttttgaacggcatggaggatgtgggggtcgccttgtcgtgtgtgtcccacatggcagtcgcagtaggcctacccccacccaaacactagaaacggaacggatgcttctccgctgtttttttcctctctttggaacaaaaggtcagagaacatgtagtatgcgtgtgagagagaggacatgaatcgccgccatgggcgaggcctgcaaataaacaagcctggatatccatggcaaggagtggttgcaacgaaaaacaccaggaatgcagctttgatggaagcaatcaagcaacgaatatcagtcaagatcacatatacgtttgatggaggcaatcaagcaacaaatatcagtcacgatcacatattcagttattcacatgcatttacttgcagttcataggcaatcaggctgttatagtcgtatcgtacattcgtactgtacaatgatgttcatctatcgacttgagctacaacaggcaataacttgacccaattcacttgtcatgtatttttggtaagaacaacactgccatgtagtttcacagaatacagcaccttttcttcattgttgattcctatcctaaacgaaaacaaaaaaacagctcattattggttgctcacatcgtcacacggctgtggtgatggccaaatatccttgcaagctaaggtacaagagaacgtggccagacaatttgctcaacaggagcaagagcatagcccccatgactcacttgaaggtattttacctgagaactctagctctacaacttctccctgacataacataagtagtctgcttacacctcgaagatcagcttcctgaacttctccatgtgctcagcctgcaatgagatggctatggataggctaccatccttgttcgcgcttgggaggacaaacgccagcccttcataggcgatgccaccaggacccatgaacactggtcttccccatccaaaatctgcatcatgaattggcaagcgcacccagctggtgagcccgaggttcggacaccggaaagtgtgtgctccacggaccaatgctgataaatcaggctgcagctccaggtagtccaatgctgagcggcagtagctatcgttcatcctatctagcgcctcttggatgactgctgctccatctgccagcccactggtcaccttgcctgcctcagcaagtggagtggcggtgaaaatgacattcccaaagtaaccttctggaagtggaggctgcaaccgttgtcgcccatcagtggcacaatacagcttagtgggctgttcagaaggcaggccacgtgcaagagatacgcatcgccagacatgtgcagcaagaactgcatatgtgctgaaacgtggtgcaccttctcctgatgggagctgcgaacgcagtcgaccaaggtctgagcgggtaagcttgaaaatgtccacagcagttggaggtggtgttgtcttattagcagtaacagactggggtacggaggacagcatggctggggcaggctggtactcaacatgtgggtatgatggagttggtggatctcgggctcgtaggagagtgcggtcaatgaagggcatgatggcaatttgagttcctcggcagaggtcagaccatgagttaataaagtgcaaaccggacatgccatccgccacatggtgttgcataccaactccaagggagacacctccgcacttgaagtaggtcacctggaacaaaataacaaaaccaaggagaatcagtgtcttgaaatgtttcacttactaagataaatataattcatattttcaactgcatataccattatagcaacattacaagtattgagatagatagtacatgaatgacacagatagaagttgcttacaccaataggcataaacattctggatgtcagaaattaactatgtactgacacaactcttcaaaaatctgcaagttatattgttgaactgaaactcagttccatactatactgggtactggatttctaattgaatttccaagacttaggatgcaagacataagcattgccaccaaaattgttgactgcaaccataaacatataaactcaaatttgtgcttctatacaaacttttgtcatgtaataatgcatacaaatgacaacatcctccatcaaattcccgatttctgattctaccataaaaaatgtgccatagaatctgccatcagccaaaaaaaaattttcaaacaagagtacaagtgatacaaaaactagcgcaagcatgtactatgccttatcattaattaacatgaaacatgcaggcatgcaattttataattaataaatgtgagccagaattgtttaaacctaatcacaaatacggacatagttcatgaggtaaacaatgtgtattgatgactaaatgaaattgcaagacaacatgatagtaataattggataatactatatgcatgcatattagattccgctttgttataggaacatgtgtgatctcccttactgataagtttggtcctttgactactgtcgtgcttactattaatggtagaccaaatacatatatggtagggggcattgaaagttggtctatgtcacatcagttaagtgttgaatcaccaatatggtatcatgttgatatagttttttttctagcataatcagctaaccaatgaggctacggataacaaaataaataaaactaacacaactaaaatcaaggccacgaaccagaagatgagatggcaaagtgattctagaatgaaaacagacatatgctgatgcatgaaatagctgaattgtccatggacatgaatgcatagcattgtgtgtttgacagtgactgctatggcatggtagaatttatggccactcaagaaatgttcgatgatgctttacatatgtgaattttaaaacatatgcacatgcaagatctgagtatatgtgctgcaagtgcatcaccgaatataatatcgcaaggacaggatcttagaggcttttactaggaagagccattaagacaggcaatacaccaagtttctgatgaacatagaaggaatcaactacagatgacaagagatgctccaattgtgcactagataaagagtaacataattttctctacaattttttggggttgggatgcatgatattcgcaggcctcagatccacattaacaaggtgttaggatccaacaattgacaagcactctaccaagcaatgcaaaagtacctttgccacagctgcaagacattttattggcaactaacagagaaggactacatgcaaatggcttgtctagctcaggatgcaacattccatggtcaacccaacccacaaaaaaaagaaggttgatgcatgcacaccacaattgaagtcagcttgccatctaaacaggtgttacaacaagttagcaacaactagagttgataaaagagaggaaatcaaggtttaaataacttctaaaattggaacaatatggcgcaaaacagtactatctattaacttattataagcaaaaacttgtcagatggaacatgctccagttaacactcagatccataccaaccaacatgcagtgcaccaagactactcagagtcatggttgctgacatatcagcgagtaaaaaaattgaatgaaactatggtttgtaaccttgtaaattttggcccagttttatgttatggaaagtgcatgcacaaattttcagttgcaaggaaaaagtattagcatgtgcctcaattattagaacaattttctaaataaaattttagctcctaaggtctactagacttacaagcaaataaattctttccattaacacgttgtgttgtacactgtaccatattatttcaaagtcaagtatgtctcacgtaagactaatgattcattcaacctaattgatttattgtacaagaattccagcatgaaagggcagctgatgatggataaccagaaggtgagcagatcagacatgtttcatttaggacaaaattgaacgtgcaacctgaatgatgtatccatcaaaggataaacagctcatgaggctctacaggacaagggctccagttatcgaacaggcaaaagaaagctattgtcagtcaaagactaactatcacaaaatgttaatatcacacccaattaagtcccctcctgtctacatcatggggcaaatggttgacattttggaacaatgagattgaccaatcaaccatatatgggagctatagaggccctagaagaaaacattagtgcctactaaaattgttcccatctaataacaagttttaatgcaatctaaccattacttctggcatcaaaacacttaaatatcagcagtaacatggaatgacatggaatgatcggcacttatgcttaagtgatcaaagcaatatatatagtcatcgccacaaagttttaagtattcaacaaaggctagcagggttaaacgtgcaaatccaatgttaaaaagctccaaatgggataagcttctcggttcaaatatctgtaggtcatgaatccataagtgtagtagttcaggacaggatatagggatataccggagcaaattaaagggctacttaataaagtatccttagtattagtttctcaagcttggcagggatgtacccgcacgaccggtggcttttgttgtctgttactcttaatgcacaaattgatgcacgctgctgccacttttagatggtataacatagaagacaatgtggagtccaacgtgaaaaacacatttcaaatctatatgatacaatcactctggacaaatcaaaattgtctaggctttgacacagtcaaggtgaagcatatacttcatttttttagtggatactgattattggcattgaattatggtgttttaaaattctataattcctacacaacccctactaaactatcacaataagcataaacatcaaaccaaaaatagaccccgcccacaacagaaagacatcaactgcctggatggaaccgtacatctgatgcagctaattaaagccaaccaaagagtaggtgacccgctaagctcagccccaaacatttagtgcaacagccaacatgggacctagctatacaatcagccccaaaatgttataattaatggcttactgccaaacttagttgtcagctgcagttgcaaagcattgtttgcgctccacttccagaaagctatctctaacctcgtttgattttgtgcttggatctaactgtacttgctactagaaatttggagctcacctggagcacgaggagcgagaaggaggagatgtcgtcggtgtaatcaacggcagggatgaggcgcttgagctccatggtgggcgcgaagtcgccgtagtcatcgacggaggcgtcgggcgcgtcggcctcgacgaagagcaccccttccccgttgcagtcgatctcgaccctcccgtcctcgtcgcgcgcgagccgcccggccatcgggtagaacggcacgagcgcctccgccagcgcgcgccgcatccgctccccgtcgaagaacccctccggcgcgccccctccctcggggccccggcggtagaagtagacgcttggggtgtggaaccgcggcaccacgaggtcgaggttcgagttccacagccgcacccgcggcgtctcccacgccggccgcaccatcgtcgaccgcctcaccgtgatcgccatcttcccctgccaccgccgccgccgccgcccacgcataccaccaaacacctcgtgagcatcccaatcccctcacacacgaaaacaaaaaaaaaacaaaaaacaaaaacgccaagcaccactcaccagaccaacctagaacgaatcagatctgaggcggatgaagaccaaagcgaggcgcggcacaaagcaacgggttgcggggtaggggggcggagcagctcttggtggagagcagctggtgggctcgttgggggtggagcggcttttataggcgacgggcggcggcggcgtgcgggggcggtagagctgagctccgagctcgcgtaggcgtagctccccatcatgtgtcatgagctgcccagctcactctggttttctctctactttttttttttttgcggctttcccccgtcggttcttcctatttttcgggttttcttccaccccgtgtggcgtcgttcgttggagaaggcgacgggtgggggccgcgtggggcgaggggggtggttggtgggatggcgaccgcaagcgatgggctcggagtcggacagtcagggatggatgggggtggactggtggagtttggtgggtggacacggttcaccccacccgaccctggacgtttttcgtgtggggacgttgcggtcgagtgtttatcagatcgttctcgtcgtgtcgtgccgagactctccgactctcaggtcggcaagaagcggggtttagcgtcacctcacctagcttcgccaaattgtttgggacgacgttacaggcttacagcgtggtataccgtatttttaaaaagttgaaaagattaccgtacgtgataaccactataacgtacgataatcatacggttttgttaaccttgacaagaagagctgttcgggttacggtggaggagaggacaaggaattataactcgggttgattgaagactgtgactaccaaactaatttaggatgacaaaatgggtcaaataaacacactttcaatcggtggccaaaaatattgtaaggaattaaaatagcaataattattgttcttcttttctttagtagatgattagtgtactatatgacataaagatggctcagtaaatgttggctattaagattatgtactaacatattccgtcattccatgattataatgatatatttatgatggtactacatgttgttaagggattgggttcatttatagtttgatttattacaaggataagaaggagcaatggtttttctatctctgtctaaattcacggtaataaaataggttatatctcgagtattttttatgaccaattaaacgtcctttggttacaagtcaaaatagaaaccattgctccttaatttcgatccttgtaaattataaatcaagctactatatttgtttttttaaaacaaatggagtattttttttgagtagctaattaaacgccctctaattacaagccaaaatagaaacgattgctcctaatatttcgtaatactacaaagttatatatcacgtactatatttgtttttacggaacggagggagtaagacacaatattaattggaatgcgtatgactggagaatgttaggcaagactaatcttacatatactcctaaatgagaaaagagtggctgccaaccttgtcaactgacaacagtatgatctatatcctcggtctattgaggagataactttgtgtataatctattgatgagttatgtgagcgatgaaagtagctaactatatttgctgactatagcagctgcttgactactgtattttttaggaaataaaattgttaggtttttccgtttttgcgttcaatatattgatttgaaaggtaagaagtattcatatggtcaagaatgtacacaaacttttatatgcacacgcacaattcaacatgtatatacttggaataagaaacctcttggtgcatatatgtagtcaaatagttctgaattataatgtttagaaaatgacaaattttacgtttgagaaaatatttgtaggtactaaaattttacacacaaattttagaatctcgaggtacttatctagaggtaataagttttatacgaaaaatatgatatatatctctcagcatttgattatggtttttgttctttataaatgattggatatatggataattaatgcttataaggattaattaaatattacatattataaacataaaagtattttagaacaagttatctaagcaatattatattaatgcagaatatatatagaaaaatcataatttaaagtttgtggcaggaataatccataaatttataagctggagcctatgacggcgagtaacttcgagagcaaccagaatatttcatccaagaatccttgttttcgtgtgaagtacgaagaagaaaagaaatgcgatgcattcttttagataatggaatagaatgtaatgtatttacacagcacttgcatgataatccttatgcaatgtattagcaaaagtaaaccaaattcaccatagtttcacatagaggcgatctggtctagaagcttctattgacctaaccaagtgataggggaaagctgaaatttgttgttggacttgcccatcatcgtgttacatttgcggagatttatttaaggtaaaggcatgtcttttccatcatatctgacataaaaacggagttgcacattgcaaggactctcacttggaagagtgagaacaactacgacaaagacatcaacacatatagttttgacgtcgtcatgttttggagatatatacactgagctctaaagttgattattactagtccgatcctaaagtaaagctgctttatagacagggagatagggaaaaaaaattataactgcaccctgaatgtcgttcttcaggcctcaatcacttggattgagtttaaccaaagtacttatattttagttgtttcaactaggggaaaccataacccaaatagatatgccttttcagctcacaccctatttatcattcccctgtccttcataagagcaagtataatagtgagctataaacctactataagcttatatggaggagagatataacaaaaagttaagggtgttggctctcatgcaagagctagcttaacacaagcttcaagacaaatacaattaataatatataagtgagacatatcgagatgagaagaaaattgtagccaaacttatagctaatttattatacgtgttggctttaagattagctaatagtaggaagtgagctctattattatccttgctctaattaagttgggtaagatggagttataaagtgagtttagattcgtatactcttcattaaccgttagcatgttttccaaactagtactaattaagtggtgtgttttttaaaatagtttcttagaaaaaactaaaaatttataataattaatactcaattaattaagtttataataataaatggtttgtcttgttttacgtatcacgaaaaatcccagtcaaacatcacattcgaacgcacctaacattgctgacactttgtgacgacggatgttgtatcactctaatgagttttgactttagttaatctccttcgaacttatatttaagagatcttaattagcatgccctatccgttctaaactataagtatttataggacgcaaaatttgtgtattaccatatgaacagctatggagcactgatttcaatatacgaaaatttaatttatacatttttggctaatcaatttgagatgtttggaaagagaatataagtgatttaaaatttgaccactgatcaaagtgactaaaagataatcgtctcttccctttaccatggtttttgcttaacaacttggaaattctaatattgtggaacgtgaggcagtaagtagtattgtagtagtcacttgtatgtttcattaatttattggattttgatagttaagttaattcatcaaaccttgtgttagaatatgtttatccgaattcaaactagacctaaacttacatgggtattcgccggcctttaatctctttagctagacttgtgctaggatatgtacaactatatatatagatggatgtgtgagtgtgtggtgtgcgcgtgctagtgtgtctggcttgtatactcgagaaaaaaaatataattgcagttgccagatggatatacataaatgaacgcacttcatttcaacgtttttaattttctcgtttgtttgatgggtggatatataattaatcggatatgattacaatacatgtaatgaaactacgtacaatatatgtcattattgtttttttttgaatgaacggtattaatcaatggcgaaccgtccctcagctttcttgaaaggaaaaaggacaaagtcatggtgacaactgacaagcatgcgctccactatcatcctggtaaccaggttacaccgccaccgatctgtatgttttgtagtggacttcggtcgtttgacggcgtgtcactgcagctgcacgttgctttccgatggatattacatctgtcgagcaattaattaaatataagtaatccgatggccacgatcaggtcatgatgagctgatgctgagtagtagtactacaccgagatttgacgccgtggtgtgcccgctggggctggcgtacgtgcctccacgttatccagcgcggtaacaagcggtgattctacgtgtgtcccaatcgaccggggtggttggggttggggttgccgggtggttcggcggatatcagcgtcgtcatcgtcgttgtcgttgggtcagtgaactagtacacggttgctgctcaatgcaaacgtctttggagtatagatttttcaatttatctggaaactaattgaacgaacaagcgtgggggttagctttgtcacgagaaaacgaagttccgatcctatctagtaactgtagccgctagtagttgctcgtacgtacgccaaatcgaagtctgtgcttcgcacggcaactcttggcgttgcattgctgaaatgttggtgcgatctaccgcgcttcagtataagctgcacgctcacccgcagtcaagaggcagcttcgacgatcgatgccatcgtcatcacccgtgatcttggcgcacgcctccgcacgcgcgcgacatttcaagccgagagacagtaccggaaaggtaataatagaatatagcaggtggtaatgatcaattggtgtctatatagtcgatcgcggatcgcgagcttaatcaatagcggcatttaattatcacatatatttaagagttcatatcatagataataatattataaaacaataacaaaataactgataaacaaattagtgatagatcaatacacgtataagctatgagaatactagatatttagtagcactcgaagagttgatgtcttgtttcaacttaaatcaaattaaacaacaaacataatatcctacttattagatgttaagattcacaagaatacaaagttttgggagacaaaacactaacaaactcgttatttgttatgggttcgtggttatataaaataggctcaggatatggtgatccgctaaattgaattgtatccgctatctgttaagtctaaatagcggacgttaagtttcaagatactacattaaaactgttacatcgtagcggtagcggtaggtagtgttcgctatgaacgttcacctctcgttccaaaatatacaagattttaaatatatgtgatacatgttctatgaatttaaacaggaaagaggagggagtaatcccttcgtccgtgaatgtaaaggaatttttctccatcaatttcatcccaaaatataaggagttttaggatttcttagtactacgatattctccacctaccaacttttatactaatttatttctctattatctacttttatattaaagctgtgtctagttccacaccaaaattagaagtttgactaaaattaaaagtttgaagaaaaaagttggaagtttatgtgtgaaggaaaattttgatcgatgtgatggaaaaattgaaagtttgaagaaaaaattggaaactaaaccatgcctaatttattcttccacctactaacttttatactattttattcgttcacccacacattttgtctcatcacatgttcttttattacttcctccgttctacaatatttgtctttatagcattcaaaagttatctcaaaataattgtcactttgaaatactactcgccacatcaactgtcaacgggtatacccgtagaccgaataaatagggtattaggatatgttggtacgatgatttacacggttcgacatcaaacaaacaaaggaggcgcgcgtgcgcggactcaattcgtgccgcgcagtctcgcacggccggcgtagtcggtcgtcgaaggacaaggaagttgtgcgacgtggcgacgacgacgacgcgcgcgcgttgatcgctatagcagactacctgactctgtcttctgaggagtagtaacgggcaatagtcgcactcgcttctcctcagttattttgcctggacgtgaaggctgaagagaagaattgccaatggtaattgacatgtacacaaaacgtttagaccaattgcttttaaaatgctgctcttcacatacggttaagcaattgcccctgagctatactgtatctaagaattagaaaacctactatgaaacatataaatatataatggaaccttaaaattttaaaagtacagcctagaacaagaactagaaaagactgcagcgacgacttgaactttgtacgttcatgcccagtgatgctcgacatcgtaagttaaataaaaaggaaggatcaatagaaacaaaacataatgacacttctgttctaacctgtgcaatcaatttttttccgtattagtttgtcctattaatttgtaacataccaaaaattagctattttctaattttgcatcatgccgggtcttatattcttaataacctctttaaacttaggaaaatataattagtgagacctcctaaagctaacctgcataaaaatccccctttgatattcaaaagcctttgtgattctcatttaaaattttatctcgaaatattccttgatttggtttttatctaaaactttctttcgactaaaatttcttctatttaaaaccctttcgaattatggtccaagaaaatcttccaaaccaaatcctttccacttccaattttattggaattaattgttatcccatcctttgatcttaaacccatcctttgattcttgatccaaatatctaaattccaccaatttaatttctgtagcttgattttcttctcggcacacgaataatattattacaaatattgtgagtaattgctcttgtgctaagagaatagactttatccctccgtcccaaatccaaaacctcatttagcccatatctaattctctaaatttcataccacatattttgggctaaaattctatttactctactccctacatattccctccacatactcaaaaatattcaaatctagagaaatattatttatggtgttgaatattttgaatttctatttgagtgcattaaataaactccctctccaaaatattgcactcaaaccaactagagaaatatttcttttggaaattatattaaaatataatttccttctaaactctctctcagtcaattttccttcaaattcaaattattcaaatcctttttcaaaatctagccatccaaattcctctaaatctattatttgaatctctaggaaaattagacttcctcctttttaactttgggccgaattcttcttctccctcgcgcggcccaagtcggcccatagctgagccgcccctcctcctcccgcaagcgcgcgtgccgtgcacgcgcacgccgccgccaagccttccgtcgccgctaagaaactaaagccggccgccgttgtccttccttgcacgccactgccgtcgtcgtgaccctcttgccctcctcctccaaaccgacctccccctcctataaataaaccggcaacaccccttccttttcccaaatcaaaccgagctttctctctcctcccatgccgaccaccaccttgccactggccgatctcctcttccacagctctacaagccaagcccttgcgccatcgtgtttgcctcgacgaggtgaactcatttttccccttttcccctatcttttagccaccacagcaagccaccaccgccactccttttattgctatggtcaagctcctgccgtcgccgttccggcctcctccctctccctctccgccagctactgccttccccggatacgcgacgctcgggaacacgcgtggcctccgacgtcgccgccctccagccaccggagcgccgccaccccgctccccttctcctctctcttctctcggctctctctggaacagagaagaggaagacgagaagaaggaagaagaaggagaaaagaaaaagaaaaataagataagatactgacaggtgggcccccgcacagtaacttttcatattttctagatttaattcaaatcccaatctttagaagcccatatctcctaaaccgtagatccgattccgatgaaacttggacctaaattcatctaaattcaaaccctaccttttgacaccaaatttgctattttaatatttcatttgaatttccttaatttattcaaataccatttgaataaatatttgatataatcttataattgaatttacaatttaaacttatatttgcttttcgaatatttccgtttatttccaaaataccctttagccactaaaaagccaccagttggaactttacgctttccatggggacgctcgcggtttactatccccgacgtcgaaccgttggttgtaaagcccggcaaaacctaaacctaaggtcgaagtgctgctcctggcaccccacgcctcgatgcgtacagcagtcggagcttcactattctctcgacctccacagcacgccgcacagttagctctcagactctgtgtgatcctagccgctccgccgccactcacggttgtcggagtaacacatccgccccactaaacctacacaaacttcctatccctctagccgttatattgtctgttgacatcggctagacaccaaacctagtcgtcatactacccaattctaatgacgactagcaaacacccaaatctcagccgatattcatcctacctcgatattggcttaatcaaatgaaaccctagccagcctgctatccaaactccataccagctatttaccctccaactacccatagtttaaacatgaaatacgagccgatatgttatcccatttcagcatcgaaaccctagccactattcaaccaaagcccacacatgagatataagcgacatcagttgcttgatcccctctccaacctagcctccaactccttagagcctgcgcataaaatactagctcaataacccattaaggagatagctatacccctcaaacctagcctttctcaccttcattgctttcttgttgttttatggcttttattgaatttggttcttcctcttctttaatagagtctattttattctggatggcaacctgtagtatttcgagcatcggataatcaggttgcctatcttggatttatttgcgttggagcaaggcaagttattattcctctcctttgagcataattatcctatactctatagctttattctaagcattagccattcatgattttgaattcataacttgaacatatagcaaactagatatatgctagattttgcttagccctgcctagttagactgcataaaaatataatgaacttagattgggacagtacgcatgaattagttgatttccgggtggctagtactgtctctatcgatataattgccaccaaatacttatgtcaaacgaacgagtatgaccgcagcttttagaatagggacagacctagttattaggttaattaacaatgtggtacctctgtacagtggttcttatctaagtcctcgcgaaggaggcaaacttatgccgcgaagggcaaatgtgatatttaccgaggcgcaggtaaatatcttgattatattgcgatcgctgtgtgtgtatattgtaaaaacctggttgagatgacgtggggtctctcatccagttctctctaaaaacctcgggaacgcaagaactcctctcgctgctgataacgttacgttcagagcgcatggggactagagttcatggaacaggtgccactattgttaataacctaaggctgggctacgactaagctaatgaaaattggcaagtagagtattcaacatcgagtacgactaacctaaggctgggctacgactaacctaaggctgggctacgactacgagtaaagcgtacatctactgcagtagagtattcatgaaactattcgaatagccgtgctcacggaattgagtatcgggactcatatgatatttggttagaaacttaactcaagattttactaaatactgttgcataaagacataccaggctttcttcctctttattctcagctttctgccagtaaacctagatctacttaaatactatttcatgcattcattatttgatataatagcttgctgagtacgttgtactcatccttgcttcaacatcctttttcagaattattttggagttcttgttgatgatgggagttcaatcacacaagttaattcccttttaacttagtcttcaagtctaggtaatttaaatggtttaagtctatagtaaaacagcagagttaggtcattctaaagcttctgctgtaatagttagccacaatcttgtaaataccctattactttatgtaataatatctccttcaaagctatgtctaaatgtatgcaaagacgatacagattattgaacttgtatcaatctactgatccagagcttgatacaattttaatatgttggttaccgaatcattagttttggaacccgacataattagtagtcaatattacagtcctgtctaaaaatgcattttgaaaatttggtctactacacatgagggcacgtaaaaattggtctctgaaaattaacctatccatatccatatgtggacaatcatttctgaagacaggtgtgctgcacatgagggtactgacgtacaaaatggttttttacagtacccttccgtcttgcttggaatccataaagaacgggaattaaaccgatctcttcgagtagaggtccaggataaagttcggagatgttacgttctaacgtccaaataagtcgtgacaaaataagtgtatcttttttcattcctttttcgataacagaaggacaaactatttcatcatttcataattcatagttaagctgacaccgagaagccaccggtcggccggtaccacgtccaggtggcttctgctctctgtctccattcaactatgagctcgatcgtgccatcgtcgcgcagccgtcgcgcaggtccaaattaaaccgatgtttcacttcattactattttaaccctatcatttttatgttactttacaaaataaaatatattttacaatctctaattaacttactaaactttggaatttaaaagttttctctcacaaaaacaaatacaagactttagaagggtttcaaactaacatatctaacgttaccaaactttcgatagaaccaaaacataccaaattttaataacatcaaatattagtcagattgatttcgataataaaataaactagccccaaatcagacaccgccggcccgtacctccacacagaagatcgatcgatcggctgccacggtatcttaccgttattaccagctcagctagcaataagagttctggtcgagagacaatatgcatcgatccaccaggcagatgctggagaagaaggcccggcaggtcggcacggcagcctgccccgccgcgacccgcgtgagtcgtgacgatcaggagcgcgcccttgcgcacccgttggcatgctatgtcgttccgtgcgctccgcccgaacgcagcaccgctccgctccgggcgcgcttccgtcatccgccgaggcacccgctcaccaccaacgggcaacgggccgcacggcgagagcgagtgatcgtgtacgcccgcgcgtcctcttttggaataagttcacttcatgcccctcaactgtgatcgaaatttaatccatgaccctaaactacaaaaccggatatttcgacccccaaactcctaaaactggtgtaatttgactccctcgactgttttggagaatggttttgttgacgtggcgcctacgtggcgatattgaccgaatcttcattccatgtggtgttgacgtggcacttaagtgacattagaatttaaaaatatgtgtgggacacatttatcattcaaaaaagtaatgtggacccactgacatgtggggtcctcttccttcttcctcctccctctctcccttctctccctttctctccccttcttccccaacggcgggcggcgggcagcgagaacgagcacgcgtcgtcagtggatgggcgccgcgagcgccggcagcacggccgcagcgcgccttggagccgctcgaggggccgcctggtggcctcccgccgcatcagctcggcgagctcgagctcccgcagcaggccgccgacgagctccacgtgctgccccagccgccggcactcgtatcttaggtggagttgacaaatcttcttgatgctgtccaagaaacagagacaaagataatagagatgtcagcacttaatcatctcatgtcaactgtcaacacatgttctacaacaagctcagcagatccagtatttatatgaccaggtagaaagtctatttaagccggtacaccatatctgttatttgtttcttgtagattgtcttcttatgtgaacatacatgtagatattcgtggaaaaaatataaatggcgctcttctcaggcagttgaaactacaaacgagcatgggaaagctgcgacggcggggagaggtgtcagggtggcggcggctgcgacgcctcggaaggaggagtatggcagcggcgggggcggctgcacggctcgccgttcctgccctcgcccatcctgtcgtcgccgctcgttctcgccgcctgccgccggctgaaggggaaaaagggagagaaagagagagaagggagagagggaggaggaagaatgaagaggattgacatgtgggccccacatgtcagtggcccatatttctttatgtgtgaatgactaatgggtcccacacatattttttaattctaatgccacctaagtgccacgtcaacgccacgtggaacgaagactcggtcaatatcaccatgtaggcgccacgtgacgccatgtcagcaaaactgcccttcaaaaccacctagggagtcaaattgcaccggttttaggagtttgggggtcgagatatccggttttgtggtttagggtcatggattagatttcgatcacagttgagggtcacgaagtgaacttattcctcctctttttacttgcgtcgctgcacaccgcatgtatcaagcaggggcgatgagttatccatgatcaagccccggcaacccaacacatactgggctcacttcaaactacatacgctgaacggctgaagatatatctctgtgggcttttttcgccctagtccacgggacgtggccaagttggcacgtgggctagatccgcacgtgaatttttcacattttggtccttttgaaaaacttatttcgcaaatagactcttggaaaaacttatctcagaaatggttctttttggggcgctagagtggctggcgccgtcatccaacaggacggcgccagcctctctggcgccctacacagagccattgtggcggggcgatgctgaggtgactagggggagcacgccagagtggctggcgcccccccccgaatttttttatttttcttttatttttttgatatttttttcacgcttagggacacataagaacccaccatagaaaaaatgaactcaaatggacgtaatatgtgacctgtagaatttttcctctcctctcctctctctccgaactagtgcagaggagagatgtgtaacttttttatttttattttatttttttgatatttttttcacacttaggaaatcacaagaaccaaccatataaaaaataaactcaaacggacaaaatatgtggcatgtggaattttccaaagctctaccgagaaacttctctcctcgaaaatacaatcttgcaagcggaatttagaggttttaatatcgccgaacccagcaaagcaggggagaatcggatgtaacattttctgtagatgtccgtggatatattatttgcctgattccgagtccgtatgagaaagttacgcctattttaataaatgacatattttgtccgtttcgatagagttttggaaaattctacaagtaacatattttgtccgtttgagtttattttttatatatggttggttcctatgttctcctaagtgtgaaaaaatatcaaaaaaatgaaataaaaatcaaaaaaatgcatctctctgtactgttaacttatggctattatttcatgtggttatattttgaattagattaagtaatttcatatagtgatagagtgcattatttataacatgctgatcaaagggttttactaaaggagttatggtctaattttagtgaaggtgcaaagtagactaagtggtatgctagctattttcagacttagctaagtggtagttcgagtttaaatttggttgtatcgtgatcctaagtgtgaaaaaacatccgaaaaaataaaacaaaaatgacaccgttgtaactctatacagagaaacaggaatggaggtgaggggttgggggggggggggcggcgccagccgtgctggcgccctcctccctcgggcggcgccagcacctcctgccacgtcggttcgcgtgtgccacggtggcaggaggacggcgccagagaggctggcgctgtcccgtactctggcgccccaaaaaggaccatttctgggataagttttttcaggggtctatttacgaaataagtttttcaaaaggaccaaaatatgaaaaatccagagatccgcacctggttcatatgtataattggaaaagtaaaatcattattttactctcccgaactatttcgctagagcatttataattccctaaacaagttatcggctcatttttacatcccaaactatttaaaatagttcaccttacctcgtaaaggtatttttctttgtctatatatgtcatattttacattgaaattttgcagtattgatagatgtattataactcagctctcaacatttcttagatgttttctacattgtttacatagggtggaagcaccgagattgatttaaatatctaggttttaaatttcaagtcaatagttgtgaaattttttaaaaatatttcggaactttgacaatagtgtcatctatggctcaaattcctagcttaaattacaactcatataaagaggaaaaaatatataaatgatattaaaaagtaaagctgaatatttttagtagttttcagtgtaaactaataaaaataagtatagggtgcttaactgatccaatgaaatagtttagggaagtaaatgaacttttttgcataattaacatcactccgatccttccctcgcggctgaactttctaacatgaacacgtattagttaggtatgtccaatgcgtgaaaattcgcatggtgcgagcatgttctgtgcagcacatgtttctatgtaaataaagtttctataaactacaaaacttcaacattgaaagttaaaaacgaatcgggatgagacaagctcatgggcgtggtttaaaatctcatctcaagaaaagtctacaagtttttgcactgaaagttagagcgaagtctgattatgatacctataaatatcatatatatagtttgtactacatcgaaattggacattcacgcggggactttaatccggataggaattggacattcacgcgcgctcgctcgcacagtagtcttttctaaagtatttctaaataaactaattaaagagagcagtaggaatgacaagcaaaagttgaggactttggctacaaacataatttggcaagaatgcattagtactacacatttatgagtgacaaaaggaagcaaaaaaaacattaattggatgtgaactggctcgcgatcaccgatggtatgtgtgttatctactagtactcgaccgtttcatgccaccccatgcttcccagccggcttaactttttgcctttaccggcttacgctcgcttacaacaatgaactaacccccctctggtcccgtttcacacacgatcgagcaactccgatccagatcccgctcctttatatatcgaggaggagggctctagcgaggagctcatgcattccccatcgctcttgctgatcctgtgcgccgccgtagctagcttcctgatcttcttgtgtggcggggacggcggcgccgcagccgcagccggaggcccgcgtagcgtcaagatggcgtcgtccctgtacgtaccgcagctgacgaggtggcgcgtcgcgctgggcggcgtctcgcgcggcgtcgtcgagcacgaggggaaggtgcacctggtggtgtcgcgcggcgaggacgacgaccgcgtcgtcgccgccgccgggaaggaggaggagaaggaggacgaggacgaggacccgcgcgagcgcgtggagatcggggggaggctgttcccggtggtggacgagacggaggtggcgctccacggcgggaaggtggtgcgggccgtggagtacggcgagcgccgcggctcccccgcggcgccgctgctgctcacggtgacggaggggaaggagaaggaggtggcggaggtcgtcggcgcgcccgacggcggcggcgtgctgcgggtggtcggctgcggctgctacgccgacccggtgaccggcacggtgcagcacatggtggacgtgcagggctcgaaggcgttcgtgctgctcgtgtcggtgcgcgaggagctcggtcgcatcgtgtccatcaagaggctcaactgatgaatgatgatgtgtgtgttctgatttccgaatcatttagagagaaaaaaatcctataaactacatggcaaatgcaccaatgtaccaccagtgatccattgatccttattacatgtagaagattacatcattttatctctatgctgaagattacatcattctatatcactatgctgaagattacatcattctatcactttgctggggtcttgtgcgcaggataaattttaattcgtatttcacagactccaaccagcgtgatgtgtgtgagaagagaaagtttcataagcttgttttaattcgtattttgaagaatttgtctctccaattgtgccaaactattctccggcaaattactagctttttggtgtcctctaaccattacacttttttttcgatatccacaagtaaatttcacaaacttttggtgtactatagtaaaatttgtcatcaaattaagaaatggtgaatatattgatcaacgtacggtacttcgaggcgttcagcagttgatccccatagggccctcgttgcagttctccaagatggttccgggctgcagcttgcccttggtgtggatgaggtagaagaattcgttcgcgcagacgttggtgatgtcgttgagcagatggttgtaggggcacgcgatcttcttgaacagctcgcagcactccttcatcgtctgcttgtcgttgcacttggccccaagttctccgaaccccttcacctgctcgaactccaccgggcacggctctgcacacgtacaaacgtacgccacgccgcagcaccgtgcgtgcgtgcgtgtcagatcgagacgacgtacgacgatcatatcatcgccggcacacagtacgtatacaacaaacacttatgcgtgcgtgttattacttgcgattatctcctcttggctggtcagcgccctgcgcgacgtctttgcgtcggaatcggaggacgccagggtggccgctaagaggatcgtataccaaaagacgatggcaaaaatataattggagttagctagctagccattttttacgttgcaaaagctaggaaattaacgtttcaggactcatatgtgctatagtacctgataggaagcggcctgcttcgtcttggggcccctcggcctcctcggcggcggacgacacgacggcggcggcggcgaccacggacagagcgacgcagtagaaaaggatggtggaagaacccatcctagcttgcgattcccagcaggctgcaggactagagatgtgtgttcgtgcctttacgagagcatatatacgagagtagggggaatgatcggttgattagtgaaactgaccatgagaaattgtggttgaggtggtttagcgtctgtttgtggacctcattattttgagggcaggagttgtggtgatttaatttgcggccaatatatataccagggccaacttagctggacctataattagtgtgcgagattaattctcaatgatttctaatgcaaatcatgcatgcatactcgcattatgaagtacatactacagaccacacagatttccctctctaaaaataagtactactgagcctgcatgtgtagtaaagttttcaaacggaagaaaaagaattggctgctacaagtacaactttaattaatccctccatataaaaaatataagacgcaactactactaatgcaaaaatcaagaaatagtacattctcaccttctcctttgtatcatcttaacaaataaagtacatgtaaccaatgaaattacagatactggtcagggtggagaatgttaaaaaaaattaagcggagggaaatatgctatttcattacatatatgcatatgcgccttatattattataaaacattgaaaaaattggttaagtgagatggagggagtaacatctaggagaagatgcccccctgtgattttttaattagagagaacgtgtgtgtgaattccataaactatttagaataaaaccattagttgtaccaatccccactacagattacaatgaatagtttgtatatcatcgaaatatgaagcggagtgattacaccgatagcaaccatttaaaccattgttcatatattatttatactgttctcaacaaaagcaaacacacatccttcggagaagaaacaatttccagcacacagcatttttctttgaatatttgaaacacatggcccgttgacatgcaaaattacaaatactctgtagaggtacatctagctatgtgttgatgaaccctttaaatttaacttatgccatgcccaaaactatgacatatagccaagagccgaagatagatggtcggttttcttgccaaaatatgacatatatctatttatgtgtttgtctatttgccgtacatgcatgtttatattaattgagtactttcattgagttattaaggtgtttgtcgatcttatggcagtgtcggcatgataacgtttctgtacaatacatccatagatgaggtgatgcacccaagtaaaagacgtcatgcacaactgtgttgagcacgaggagaaggtgctccttattctatgtgatggttgcatcctcattcaacgaagatggcatggtgggggcactcgatgccaccgccttggggaagagaggggagaagggaaatggaggaggttagctgagggtgctagtcgagatgaggttggcactgccaccataggaggcgaaggagcattcacgaacgcatgaaaacggcgacatgcaagatgaggaagggaaaggaagggaaaaaagtgtttgggttgttgtacaactctcaaagcgtcacgatcccttataacaattagatatacagagattgcattgatatgttgggtttatggttttttttagataatggaatagaatatcccggcctttgctcaacgagttacagccaattattacagagtaacacacaaaacaaaaagtttctcacatgaaaaagaagacacctaccaacccaagataaggagtacacaattattgaattctgtttgtgaatctccatccaaaattggtaaacagttgtataaccattgcctcaagattacgacatgcaacttttaaacgctcgccctcttcatcacacttttaaatgttgtgtttatggttaacattttatgttcaaccaatatcctaggagaaaattgtaataaaccttttgtggttcattgcatttcgaagtaataaaagtaagtttagttacattgcaagatgacgaaagggacattcatcgttataggtagtatagatcaggccggaggctagcaacaacggagcgatatcgatcgagcaagtcgaatcagcacgatcgaattcaacacttcatcccatgcggtccctcgaggcatttcttgaagatggttcccggcagcaattggccgtaggtgtggatggtgtagaacatttcgtccgcgcatccgttgttgacgtcattgatcagcttgttgtgcgggcatgcgaatgtcttgaacgcctcacagcacaccttcacccctgtcgtcttgcacttctttcccagctcgatggcgggccccttcatcttgtcgaaccgcaccgggcacaccggcgctgccaaccacacaccacgccacactcgcgcatgtcagacgatataccgccaagctataatcacatgtacgtacaacaacacaacaaggtgccattacctagcggcacgtcactaacggccatcagcttgcgggaggctgagggcaacgtgtcggccttgaaggcagaggacgcaagctctgccgctgggatatgcatacgtgcagccacaagcgcgtgccgtgatcagtacgtgtaccaaaaaaaatgaacgcattagttagctgatcagtaatttttgcaggagaggcatgtgctactaccttctacggactctgcttcggtggggggcacctgtgtcgctgcggcgccggcaattatggatagagcaacgcagtagaaaatggtggcacggccgatggaagaacccatgcctgtcatatttaattatttgagcaaatttaatgggatgagggaatgatgattggttaaggaaaactgtccgaccgtgaagtgtgtttttataggttgtgaatacacagtgataaaaggtggttcgggtggtttgattagcgtgtctgagtatatgtggacctcattgttttgaggacagggagatgcgcaaatagaaagtatgcacctataattagtttgtggttctcgatagttaccggtaccacattttattactagcaagtgtaatatgatgttgaagtgaaaactatagggttccttcaaattaaagggagtaattaccaagtgagtttattgtgaagttttcaaatggaataattgtctcaacaaaggcatgtaaccatcctccggggaacaaacaaattagagtagacctcattgatcatagtaacatcatctttgcctcttttggaccatcatgacacttatgaccatacaaatactccgtagaaaggtttgatatatatctatctagccatgtcttgaagacttgaaccccttgagatttatggcgtgaccagattgatgacatactggccaagatatggtttggtttgtttatttgatgtcatgacatcaaaggagatagaacgttggtatagttgtgtgtcaatgatgtgttgtgtttgctccatggaccatggtccctcagcaccggctgacccgagccgacccgatcactccagccgtggctcacatccgagccgcccaaccggtttcctggtccggttcaaccagaaccaaacccacttcgggtccaacaagcgtagtggatacaaaccctaaacccccgcgagtcgaccactcccaattcccaaactcccgccgccgccgccgccgccatcgatggagtccgccccggccagccgcgtacgccgcgaggacgtggcccgcgcggtggcggcgctcctccggtggctccagcaccaccccaccccggcgccggagcccatctacctcctcgtcaccctcaagcgcgcccccgcccgccgcttcgagcacaccctccgcctcccgcgctcgccgttcccgtccatctccctcgtctccgaccgcctcccggcggacctgcccgacgacatcgacccgctcccctcgcccgcgctcgggtcgctcccgcccgccgcgcgccgcggcctggtgctcgtcgaccgccgcctcagggtccgcccgggcggcaagggcaaggcggcggccaaggccgcccgggtcgtgcccgtcgacctcgccgaccaggcgtgggcggagtccgcgagggaggcggcgcggcgcgtggagctgcgggtggagggcggcacgtgccgcgccgtgcgggtgggccacgcggcgatggcgcgggaggaggcggtggagaacgtggtggccgccgtggaggcggctgcggcgtgcgtgccgaggaagtggaggaacgtgcgggcgctgcacgtgaaggcgcccgagtcggtcgcgctgccgctgtactccgcggtcggcaccggcggcggcgacgacggcggcaacggcgaggcggaagacgcgaagaggaagggcgtggcggtgaaggagcaggggattgtgaagaggaggaagaagagtagcagcgtcagtgtgggcggtgatcagttgtaaacctgtactaaaatacttcagtgttgaattcgaattcgaattctgtctttcccttgcatttcgatgcttaattgatcgccaagaacaattcaatgaacgatattgcagggtatttgttcgatcctatctttgtcgtgcaattcgatgctgaaagattttattagttttcccgcgtgtgcttacgaatcaaatctcaagggcacgaacattttgattttgtcatcaaattgcatgatggaaaacataagccccgtactacgttcaaaggatcctttgcgaaccactgattatttatttattttgatgtttcataagaaaagtatacgattttttttggaaagagatggagacgataaaaggttcccataaggccataaggtccaacctaatgttggaaatcctcgaaaaatcctatataggatttttttttctaatctcaaatgctcattgtttcgaatttttcatgagatttttccacccgcagtcgtttctcccctgtttttctttttccgcccgcagtccatactccctccattcctttttttttttcgtttttttccttttttttctttttttccctttccacactcctgttgttttccttcccttggaaaccacgagtaaaaagattactaataaattacctatgcacctaaacttcttttagtaaataaattattggcttttagtcacaccaagcctctatcagtaaatcaattactgacaaatatattttttttagcaaaagaatccctctggtgtccacccagtaaagaatttacttcccacaaaaatccgtagcactcatgtcaataaataaattactccccaaaaaatttacccgggccttctcttcgtaaatagattacctttagtctagccatataacttcttggccttttctcagtaactaaaaattacccttcatcaaattttcccctgcttatgtcagtaaatatagcttttgatctaaccataccaacaacatttgactctggtattctctaactaaataaattacttccagattgttagagtaaaaacatatgaacatattgctttggccacaaattgctcgaaccttctcattaaaaataagggttaattggatccatgccactgcaaatacggcaaatcaaaaatatgccactactattcacgttatttactatatgccactgtaaaattttaaaattggacctatcccactcccgtcactttttccatcctcccatcaatctttccgtcttccccatcctctccccgttctcctcctctccaccgccccggatgacgcccgctgacgacgccgtgctcgcccacctcgccgaccacgggtacagccgcaacctgcacctcgtcgccgagctccgcatcgagcgcgcggactccgcggtcgccttctccacgccctgcgccgcagccggcggcggcaagaagcggcagtgcctcctcctgccctcgtccaccggccaccgctctaccattgctttcctcgcatgtggggacgtcgggttcttccggccattgtgatgtccagtaaaaggtcggcaagcgtatgcctaagttgttctccaaaatctctcgaaaacacggattggaatctagaaagcttgcatattttgggtttaatatgtttccaatccacactacaagctaccactaggcaaaatcctttgttttgatacgatacaagcaaagaagggaatcaatcactcacagcttcgacgttgattctgtagacgagcaggcggcgtcactcgcggcagctggcgcggtaggccatggcgatgtgcgcggcggtgagcgcgagcgacatgaggaacatggcctccacggcgacgagctggcccttgccctgcagccccagcccggccccgtcgggcgccgcgccaaacaccacggccgccttggcgacgacgtaacacaccgggcggagcggtggccatgggagagcgtcccctcgccgtcgccgccgccgttcgccgctggccgcgaccccatgttcgtcaccgcctacacatgcacccgtacagccgcggcagcgacttcctcgactccctccttgagctcatggccgccggcaagatggagacccacatggtgaacatgccggagagatgatggggatgacggaaagattgacggggaggacggaaagaatgatggagtggcatggttccaattttagaaatttgtagtggcactcagcagataacgtgaatagtagtagtatatttttaatttgtcatatttacagtggcatggatccaattaaccctaaaaataaattactccctgactatagagtatcctatttaccaacaaatccatatagccaacacaaattacagccatatttttgtcgagtaaaaaaatcatactacatgttacaaagactcaggcacatatccatattgattgtacaattaaaaacactagtcgtcgctgctccggttgcatcggcggtagacgaatcatagccgaggatgacgcatgcgcctgcaaatacaagttttgtgcggaggtgtggttcttaggtgtgccttgtcccagcctgcaatcaaacattgcgcaattcagtgaaatcagaaccaagatcaatcaagattcacacaacgggggatagaaaggaactcgagtaaatcatcactgcgaacctagtagatgatagtgttggcaattgtatgtactgatttgatgggacgcagttcagaacaattcaaacgatctgctctgttgaaccaattacagagaactgctatcaaatcaatatcattgaattttcatccatgaatagtagtatgagagagctttggatacacgaatatacaactgaacagattaaaatctacttcctccgttctaaaatgaagccatttttgaagttagcatgggtattaaaaaagtaggtgagaataattggaggaagtgtatgattggttgaaaagagaaagtaggtgaaaaagaattgttgtgattggttgagaggaggaggtaggtgaagaaatagctttattttgggacaagacactgtgctagaaatagctacattttaggacggagggagtagatgggagcagttatctcaacacagggcatacagaaattaatgactggacacctgaaaattcagacgagtatgaaaattatgtgataaatgcatcgaaaaacaacattctggcaggttaccaatatccaatgggcggtctggcccagcagcagggtgttgacaacaagcagcatcaactctgcaatcagctatggtttcccttggtgaggaatacaatcaaacacctttcaaaacaataacatctgaatgggatagattgaagcatcattaatgaggcaagaaaatgaaaaactgccatggtttccaagtatgacatccagaagcaatataggagttaatctttagagcataacataaggacacagattctcactgtcaccagtctcacctcagccaaatcgatgcaaccaaccttgccaaaataaatactaacactaagggtgtgtttagtttacaccaaaattaaaagtttggttgaaattgtaacgatgtgacagaaaagttaaaaatttatgtgtgggggaaagttttgatgtgatggaaaagttgaaagtttgaagaaaaatttttgaagtaaactcggcctaaagagctactccctctgttacaagttataagacgtcctgggatttgaatttcaaattaaggaagcgatgaattcccctttatgcccccgatgtccctttcttctcccctccattgctcggagcctcggaggtagtagtagctcgcagacacgcaggggccgcgtcgccggcggcggcggcggccacgcacctcctcggcaccaagctccccggcacgcactccgatggccggcactgcacactcctcgacgcgcactccagcgacgcggcgcagaacgcctcgcctcgcagcctcctcggtgcgcactccggcgacgcggcacggcacgggacgcctcgcctcacagaacacctgcttcagccaaactccggcgtgcttcgcttctcaacgcacgcccacgtcgactagtttgagcccgacaagtccggcagcgacctcccccaagtttcagagctccctttccacaagtttctgcttcgcgtgtgcgtcatcacgttaagctccatggcggcgattcctctctttgacctcaacgctcctcctcctgaagacggtgacgaacttcgaggaggcgaagccatagctgacgaggctggagtcaacattgctggggatgaaggtggaggaggtgctgtagctgacgaggtaatagctcagaatgcaggcaacattgcttcgggtgaaggtgattcatctcgctaaggatgttggagtatttcagatttttgaagttctgaaatgtttgaaattattcacagttcacatttatttttatgtaagttctgaaattctgaaatgtctgaaatggagtactgaagatgttgtactgtattcttcactctgaaatgtcttaactgatgatgccattcaaacgccatgttaagaatcatcaaccaaacatcatgttaatatactgaaattttcagagtactattcctaaatgtctgtacatcacttcatgaaatgtctgtagaatactgaaatttttactccgtagaatactatgagtacatgttgatcattgtattccacttcagaaatgagggagtagtctctgaaatttccagaaatcatggatgttgatcattgtattccacttcagaaatgagggagtattctctgaaatttccagaaatcatggagtaaaaaccctgaaagcttgactaaaatcttttggatactgtaaaaaaaaattcatggtattgttggagaacccctgaaattctgcaattcctagatgtgtactctttcctctgaaatggagtagatgttgtactcttgcctctaaaatctggagaactcatgcttgttcagtttgtaggttcaatgatataaccaggagtagctcatgactcaatttgccaaacagatacactgtcagatcgattcattcattcattctgctcccaatagttcaacaactgtatttacaacatgttataaactgcattatcaaattctgctcccaacatgttacagtctcaaaaagaagttacaaactgcatttacaaaaggaagatacaaactgcattatcaaattgtgatgatggaagcctcctactcattgacaagcctccacatggtttatgttggtatacaagctgatctatacatgttgtagagtttccttctgctgtgcctgtacacttgaatgcatgtactgttgtacacatactcctgctgccatttgtttatttccctgtgcctgaagttcttgaactgaaataaagagtgaaagaaaaaaaaaagttaactgtctatccatgttaattgtccatcaactccagaatcctagtactcctactctcccactcctagtaacatgttaacagtggtacatgttgatttgacattctgctactctaagtacatgttgatatgtaattcatgttttgattacctatattaattctagtactcctagtcctagtacaactgcttatccatattattttgaatcttgttaatttgatttaatatatttgtcctgtttcattcatgcccttgtaggtgttcaaccacaagagagaaagataaggagatggttatcagacaaagaaagatatgctgtttacatagcattacatgctaaaagcaaaggtggcagattagagaaggacaccacaaaaaaggttgcagaatatttcaatgtaggtattcaagttattcaaaggatttggaagcatgcaagggaacaggttgcactcgggctcaaggttgatgttgacaacagaaaaactagatgctgtggccccaacaagatggaaattgatctctcaaaaatcgctacaattccgctgaatagaagatctaatttaaggtcacttgcaaactctttgggtgtgagtattgcaacagtgcaccaaaaattcaagctgggtaagataagacgccactccaatacgttgaagccatacttgagggaggaaaataagagagaaagggtgaaattctgcatttcaatgttagagcttggtgatattgatcctagattcatgaccatgcacaacatagtccatattgatgaaaagtggttgatatgactaaaaggaagaagacctactatctcctgccagaagaagaagatcctttgcggactgttcaaaataagaatagaatcggtaaagttatgttcctaactgcaatagccaggcccagatttgacgaggaagggaatgtgactttttctggcaagattggcacgtggccatttgttaaagaggtgagtttgagttcatcatttcaaatgacttactctatgttctgatctgaactctttatgaattggtttcaggttccagctataagaaagagtcgcaacagaaccatagggactttagagacaaaatctatcatagtcaacagggatgtcatgaggcaattcttgattgaaaaagtaattccagctattcagtcattgtggccagaagaggacattggggatacaatttatatccaacaggacaacgctagaacacatgtccctccaaatgacccacacttcctacaagcagtggctgcaacaggactaaacattcagctgaaacaaccctcaaattcaccagatatgaatgtgttagatttaggattctttagctccattcaatcattaactaattgctcaagtccaaaaactattcaagaactaattcatgctgtccaagaagaatttgatggttatgaagcttcaaaaataaacagagtgttcctaactctacagctgtgcatgctagaagtgatgaaagataatggaggaaataggtacaaaatcccacatatgaataagcaagctttggaaagagaaggaaggttaccatcttggctatcatgtgatgctagagtctacgagaaggcgttggactgtctagaacaagttggttagagcaatggcttaggacactattgtgatggagagtagaaaagtcgcaaatactgatgtataggagaaaagttgcaaatactgctgatataagggagaaaactacatgaaagtacaaatactgatgtaaaggagtaactctggtgttgttctggtttattgtcatgcacaacatatgttctaaagtttgttttggaaaacaaagtttggattgcaagtttggtaggctattctgttgtcttttcattgagtgcctcatttttatggtctctgaaattgaatggatacatgaatcatggtgtcattctgtcatgtatgatgttcaatggagtatgaatcgagtacgttgaatcccaggaaagggattaaataggctacttacagtaagatgcagaattgccacttacagtaacactgttttacccccttgcagtattaatactcccttacaggaacactgttttactcccttgtaggagtaatccatgtactcctactcccttgcatacagtccaaatggttgtgctatgaaaaacctgaaactatattgattgaacattgtgaaattggctgaagaaacattacctccattgacatttgacctctgtcgtcacctcctccttgagatgcaagagcccattgttgtcaactcaccgcatctggatcaaccaaccaagaagacaagtttatacattaaatttgtagagttggcaccattaaaaaaaactgcactttcaagaacatcaattaccctcaaatcaaccaatccagacatccagtgacctccaatttagcaaactcattagcaccaattctataaaagaaaattgctatagcatgaaccagaagcaatactccattccaattcttccttgctgctcctttgacagatggacagagctctcctacaccagcagacgggcgccgctgctgctggccacggatccaacaatgacgctgcagccacagatccaacaaattctctgtttatacaattgcagcaggcacgatcatcttgttcatgccaagaacaaagagtgttcttgttcttgccaagagcaaagaaatataccaggggatgaacgagcagccgccgccgaggtcgcagaagtggaggtcgttggcgaagctgctcgacgccgacgatacggcagggtctgcttggcgccgatggaggtcgttcagctcgatgtcgccgcccaccgccagatctggtgggccccgaggccgccgcagacggccgatatagctgaccacgaggcatctgccggtgctcttgctcttccctaggaagacgccgttagatctggcgctggccgagccctagctccgtgctccgccgccgggaacatggaagcgccgccgcgcccgccttcccgagaagcggcggattcctggaacgcgaagaggagcgcgaccgagacagaatctgcactgttttttttttttgagagagtgagggaatctacacagatctattagcaatcacacaagggcacgaagaggacgacggttctagcagaggctgtgtttagatacagagtttggatccaaacttcagtctttttctattacattaacatatcatacacacgcaactctacagtcaaatcatcttcaatttcaatcaaaattcaaactttacactaaactaaacacagccaaaatatactcctacagatcaagatcaagaggcacgaagaggccaaaagacccacctttgagcaccgatcgaaaggccggagcccaccctcttcctcgaacagtttagcccagcccaaagaaaatatcacaaaaacgcaaaaaagaaaagaaaaacaaacagcaattcaatcaaacagtagaaagaagaaattcatataggataacttctcattaacgtctccagattcaagatacttcttgttcattctccttctcctactacaaactaccagccgattcactgcctttttcctactacatactactttgcatggccgattatgctttgttttgcgttgcgtggcttcggtgccactacaccctcctcgcttgcagaacgatcttgtcagttgcactcgccctcacgctgccggaggatcggactccggcgcgtgcacgggcgccgccggcacatggccctcctggcccatgactggcgcctgctcctgggccgccacgggcaggtccaccccgtcgccggcgacctggtggcccagctgctccgcgggctgctgcacctcagaagaatgcagagaataggatccacggctatgagagaaagcaaaccatactagcttcctgctgccgattagttgaagggaaagttaaaaatagtcttaagaattatagagcacgacagcattcaaatgaatgttcttaaaaaacaatatttttatttatcatattttgactagaacttcagttctttcacttcgacacgtcttcccgggagctccccctggtgagtcgtgggcgtggccagcgggttgggcacccggctggccttcgccatccggttgtacgcttgattgaggccactcacgcgtcccccgcgcggcgcagcgccggcgaccgacgagttggcgcccttgggagggccgcggcgagaacggggcatggttgaaacgattagaacgagatgtgaacaaaatttctgtggatttatggctgtttatagagtgaaatacatggccggtcccctaaatttgtgtggtggtgtcacttaagtctgtggactaaaaaattgcacgtttagatatgtgaacttggtttaatgtatcacacccagtctaatcgttctttgaccacgtttgaccaccaacatggtatgtcacataggcaacacttttgctcttagccccctccacatcacaacatgtcgcatatatctctttgtaactatatactgacaccagaatcccaaaaaaaaaatacttaaaatgttcttccccaaaaaaagaaaatgtcatctcccgcacaacgagcacttgagcaacaacaccttcttccggtgacttcaagacgaggacgagcttggagaatccatgggcctcccgccgctaatctgaccgcactgtgccatcgctaaccccgctgcactgcgttgcctcctgccgctgaggcccccacaaccactacctctcggccttcttccgctaacccccacaaccactacctctcggccttcttccgctaacctcaccgactcactgtcgaaaccttagctgatttagggatattttggaggattgggtttgtaacagccctccctctagaaccgcgtagcccagccaaccgatgagcgggcccacttacacacaccaccccacttacactttcgtcctcgcttcgtgtaaaagggttaaccccggagtgatgtggttggagggaagaggccttataagtcggttccactcgtgctaaactagcgacgtggtactaaacatgcgcacacagctcacatgggccacacaggcctaatccttattgggccgggatgtcacagggttgaaatgcactcgtcagggcaagttatgtgcaaagatatatatatggaggggggctgatccaaacaccacctaaagcaatcattgcacgccttcacatacatcggatgtttggacgctaatttagagtattaaacatagactaattacaaaattaactgcataaatgagagctaattcgcgtgatatttttttaagcctaattaatatcataattagcacatgtttattgtagcatcacatagtctaatcatggattaattaggctcaatagattcgtctcgcgaattagtcaagggttatcgaataggttttgtcattagtctatgtttaatacttctaattagtgtcataacatccgatgtgacagtactaaaaatatagtccatgtgatccaaatagacccttatacataaagtttgttcttacataaataagatggtgaatcataaagttattttgagacaggtgagaatatgcatttgtctttcactttaacaccctattttgaagcctaacaattaaactgaccatcatttttgaagtttgctcaatgaacccgcttttcaaaattgtaataaccatttgaccatacatttactccaccattagagattcatttagaatacaaaagaaaatgtatctactaccctgaactaacaaaaagcccttattacacatcagccatatccccgaccttgtctagtcccaacccagttcagttccatggctaggcggcaaggagggagttgccgtgggctagggcagagggagcggcggtggcgcacatgcggagggagggagtggcatcctatgcggtttgggagctcgccaacaggcgactagggaagcaaaggccggcgggcggagagagagcgagcggcgagcgacgaccagtgcatgttgggtggatggaggcatgcggcgtggggaggaaggcggaggcccacggacaagtggagccacaggcctagctcgcacagtcgactaccgtttttaaccttcggaatatggttttgtgccgtacgatgccggagccgatcctacccataaagtccggctgaattttctcgatctcccaaaattggttaaggaattttgatcagataaaatggtcgggaaagctcaacggccagccatcatcgacgaatgttaaatggagattaaatccgacgaattaaaatcgagttgaaaggggaaaccatggagaaaatgatgaaggatgagtatagaatcgatttttgcgatcaattggatgggggaaacgacgcatgcatgggaagaaagatcgatgtggaggcaacattagggtccggcccggcgaaaaaaaaggcaaataaaaaaacaagtggatgaaaaccgaactgcggtgtgaaaaaacactgacggaaaaaaccggatggacaaaaaaaaccgcaagcctaccaaaaaacgcttgcgcaataaaacaaactggcgaggataaaatatatgttttttttgttaggccagcaatacaccaataggataggaaaaaaacttgctataaagtttacataacaaaatattttttacatgtttttatgaataattgtcaacatataaaagtaggttgctatggtcttggagttctattgttgttttcaaggcctagaaaaccaccaagaatatgaagaaggatcattgtaaaaaaaataattaatattaggcgatgttcaaaatatcttatattttcatagaaagattattacacaagataaaaatatcacaaacataaagccaagtacatgcctcttgctaactaatctcaatgtccccataattataggggaaaggcttccagttttctccgcattatcttctctcatgttgcattcgtgtgctttaattttccgtaactttttcagaaactcgttgttgttgtccaaaggactccggactgtaaactgaaaacatttcatatttgattgcagataaaataggccaatttccacacgacgactcttgtaccttctgagtatattgtttaatgcggcatgcaatttattaaaaatagggatgttctgcctgtacgctgaccatgtgcgaaggccgcacccatggtaaaaaaatgctgtaatcatccttgtctcggtacgaagctcaatctcgcgccacagtgacgtggatttaaccataacttgctcagccaatgccttcgtgccatactcatcacgaacacaaaacctaaatttcttcttaggaatcttgaatccaacattccgtttttctttcctgtacataagcgagaaagagaaaagaaaaaaaaaggtcacattagcgatcgttatccgtatttcttcatgaaaaaaaaaatctgcacatgtatatacctgtcaccagtagttatcttcatgtcaacacacaaaacacgaaaattcttgttcgctagctgctgccttttatagggtgtacagctatgtggattgttaaattcattaattcaggtatcctgctcggtctcgctaacaaacatatgatccgacccgttaagagacgggtgattaataataattaaggcaacaaccaaactcatccaatctgcttgcggcccaagtctccaactaagtctcggatatgttccacgctttcacgcgggtcggccgccggcgaccgcggcgagcagagcgcgcagtgcagcagagaacctgtcgggtactcgggtggctgggctgacaggtggggaccttcgtgtgagaagcacgcgtacgcatcatggccttgacgcggagcgagcaaaatattgcaggcaccatctagcacaccgcgcacgagagccgtccgatctactatatcaaacctccctacgcgcaaacggcacacgtgataggtatatgaggtatcgatggaaccggtcgcggctagccggctagtacagctacaaacaagcacccactcccgtcacagcattacacggggtacacggtagattattttggagaagaaaaacaaaattgctaaccttctttcgacagattttgcatctccaaatcttacaaattttgggacaccggatgggcttcaagattcgtgcatcacgccttttcctccaactccggcgacctcctctttttctccggcgccggcaaggaccctacgggttaggatcgcggggtggggtggggtgggggtgga

SEQ ID NO: 36536 - DNA, 18830 bp, Oryza sativa
tcaaggaggaaggggggaggggagggtctcgccggcgccgttgacgtcctccggccagccggcgaggcgggcggtggcggcggatcgggcagaggagtagcgatgggaggggtgcggacgcgtgacgggaggggaacaggaggatgagaggtagggttaatgcatctgcacgaatattaaaacacatccaacggtccaacatttgaaagatgggaggtgggattttctatcaatagatgtatagacatcccaaaaaaaacagagaaacttatagaggattgtagagcttcggatgcatcgtaggagtccaccaataactactgttgcatgcgaaaggttcttggtgctaagaaatgtcaacgtcagaacgacaccttcaagaaggagaacgacgcctaatggctaatggcttcgtcatcgtcatgtcggcccatgtcacttttggaaatacaatctgtatttgagtcgagttttaacttcgttcgtctttggacatatagaaggagtcatataagaaatctaaataaaaaattcgcatgctaacttgagatgatcggacttctaattgcatctcatgatttttctagaaaaatatatatccaaacgaattcccacagtgaatttcaccttaactaaattgtatgatgataataagataacctttacccgttgcatcgcgcggacttctttttagtaaaaataaaaactatggaaagaagagaccatctaaaacctaatatgagattaattaaaatttaaaataaaaaaataaaataaattccaaaataactggcatgtactccctggccgtattccggtagtacaggttctggcacggccgggtcatacacaggtagagactagagacggcaaattgtgcagagtggaaggcgagtttagtagcctcgcgagcctgcactgcatgcgacgccgcggaacgagcccgtgcacctgtcgcctgtgcgcggctgttgcagagacaacggactggatctttgccaatgctttcaatgggccagaccaaaataacgagcaggccagcctttcgtttggttctgatccctgatacgcgtgaactgtcgccgtggggcgtgggctgtggctgaatttgtataggaaaaggtccactttacgtcccttaatcataggtcgagtttcttcctcaatcataagattgggtcgagtctctcagtagtattaagattgttttggctcacatgatgtcggtataacatgtttacttggtcttcgtctcacgtaaaatttattacatggcactaaaagaaaatataaaaaacactagtgggatccacgtgtcatttggaatctggttagaaaaaattaaaacaaatattaggcccacataatagtgggtgccctagttaagaaaacaaaaaaattatagcgagacccataaatcattgcccctcttctctccctccatcccttctctctctttcttagtggccaccagcacatgattgtacacccaaatattgcgtgtggtgcagttgctactttatcttgacgacggtgtattgtgccacgtcgcttgtgcccaacacattgacgacggtgtcatgtaccaacaacaatcggcgccttcgattcatgagcatcacctgaacaccatcccaaacagcctcactaggacggcagctgtgttcttaaggacgaggtgttgtgatagtagaacgatgtggtgacatcgagcactgagagcgatagcgcgaggccggcggtggggatggtgtggctgacccctacccgactttctcttggacatagacgagaacgagaatggcgacgaggctattagcgaataagtcggacatctttgtgtcctttgccgtgcataccaccgatgtgcatcttctcttcaccatatatactctgaccaaccatatatatagaaatatatgtatttaagttgtattttaagtggttgtcttgcttttaattaaaccgtaaatttataatttgtaatcatttatcctgcaacttttatagtttctttgaaacaaaagctagaataattattttcattataaaataacttagctagttatgtgcacaatgcattgtgcggtatggcatgtgcaaacaccaacttatattcgtgagcttctattaaacaattgtaacttgatttcataatcaatagagctcacattttccttataaaactttctatttatgaaaatatatcagagtgggacttagatgcagtagagatgggatttttttaaatataatgcagatatggaaataaataaagcataattacatttgggcatggggaatatgtgaggtagtatcaaacacctgctcaatacggatttgcatcttataaatccaaacgagaaaaagatagcaaagaccataaattgaaaccaagctagtctctaatgattaaaagcggagccattcttattcctcctcccagcgctacaaatggttaggtctcaattatgcttatatcccttcttccactctatagaccataagaggttggatctcaattcatcgtcctaacccatccctagtcatatgtactcgtgcaatcgagtctatgggcttgttgcaataaacgttattagtatggtaaacaaggggggatcacaaacatacaaaaacaatatctaacacctgtaaaatatactttaaatcatgacctatccaccacctcactcaactatatattcctagtcgttatttaagggaggagtttctgacaaccatacccactctactattataaggattaagatgtttttgtcggtactttggtacgccatccgtgtatgagtcggcttttaagtttgttcacttttggaaatacagatctgtatttgagtcggtttttaaagttcgttcgcttttggaaatacagaaggagtcgtataggaaatctctttaaaaaaaactcacgtgctaactttagatggtcggactcctaattgcaacttatggttttctaaaatatatatatatccaagcgaattctcaaagtgaatttcaccttaactaaatcgtataataagtaataacgataagattaaaatagctttcacccgttgcattgcacagacattttttctagtcttatataaaatgcctaaccccttcaaactgttcatgtttttaccaaaagtctagaaaataaattcaaagtaaaaagtaaaaaaaacttttagaatttatgaattcttatcagctgcttttgagaatttcaagcttctaagacaatttctaagcctagatacattttttcgaacggtcaggccattgccgacattttatataaagaagaaggtgtctcattttaaggagaaaacgagaccaaaccttacaatgcacagttaattaggggaaaactgggcgaaaaccacaacactctaacctaagctaccgacaccatggaaaaaggaaaaatggcggagcccaaaacagctatcgataaagagcttgttgtaagcgatacaaaggcttcgacttcgtgaagcaaatgttatcgttgccgggcttgtcgcctagcgacacagcagcttcgactccacagctatcacaacatcgttgccaaatgcatcacagaaaacaagcaagacatcgattgtccactttgaacatcagcgcaaatcaccagagcaccacttcttgaacgcagctaacaccaacgcccctcgaaaactgcaacatgttattgttgccaagcttcattgcaccctaacaaagcagctccgacttcacctagaagaaaacgaagaaagttgtacgctcgccacatcaagaatggaacctaggagacgaaggcctcgccgaaaagctaggcttacagagcttcgacgcggggtccacgaacgaccatccttgcatgggaaaggttcttggtagtgagggagacgccataacgacgcctccaaggaggggaacgatgcctccaaccaaaggccagccaaggctttcgtcagcgtcatccaaaaccacccaatccacccgtgcaacgaacgtcgccggaccaccacatcgtcactccagccgccaagcctagcccaccacccacagctcaggcagattcaccagtccgccgagccgccaagcctccaccatccactgctgcatcgaccaccggccgaggcggccatgggaccggccgtcgaggctcggccagccatcgggaccacgagcgctccgctgcgccgtgccaagacgccagtgggcgcagccggtggccaccacttcctccgcgcacaagggcctcccgcaaccgccggtgggcgcacccgccccccgcctccgttgcagcaccaggcccccgcctccgtcacgtgcccgccacccggctcagtcctccgtcgccggcctcctgcagccttccctgcgctggcgagggcataccggcccccacctctcctaggcagctcgccgtcgtcagccggccaggagggcgacggatctggtcaaggggccaccgccatcaccggatccggccgccgccatcaccgggccgagggccaccaccgcctcgctgctgcatcgccgatcgagacccgcgtcctccatcgctgccgctcgctgcccctctctgcctccgtcgtgtcgcccaccgcgctggcccgcaggtggggggccagatcctgccacaggggcgccggatccgccgccccaagctgaccggccgactccacctccggccgtgccatcatcggccatctccgtcctcctcacgcagagggcggttccgctgactcgtatgggcctcgccgccgccttcctggctcaccgccggctttgccgccgccgagctccggcggtggcgaggtggaggatgggaaagaaggtgtggggcgcgggcggctagggtttcgcccccgagccgcccgcgtgagagcgacgcgggggtcaagactccgacctcgagaccctaggacagaatagacttctccattaagcctagatacatatttaaaatgtactctcttaatgacctgtttaattcatattacatagaaaatatatttattatattttaaaacagatctggtatataataccaactcgatgaagaacagaagtaaccgtaagccggatgcgactatgcgagcagtcgagcacgcagagcaaaactgcacaaagtacggtaatacccacccctcaggtcacaaaccagctaagccccggatacccccaatcgtaaatatcccaatctctcgtgcccaaaaccaccacgacccaaataccggcccgcacacaaatacaccagcgcacaccaccaggcaccaggagagagtgtgccagtaaaatccccgcgaggcgcataggaaagtacgagactacccacgcaagcgtgcggaaactacgatccggacccacacccaccctcccctcagccctaaaagcacccgggataaaaccccaccctcctcccgtcgtccacgcctccgctcccccttcctcctcctcctcccctcctcccctcgcaaacgcaaccttctctcgccgaagagggagaagggaaaaggggtttcgatttctccgcgatttccccgcggattcctccccccaccgcctcgatcgagctcgcgcgcggcccccccggattcggttcatccccctcccatccccccgtctgagaagcatggagaaggatcaccagcccgtcatcagcttgcgccccggcggcggcggcggcggcccccgccccggccgcctcttctcccccgccttcgccgccgccgcctccggctccggcgacttgctccgctcccacgtcggcggcgcatccaaggtgagagggggggatgatgggggatgagagcttggacgcgcccgatctggcggcttgatgtactgctcgatgtggattcgatgggatggtggcgggcgtgggagggggagatccggtgagaggatcggatctcaaatcgatgctccaatctgggaggggcgttagtggttgtagttgattatcgcttgcacggctcgacctagttttaggagggggttaatgcgagacaaggagctgatagtcccgactgtgatatgacagcttttgctaattaaagttggatatttcatggttcagcatgctatacttaggatttgtagtggattccagtgttgttttagctttcagggcttctattgctcttctatgtggcttgtgcgatacaatgggccgtgcatataagttaactgagtctgccttgttcttcggcaagtttcatacatatatatgtttgttttaaaactgcaaacagcatttatgtattgcatccttagctgaatcaagcaagttgttgttgtcgtgggtgttatgtaatctttatgtcaaatatttttttgttggatcaatctctcagattattagccaaaatgttgtgtcctgtgatttaatttgtggagttgtggacttgtgttttctaatttgatatgctgacatggctgatacttttgctgcagattggtgatccaaattttgaggtgcgcgagcgtgttcgctatacaagagatcaacttctcgaactgcgtgaggtacttgcaatctgttgtgttattcaatatcagtttctggatgggaaatttgctgtgaatatcttagtagacatgttctgctttacgtgctccctgtcgtttggttttgttgaaaaatgcttgcagcgtatctggcacatttgagctaaattagagcagaagtttctatttggaatacttttcaacacatcagacatggaaaacaatatcgcgtaggtggtgtttctgcaactaggtgcatagcacacaaacatcgaaatataccacgttaatgtcccctaggtattcgtgcagtgaaagttgaaacacaaccaactttggctgcaataaatgtagaagtgtctaaattggccacattgaaatggttataacagaaattttgctggtacgagtacttcgatggtatgcgttgctagcatatcattggaaatttcagtgatgaatgatttaactttagactatgctatatacaaagtagcaccgatctaggatggaaatagaggcactcacaggatatttaagtgaaactgtacctactagcctcaagtggaagagccgcagctttctttcgatataagttttggttacttgtttactctgtagtcttgaaatgcaataaaagagaggggggggggttgagttttagtaccctattttcgcagttcggtcgttctgttttaacctggttttataaatgtactacaccttctattgagacaacattagacagtgtctaacattcaactggcatataatatttatattgcgaccttgtgaagactactaattttttgcgtactaattatgattttacttactaacagatcgttgacatacctgaggccatcttaagaattaatcaagagattgatatagagcttcatggtgaagatcagatttggggtcgccctgagtcagatgtgagctcttgctatttccgctgtcatcataattcacttggttttaccatacgtattaatcaatcctaccaattggtctggttgaagcatacaattctgtctcaaattgtagtcttttgttgttcaggtgcaagtgcagacacaaacccaggcgcaaccgcacaatcggtatggtgagacagataaccgtgactggcgtgcacgcacggttcaacctccggcagctaatgaagagaagtcctgggacaacattcgtgaagctaaagcagcacatgcttcaagtggtcggcaacaagagcaagttaacaggcaggatcaattaaaccaccagtttgcttcaaaagctcaggtatgttcaagacaagaattatcagtaaagtttgttccatttgaccttattcattcattattttttttcatatcttgaataagctcatatttcttcctgcgctaaacaatgttgcttttgaagtagccttgcttagtggtagctactgattcggaattaatgttggttccctctgttgattatgtctgatgtaacctcctcggttaatccatggctattattattcatcaaattactaaactaactaggttttgccttttgcgggatcgtctacccaactcaacagtgttatttacacattttgctgtcccctcattcacaattgatcactagtgccatctatgctcttttaaccctatctttcttgcaatgaatgttgaaatgtaaaccacagaagaagtgtcgggttataaattggtacagaacaatgtcagtttgtcttgtatgtgacagtccatattattttgttgtatgaaatcaattcacatgttttaatatgtatttttctttcataacttgtatacttgtatgtatttgtgactttgtgatcaggcctttgctgatgtatgtctttcaggttggcccgactcctgctcttatcaaggctgaggtaccttggtcagctagaagaggcaatctctcagagaaagatagagtcctgaaaacagtgaaagggtatcataattatcgttcagtctttttcatgtttttgttcctttttgagtgcttttatttctttatttctttatttctttataacacagttttctggcattgacttgctgcctgtttttcttgtgcgtatgcagtatactaaacaaactgacaccggagaaatttgatctactcaagggccaactaatggaatctggaattaccactgctgatattctaaaggttggatgattttagatctcttttctgtagctttctattttttgctagcctccttgtgattaatatatcttctgcttttgattcaggatgttatttctctcatatttgagaaggctgtttttgagcccaccttctgtccgatgtatgctcaactttgttccgatctcaatgagaagctaccatcattcccttcggaagaaccaggtggcaaagagattacattcaagcgtgtgctgttgaacaattgtcaggaagcatttgaaggtgctgagagcctaagggctgaaatagcaaaattgactggccctgaccaagagatggagagaagggacaaagaaaggattgtcaaactaagaacacttggaaatatccgtctaattggtgagctacttaagcaaaagatggtacctgaaaagatagttcatcacattgttcaggtatgcattagcaaattggtaataaagttattattattcaggggtagcttgtctaatctgttctatatgcaggaactcttggggtctggacctgataaaaaggcttgccctgaagaggaaaacgttgaggctatttgtcagttcttcaatacaattggtaaacagcttgacgagaacccaaaatctcgtcgaattaatgatacctacttcattcagatgaaggagttaacaacaaaccttcagttggcaccacgtctgaggtttatggttcgtgatgtggttgatcttcgttcaaacaattgggtgcctcgacgtgaagaggtaaataaaatcaccctagtgttttattttagttatcttttatacatgcattgtctttctttcataatgacgttagtctcttggttgtaccgaggtgctgctatgagtactttggtcaatggctaccaaattctagcaccatagttatctgtagtggctctttaactgtgagcttattagataaacatgcatgctcatgtgggaatggcaagcaatcgccagtgctatgaaattgcatatatttatttagaatcaacgggtttgtctattgctttgtacacccctatattaataagagaatggccatgtttataatccatatttgaaataattcatcagttcaccgttttgactatacattgaagcattctgtttggtaccataatgttgtttctggcttacactaaatttaatgccaagtatggcttcaatgtttttgttcccactcttagtttgctgtttgtattagcaatcactggttagctggatttataaatttattatccattctgagttttgtgatgcttgcaatcttcagattaaggccaagacaatcagtgaaattcatgatgaggctatgaagacacttggactacggccaggggcaacaggactcacgaggaatggccgtaatgcaccaggtggtcctctttcccctggtggattcccaatgaatcgaccaggaacaggagggatgatgcctgggatgcctggaacacctggtatgcctggatcaagaaagatgcctggaatgcctgggttagataatgataactgggaagttccacgttctaaatcaatgccaagaggcgactctcttcgtaaccagggtccgttgcttaataagccatcatctattaacaagccatcatctattaactccaggcttcttcctcatggaagtggagcactaattggtaagagtgctcttttgggcagtggtggtccaccatctcgcccttccagccttatggctagtctcactcatacaccagctcaaactgcaccatcaccaaaacctgtaagtgcagctccagctgttgtgcctgtcacagacaaagcagccggttcttcccatgagatgccagctgcagttcagaagaagacggtatcccttcttgaagagtattttggcatacgtattctggatgaagcacaacaatgtatcgaggagcttcagtgtcctgagtactactctgagattgtgaaagaagctatcaatcttgctttggataagggtcccaacttcattgatcctcttgttaggctgctggagcatctgcacgccaagaaaattttcaagactgaggacctgaaaactggatgcttactgtatgcagccctgctggaagatattggtattgaccttcctctagctccagccttgtttggtgaagttgttgcacgactgagtttgtcgtgtggcttgagctttgaagttgttgaggagattctaaaagcagtggaggatacatacttccgcaaaggaatttttgatgctgtcatgaaaaccatgggcggaaactcttcaggtcaggctatattgagctcgcatgctgtggtaatcgacgcctgcaacaaacttttgaaataatagccccttggcagccttggcatatcaaccttttggatgctgtgcctagccaaaacagcatcgtgtattctctatagcttaggtgtttcaccccagaggaactctcgtactggagatgtgagcaacagccagttttgtgctgtatatttttgcaaggtcagatgagtgttcattattgtttcgacaacgaaggaaagaaagaagccatggattttgctatcgggtgacagcttaattcgctggagcctgagatgaacaaggcttaatgtggtatttttgtgtccctttattagttcttttctgtgcgtacacattttgtaacaatgtactatggttttggagtattctgttggtttacaatatatcgtgtcattgtagcggtcaaattttgatacctaattctgaggtttgcttgagcattcgtgcctcgtgtgcgatgaagttttatcattttcctcagaattacttgctgatgcatttgactatgattctgtttgtgggctgcctgcttgtgcgtgacattcttcatactatcaatataacaagagagttcacatcgtctcctaagctaagtttcctaagggctagtaaattggccttatcaatttttggtaagttttggaatttttgtcaatgctaaattttggtaagttttggaatttttgtcaatgctaaattttggtaagttttggcatgacaaattttaggaaggcaaagttgtgctaaacaaaaatagcctaagttaattattgaaatggcctattttcttaggcattctaaaatttgtcttcccaaatagacactacatactattaaaattgtcaaatattggtaagtaaaatttgggcctcaaaccaaactagccctaagttcagttttttttacgaaactagccctaagttcagttttttttagaaggagagatcacatcatggcctattttcttagacattctaaaatttggcttcccaaatagacactacacattattaaaattgtcaaatattggtaagtaaaatttatgcctcaaaccaaactagccctaagttcagtttttttagaaagagaggtcacatcatctcttagattaagttttttttagaatgaagagagtacggcatacatttcaaccaaaatttaaatttagataatagtactagacaaagcgctagaagccttccgtccctatccccccccccctctctgttgctggagatcaaaatcgaatcaattgcaaagctcaccgctcacccacccaccccctcgttgcgttgctcctaagccaccagacgcagccctgcactgcagcagcagcagcagcagcattagtctcgtgtgcttctcggcggcgagtgatcggctccaccacctcccacttccctttccccttcgttgtcacgcgaacgcgagcgagcaatcgaatcttcctcgcgtaagcgtaacacctctcctctggtcttgctccgcccgccccgccccgcccgtgcctggattggacctgacgagaggagctcgcgccctgccctgtggtgccagtgccactcactaatcgaggcgtgcttttttttttcctttttagggttcgtcggccggcgcggcggcgggcgcgtgtgctggtccagagctgcatcggcggctggcgcgctcttcgctcggaacatggtatgcacccgtttcgctcctgcttctcctcccccagctgcttgcttctgttgatgcttgattgaagaacctccagctgtctcgtctctttgggtagtaggaaggcaaggaagaatcatgtgctacagtatactagcgtacaggcagctgggttttgcatgcaaaatcataccatctttgtggtgtggagcttctgctcatgtgcgtagggctgccgaaatgctcaggatatcatctagtttgtgcctgttgggcgtgcaaatgcagttctccttgtcttcctttgggaaatcgggaatgcttggttggttagtgtgatttttcctggtagaatctgggatggtttgctgcagcattcactgccttccgctgtgcattgaatattgttcccggcaaaaataacattagcttcggtcaccctggcaaagatattgttccgttcgttctcagtgtctagagtaatgcgagcttatttcattttcaaaatcattttagatgtttgccagcattttatgcaccatatgtgatttctgccctttttctcaggccgggaggcacaccatcattctcatgcaaccatcgcagaacagagcgacaagaacatttatggacttcaattcagttaaccatgcactggatggtcggtattttctctcatgcttgcttgaaatgttagtgcagttatgggaataacctttccccttttgtgcctgtatgttcccggttatgaacttatcacaaaagtggtgcattaataaattgcatgagcatttgttgcttgcttcagctatataagcagtggcatagtattttcttcatttactccttatctgttagtactttggactgaaattcaggaaattcatcagatttttgttcactgtcttttagtttaaccttgtaggaatatataacagaacgtgtacagattgctttaataaactaacatgatatgctatagctaatgtacagaaaacccaacaagctactctttaaagctcaaatatcattgaggaatatgcgtagtgcttctatttgaatcaacatgataacagtcatacgttttctttaaccattaaatgaatgtctgtaaatttcacatagtttgggagtcacgcagtcaagtatcagctaaccataggaccatgccaacggctgtacgattgttgctgttttccattctaagtcttgggaaaagcatctctattatccccattatgttcttaatcatgcccaggacaagcattgcgtgctcttccttgtttcttaatccattttctatgtttatatgtgtgttcttcccttgaggaacttggtacttacagtttgctgtatggaatgacaggaatctgtggcctttacgaaaggaaaatcagggatatcaaccctatggccagggacttaacttatgatataaatgacctgtacaatttcatcgatggcctaaccgacataagtgcactagtgtgagtgccggcttccctgacatcgaatagcattactaatcatacactgatgcgcttagaactaacttaaccatttgtgccctcaacacctcgcaggttcgaccggtcgcttcatgccttcctgccatacgaccgtcggtggataaagcaggagatgtttcagcacctgaagaggttagcacagcagtaaagcgtgatcgatcgccgttggcaggtgaatcagcaaacaagcgtgatcgccgtggtatcctgttgcggtttgtttcgtggtgtgagatatctgggatttgtttcttgtaagaaaaacgcgaggttttgggtcgccagcctcctgtcgtatccgatgcagtattctggctttgaatggaatggtttgcctctgtctgtctgtgtctatgacagtatcatactatcttgtgagcacctttggaattcatgaattttacagaattttcacatgatgaaacagttcaagtcacatgaaattcctctaaaaatcgtacgtcccaaaaggacgcttgaacaaaacacaaaaacacacacacccaaaaaaaacccgaaggaactgcctcaatatccttccaaatgatactgtgcttctttctgttacaaaaaatgaaaggaaaactaactgttgtttcacctataacctattgatgtgctgttgctgatgatacataaagaactagtctaccaaagagtggagaacagaaccagaacgccattggtaatttggtatagaatgaatcatggatggaagacaagtatcctgttcatgagcttgtcagtcaactcccacggtcttgtagctcgttcatgagaggaatcaactccacagtacccgttccagcatcgaccactttgattctttcatcttcgacagccacattcagagcatgacagctagaatcatctgcgacaaggacggaaaattcagcagtgtcttgacctcctttcctagcttcagtagattcattgtcctgaagcatctctgccgggaggagcattgagttttggtcactctggggaacaagaaacagcagcatcagcgggagcagcctcgacaagtttctgatcaggacggcaacccagaggttactgaactccgttcgagtcacattcagcaactgcagcatcaggccaccccaccagccagacatcagcaacccggcattttggatggacatgagcagcgcatagaaagttccttcgatgcctggaggacaaagcttggagcaaagcacgaggagcggcaaccatttgagcctcccaaccatctgggagacactgttgtcaatcaccgcaaagacgtaatccggaatgccgattcttgtgttgagccgggtcaccattatcagatcgagcattcctgccaggcttgaaagaacttggccccagaatagcacgccgcggaaagggcagtccttcagtgaaatttggtatagtaaaactccgagcagcgaaccgattgaaccgaccgaatacacaaggccaataaattcctgaaataaacgatcgaatgacgcaatcgaagtgtcatcagatgattaaaattagaagaaggtcaaataactgaatttatctaaaaccacacctcattatatggatttaacagtggtatgcattctcagtattacagtccatgcaaatgatgcgatgaactgatgatatctagcaaatatctatatgcaggaatgtgcatacctcagagaatcctggtcccactattggatcagtgtaccagtagaacattcctgcttggatatccaggcttagactgagagaaacatacatatacacacacggccgccaaacttcggcacacttcagtgttgcccccatggactgaattgctttgtagaatttcctatgaacctgaatccatcaaagcactcaagtggcatcactgtccatgcctgaattcagcaatctcaacacacaaaaggaaaggtgttcaaattttgtcttgacattctgacctgcttgtaatcgaaatctgtaactcgcctctccttcagcaaaacaccagccaagaacaccagtgcagaagggatgcttagtaatccaagagcacccttagaacaagaaaagaaaaaaaaagcaagaatcacaatcatatcaattgacattgtgtgagaaaacaaatgatgatgcaaatcattatctaaggtcagggaatatcacacctgagaccccatggagtggacaagaagaccactgatggagaatccaagcaatgccccaacggaggagctgaacccacacaggctctgcatgtctgcggctagcggctggtgcgtgatgctgttctgagcaaccagcgcgtccaccgtcacgtcggccaccgccgcgcccgcgctctgcgccgtcagcgccaagatcgccggcatgatgcccagcttgcggtggagagagagcgtgagcatggacgacgccccaatcactcctgaatgaatcaccgagagaagtgatcaagtaaggcgaaagccttcgaactgcgagatgggatcgaggaggcggaggaggctgcaatcccctcaccggcgaggaggaagtacgggcggcggcggtagccggcgacggggacgacgtcggtgagtagaccccagatgggcttgacgacccagggggcgctgacgaacccctggtagaactgcgccgccgacggctgcacgcgctgcacgtccttccagtagtaccccgccgcgacgccgccgacggcgtcgccgacaccctggcaggccccgtagacggccacgacggcgagcacgaagctccagtgcagctcgcgggacagacgccggagccagccgccggggaaggaggcgccgccgccggcttctcgaagcgccgcgtcgtcgtcctcctcctcttggcgatccatctgggcagcgatttcttgccgggggtttcttggggatctacggcggaagcccgccggaattcgcacggctagaatgcaggtctcgcgattgatcggtgggagagattgacgaggcgcatcttggcgttggcgagctgagcaagagcaagtgtgcgttgatgggtatccgcgctcaaggttttgacttgacaccccccaccttgcaactattatagtactgtatactcctactaatttaaccatggtaattttgcaccattaatctatgtactagtagtagaaaactgggcaacatgtcaacactaattttgactttgtgccttttactattgcgcatcatctctttgcactgcgttattactgtgtagctacttacgacctaatcaaggcctgataggaattaataagtgaatatgaaataagttcactttcgacatttaaatgctgagtttgaattgcgtccttatccacaataccagtataatgtcagttaatttataatatcggtgtacccgagattctaaaatagtataacaccctattttaactgacatgatgagccaactatgatcatactgatcgagtaaacgtgagacccacatgagccccatatattagcggttaactcttttttccttcatcgcctcttctctctacccatccctcttgccaatttctctccaccggtggagaaggccagaaaggcggtgagcagcgggaagaaggatagcagctaatgggagaggggtgacaaccagtggactagaagaccttgagcttgccaggcggctgctcgagcaaccctcaacctcaggaacccagcatcgacctcgatcgcgtaacatcgtgttgccccctcggcttaccccgatggcaacacaagctacgtggccaaggtaactacggggttcttgagcatgatggcttttccagcagttgctccagttcctgtcgggaaagagatggggaaaagggatgggtagatagatattaggtaaagggactcggtagagagagttggctgctaacatgtaagacccatgtgggtctcacgctgactcaaccagattgataatagtcaactcgtcacgttagttaaaactggatgttatactgtcatgtgacctcggttacaccgatcttgcaaattggttgaaggacacaatctaaactcatcgtcaataagagagacctaaagtgaacttattataatgaatattgactattgagttggcccagcagcccaccatgttcataagaataaggtccacgacaactgctgctcacctactctccacctctcccagtctcctgttcgttcctctctcccaagtctagggatgaaagtggttggaaatggtcggaaacggcatcattattttattattttttaaaaaacaagcagaaacggtcgaaaaattttcatattcatgaattcatctatttagtgtcaacttcaatgccacaccgttagaaattaaaaaaaactaaattttaaaaatgataaccatcgataaaaatattattattatattagttttgcggaaacggtatcggtacggcagaaaatttccataccgttttcacccccagccaagtcccaacaacgttccgaggtcacagcgctcgtccgggcgtccatcgctgccaatttcaggcccgttgttttggcggccgaatccccctcccgcatttttcccctttagaaaaccctgcgcgcgtggccttctcgattcctgcccgtccgatccgccctcacggcctca

SEQ ID NO: 36537 - DNA, 751 bp, Oryza sativa
caaatcagcatatacatgaatacatccgtccatgcggttgagctaacaaaatgatgaaacgagatgatcgccagattaatccattgtttacatgcagccaaagtacaatgacagttgacaaccttcaatctgcaggcaataatttacacttttcttttaaataagccttttttttcctcttagaaattaaaccgaagctgtgagcaagagcacatcatggtcagttcttggaagtcttttgtttgacacacacttgaattgctcccattttttcccaaccaatttgccacctaccatgcctatctgcacgcacccgtcgcgcggtttattagcctcttttctcctgcgaatcacggcgagctgatcagcgattaggcgaagcaaacgtaccaaattataatgggtgacgcccagcggcggcagcttctcctcgtcgccctcatgctcgccgccgccgcagaccactcgctggccggcttcttcggcggcgcgccgccggcgtctggtcccgccgccgccgccgccgacaacgacgaggtacgttagagagacatagtatcgttaattactggaaaggttaaagccggcgatttcgttggtcgatcgttctggctaattctgatgttcttttcttgtttcttttggctgatcgatgatgcagaagtgcagccggacgtgcgagtcggagcactgcctgggcacgtatgcacgtacgtacgtatatatataccactctccctggccgatcgat

SEQ ID NO: 36538 - DNA, 6393 bp, Oryza sativa
  unsure (1)..(6393): unsure at all n locations
taatattgcatagttctagaatcgtgtttacaaaatagctttgagcaactaagcatctttaaatgctgtttactgcaaccctaaccctttatattataactcccttgtactcccttgcatttattatgcacttgtgggtgtgtcttgttgagtacggtggttgtactcagtcttgctcaattttttcccaacccagaagaggagcccctagatgatgaaggctttggtgtctagctcgtgcctgccgtcaagcgcctgtggtcgtcgccctagtcttccgttgtttctcgtttgtctttgtgtgtgctgggccttcgtcgcccatgtaataaattatctatttacgcttccgcttgttaaactctgaattgtatcaactcttggtgtaccttgcctcctgggacaaggaataatacacgcacgaaaggaacgcccgttgggttaattccggtcgtgacatgtgaagaccatatttgtgtcatttttttatgtcaattgaatatgacaattaagaaaaaagtgtaatgctttgaacagatgcttgaagtgtaagttgtgtttgtacagattgaaattggtttttgctgcttgaaatgtcatggtctgtacagttttagactgatatgcagtatgtcacttggaacaaatatatatgtacatcactttgcatactgtttcaccaggaaacttactggattacccaaaaaacagaagtaaaatattttctcttctcctgaaatttttgacccaactgcttcacatattgttaggaatatgagttagcaccatgaacctgggaaagaaatcaaataaatgcaaatcattgctggtaacaactctgttcttaaaattgctagctcagaatctcgatgtgtttcagatatacaatggcaaatgagttcacagaataaatcagttgtgacatctcagttacataacacaaaataaatgagtttatagctcatcccaattacatatgacatatcagatagatgacacaactcaagatataatttaatcatcatcggtgtcttccggcatgtcatcttcagcgttcccattgccaatgtcactacagtactgcaatattgtgtcatctcatctgcatcatccctactgtcttcagtcaagttagcttggttgttaaggtcttctaaattagcttcaataatagtaacttctccatcttcctgcaaatggtctagatcctcatcagcattaccttcatgcacttcatgttctgtatcagaacaattatcatcttggtgtacatcaaaaatgtggtcatctttttcagacacattatacatgttcctatgttcgaatttctgcacaattcgccattcgttgcccaaagaggtgtcctgcaagtaaaatatcttcttcgattgagttgctaaaatgaaagggtcatccttgtaccaaaatgattggatgttgatggatttgaaatgcccgtcatccctaactcctcttgtcttgccaacttgattgaaccaatcacaacggaaaagaaccaccgatcgatagatatctagatcagagttatactgcaactcaagaatctccctaaggacaccataaaattcaatgttatccccttcatgtgtaccatcaaccattacaccactattctgcgtttggaggtatttctcacggtcaacagtgctatacctgactccgttgacaatgcaagatgcacaactctttactcggagatcaggaccacatgacaatgcaaatagtgcttcactgaccacccctggattttctttcctcagcttcctgatctgatatatatatatatatatatatatatatatatatatatatatatatatatatatatatatatatacaagaaaaatacacatgttattcccaatttgaaatttcatcaccaaaaaatgatatttttgtaagtgtgtgtcacttacatgagtcttaaaccacctagcaaatcctttttcaagtcttctgtcaacatcatgtgcatcttctttctccaactcttctctatgcatgctgtagcatattatgactcaacaattaggaaaatattatatttaatacaatacatgtgaaataaacctacataaatggtgcttactccaaatatggttgaacctcctcacagttatttagcacataccaaactagcttatccatgatttcatcctccatgtactgtatcctagtggatcctatgagtttaacatcatgcataaaaacagagctgttaccatccaatggcccatccccatgacgggcgtcccgattaaatctagtgtcaacatcctccatgtaccttgaacaaaatgtcaaggtgtcacttgctacataggcctcagcaattgatccttcaggcctagccctgttccgcatggaattcttaaaggtgccaagtcatctttctattgggtacatccatccatattgtacaggacctctaagtagtgcctcatcaggtagatgtacggccaagtgcaccatcacgtcaaagaaggctagaggaaaaattttctcaagtttgcataggatcagcgggatgtcttttttcagtcgtttgaggacatctatccttagatttctactacacaattccctgaagaagttaccaagctctgcaattgcttcgtatatatccttgtccacaaatcctcttatgccggcaggtataattctttggagaaggacatggcagtcatgagttttgagcccctgcaccttggaaccatctgaacttatgcatcttgctaggttggctgcatatccatgtggatacttgacacctttgaggaagttacaaaactcaattctttgttccttcttcaagacatagcgagcttgtgggatgcgaactgagttgccatcctgctgtaagtgcaagttatgtcttatgttcatatcatgcaaatctatcctcgaattgactgtgtcctttgtcttgccctcgattttgagcaatgtgcccaaaatgttgtcacatatgtttttctcaatgtgcatcacatcaagattttgtggcagcaacaaatctttccaatatgggagcttgcacagacttactttgcggctataaattagtggcccttcatcctctccacgttttcttttcttacttgtatcatgcttacccggtctaacatctttcaccttctctaactgctcgaggacctcatctgtgctgaattttcctggctcaacctggttttcatggtgtccatcaaaagcatggcttcttcgccaagcgtgtgtccttggaaggaaacaacggtggccaaagtagcctatcttatttcttagtgctcgtgacaacgaatttttgtcacaatgaatgcatgcataataaccttttgtagttcgccctgacaaggtgcttagagctggataatcatgtatgcaccatagcatggcggcacgaagattgaactttctagcactgaatgcatcataagtactaacacctatccataattcaagcaattcttctatcagaggctccaagaataaatcaaaatcctttcctggagatgttggacctgggatcagtaatgacataatgcagttcgatggatcgacagattcccatggtggtagattcaaaggcataacaagggcaggccacatgctatacgaattgctcaccttgccaaatggattgaatccatctgtagctatggcaagcctcatattccttgcatcttctgcgaaagttcgatactttctgtcgaagtccttccaagcctccccatctgctgcatggctcatttcattatccactggcttccgcttgattttgtgccactgtgtgtcttcagctgttcgttttgatgcaaatatcctctttaaccttgggataagtggaaaatgcctcaaaactttgcgaggaaccttcctgtcgccaaccccatcttcccatctggattcaccacatattgggcatagatccatattggcatattccttccgaaatagcacacaattattcttgcacacatggatcgacacatatccaaggcccaattcacgaagatatttctttgcctcatcataagattttggtaattgacattgagggaatgccgaggacaacaacttcaataattcagtgaaagctgtattgctgattcgataatatgacttgatatggagcagcctcacaagaaaggaaaatcttgaatggttagatcctgggcaaagtacctgcttcgcatcttcaagaattctagcaaaccttggtggctgtccatcttcccctgccgcagtgtatagttcacctattaactctggaactccattgtcatcctcgggttcatacccgcccacatctgtcccttcattatggttagtttcatgtacctgttccaaatattcgacatcttctgtatcaactaattctccatgataaatccaccgggtgtatgttgatgacatcccaaaaatatgtatatggtcatgcatttcttgctgaggcagtgaagtgtggttaagacacctacagcatgggcatggtatgtcaacgtgttcatcaaatctttgtccaacaaattccatgaactgtttcactccctccatgtatgcaggtgtgaattgtctcccatgtatccaagttatgtccatctgctttggcatgttaaaaaaagcaattaggcaaacaaagctaatccattttttaggacagaatattttctaaaacattagatggaacagctggttgctacatgacttaaaccatgttgatttgttcataatactctgacttgtttctctgttcatacaacacaaagcataatctttcatagctgaacttgcatttcatacttagagtaatgtacttatggaaaatcataccttatatctactgaacggcgttggtgatgggctgtgcgcgctgacgataggattgagagaggaggtgctaggataagacggtgggcgaggagcagccgatccgtctcagtcgtcgaggatcccccgcgccgactgggatccctccgcagccccaccgaccaagatcacttcaccgcgccgccacccaccacgatgctccacatcacgatgccggccagcctgtggagccgcccttccctgcaccggtgggataagaaacctcctcctctgcaccgtcccggtggctaggatccgcccccactgagctccgcctgcgccgccgccaccctccctccctggctgtgaccaaaccctgcgccaccgcccccctccctccctgaccaaaccactaggtcgcccgcataaagcattcaatcattcttgtgttcgagaattgaaaggaaaactaaaagtaaaacatcatcagcatgaaagctccttgcagcgtagtggttaagctagaattatggttagtcacaagtcgtgggttcgacccccaagtgctgcagcattttttttagaaaaaagagttcacatgggctgcacagattcacacatgggctgcacaaattcacggactgcacaaatttgggctgcgaaaaaaaagttcacatgggctgcacagattgacacatgggctgcacaaattcacgtggactgcacaaagcatctgctggcccgaaaacgcacctgtgctgcatatacaatgtggggtccaataacaatctggattgccacgtatacaatgtggggtccaatgacaacctagatagccacatatgcaaggtgggaccaacagcagaatagagatttacttacaactgacgaaatatatttcagcatattgtattaataaaggagcgtcataagtgtgttacatgaatggtgcgcaccattttgtgacgaaattatctattgttttatgagaccattttaaatttcgtcatggagtttcgatgtctaccctccgccatgagtgatccatgacgaaacatgaaatttcgtcatagatatgctgtattcaatgacgaaattatacaacgtcatgagcaaaacgtcatagatggatgatttcctactagtgtctccgccggggatctagctaacgaggtggtttgcaagcgagtgagagacaagggattatataggttcgggccgccaggaagggtaacaccctactcctgtgtgtggaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36539 - DNA, 23277 bp, Oryza sativa
  unsure (1)..(23277): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggaaggattaatatttaaacatttaactgtctgactgtctgttttggataatctccataataaaatctaagaacgagacttctgcagacacaaaagaagaatctaagcacgccttatctgtagttaagcatgaaatttccaagcgatctggttaattgtcttcccaaatggttaattgatccttaatttacttcgtccgaaatcaacgaagtctcctgttcagctcggacgtcgtccgttgttgccgcgatcgctaattagcgcatacgcgctagttatttttggcacacatgtacacgtggagcgaactatcttactggcagtgtcgtcagaaacggaaaaaaaacgtgattagcacctaattagacccagatcagtaacatcattcattccgataattttccttctccgggtaattaaccgtatcacgttcacttgctctttttttttacttttcaaatatatttaagactttcaattaaaatttttaaaaactctatccaaaatttaaaactttggacacaaattcaaaaacattcaactcaaaatttaaaaacattcaactcaaatttcaaaaagtttcaactcaaattacgaaaactttcaaatcaaatttcaaaattttcaactcaattttgagatggaagttttaaaatctaggttgaaagtttcaaaatctttagtagaattattttcaagtctggatttgaaagtttcaaaatctgagttgaattttttaaaaaaatttaagttgaaagtattcaaatcttgacttgaatttcaaatctgagttaaaaatttaaaacaaattttcagttaatagttttcaaatccaagcaaagagtttttaaatctaacttgaaagttttcaaatataaatttaaactttaaaatatgtacttaaaaaaatgtcgaacctaggttgaaaagatttcaaatctcgatttagaaattttcaactatgtttgttttagtaaaaaaaaagaagaagagaagaaaaaacacgcgtagaaggaattgtttctggaaaaaaatgaaaagaaaaaacgaaagaggcacggaggttttttttttctgatacggaacgaaaaacggggaaaaaaatccatagctttcttccttccccccgtgctcgcgacttccgtaatcggtgtgtatgcgctaattagccagccgccagagatctcaactattaatgccgcccgagttgtagggataacagagggtgcaggctgcacagtcgatatttcaggtagtaaacgtcccaaaataactcaacctacgatttttatgatgggtttccagatttgttgttgatgggtcatatctcataggtaaatccatcctaaaaataaaatcgaaggttgagttattttgggacgaagagagtaatttagaagcggggtcggctagagttgggatgaagataagcttatttatgtcgtggaggagaggtgatgtcatcgcggcgccattctttctctgtggaagttgtgcatgcgtttactgacagcctgactgataatagttgttcaaattaatcaggattgttggatcttgaaccatcacggataaaatttatgaagaatgagaaggttttttgaaaaaaaaaaatatatatgtaatgtaacatcccggcctagggcttaataagattaatagaatacttatatcaacaagttgcaacttcttttcgggaagccaatctccaaagaactctagggttaagcgtgcttggcctggagcaatttgggatgggtggccgaccgagaaattctttccgggtgcacacgagtgaggacaaagtgttgcagaaaagacatgtgttggtctgtgagggcagtttatgacctatgaaagtctcctatcctacgacttatagaatatacgagtatggtatacctttacgtacacaggttgtttccgtatgcgttgtaggaatctgttacgaattatagaaaatatctctacgggccgggtgatttacaaagtcctacacggaggggatacagcttctattgtgttgtacgggatccgatgtctccaagtcttacttggagatcaagatgatccacggtataaaagggacccccgtggagggggtgcaaggcatcgaatctcatcgccaacacacctaccatagtttacgaagccgaagtatgcggagccaagtcgccgggagatctcgtcgaatatatcgactacgatctcgtcggtatcatcgaattcgtctacttccattgtattatgtggttttccataatcaatcccatgtaaactagattagggctattacccgataaggggcctgaaccagtataatccttgtcttttgtttgcttgatgtcgtattatgtagatcctcattccaactaccccaatacccaactcatccggtctacgagtatcactcgtcgacagtggcgagccaggtagggggccttggtgcccaaggttatgctagtatgacttcaagccatgccgacaacaatgtcaacactggtgtcaatcaagaagcttctatctcgacatcgctggtgtggactcaagtcggatctattgtctttctagtctacaccgttatgccaatctcaactggcccaaaattactatcgggaacgagaacggtgcggttacgacttcgagaaatgacatcttgccgacaattccttccacacaagtggagaacggaatatcgacgaccccaacacctagaaaaaatcctcaagcggccgaattctgtgccccgcatagaaactaagagccgacaaggatatccatcaagaagccgagatcttcgtgtcctatccataaggcatccaagcatactctagaggactacccagtgatactacacgtgaaggctgagttctacgcttgtagagaacatagaattcagcgcacttcaccaaccaatatcacctattgtccaatccataagtctagatctcacaatttcacgagctgaatcttccttaggacgatcaagtgccatgctcttagatccaacaaccacgagttcaacctcagtgtgttgccgaggaacgggacgcagcgacaacctcagatcggttcgtgggatttgtcgatgttgaccccgacgagtcacccgtgttgcatattttggaagaccaagagtcctctccgtcgatttcaccgcgagacgtcaacgtgatcaatacagctgagaccagcacgtccgcggcagctaggacgcctgctcaatagctacaagccctcaactcgatattgagagagccctttcgatcctgccctgaaccctgatgttgattagtaggcagtacgactataagagaccatggccaacctcaatagcgcatttgtagaggcagcaactgagcccccgctgcgagatccaccacgaggaaatagagaactagctaatgggaacgcagaagtataaatccctactggtgaacgttccccctatgctcaatcgccacgagcaacctgagatcccactccaccacctcgcgaaaatcacgatcttcgtgagcatctggacgaccgacggagagaacgtcgggatcagaacaacactgatcgccatcgacatcgttctccctcacgacgaagagagaacaccaattgacaccaacatcagcgtcattctccttcgcgacgaggagagaacaacgatcgaggaggacgctcgaacgaagatcgagactagcaagcccgcaacgaccatcatgacaatggcaataacgttcgtcgtgacggtggcgacaacaatcagttagatcagggagccgacggtcgagctcagggtggcaatggttgagatcaggggcgaggcagtgatgatagacgaggacgtaatcctcgattcccaggatcggaacgggaccgacgatgcgagcatcgttctagaagtcgagctcctgacccaagcaacccctgctcatcatcctcgccatcctcttcatcaggcagacctccttgatgacaccacgggcgcgaacaacccttcgctctaggtggcgggtgtagagcgtccacccctacattgcgagacgtgcggcggcccaaggagttccgaccaggagcaatcgagaagtacggtggaagcacggaccccgaagaatttcttcaggtctaccccacgatcctgtacactgctggtgcagatgacaacgcgttggcaaattacttaccagccacgttgaaaggatctgctcgttcatggctggttcatcttccgccccactcaatctcctcatgggaagacttgttgatgagagatgttttgtcccgatcttccgataggtactgataaatagtcgatataggcggagtcgcgacacaactcgatccggcttctgaatgtacacgctactaagccccgcaattgcagcaccatgtctcctctagttatcaaccgtgccgaaacccggttgacctcaccaagaaggctaatccctgcatgtgaatcgaagaacacaagtaataacaagatagattgcaacacaattgcatatgaatgattaagcactcgaacttagggttccacaaaccgatctagcggtgaaactgttcttgacagattaatctaagcaacacccaaatctaaacgatgacggatgctgaataaatatgattaaggatgtcctagggttgccgtagggcgcacacccccttgggctaaggccacgacacaattacaaggcccaaaacacaaatcagattcggactggatgagatacgttgcttgttttgcagattcccggcagctcggttggaattttgacgtgggaccaaaaccatctgaaagtagactccatatgctttccaacaagtctaatgggccccaaaattccttctcgatcagtggctaggtccgtttgaagttggtgctgtcaaaaggcccgaatccgaatccaaaacgtgtagaactttatctcttatcttctatatatggaccaaaagtgacatggtgagatgtaagtggacttggagaagatcttggtttggtccccaatcaacttttttaatcatccatatattccttacgcttggtcccttttctttcgcccaagcaagtacctctgcaaacgaaaacacacgaaactcattgtgtagcaatgttgttcaaatatataacaaataaatctaatagagaatatatgcacctttggttgattaatacataaggtagtcatggttatatctgagctagttgtgtcctcatcacttgtggcagcaattcatcaccaatttccaagggacatacaagcgtcacgcaatcgaggacgacctgcacgctctaactcagaacccaggtgaatcattgagggactatatccggtgtttcaatgagtacaggaatacgatccccgaaatcaccgatgcttctgttatccacgcattcaagtcgagcgtctgagatcgttacatcacctaggaactggcgacacgatggattatgtctgctcgcaagctgtttgaaattatcgacagatgcgctcatgcagacgatgcctttagacgaaaagaatgaaagagcaagacaggcgaaaagaagaagccagccaataaagacgcactggaatcaagcaagaggagaagtcataagagtgggaagcgcaaatcttcgggagaggttctcgctactgatcaaacagacccacccaagcgtccaaacccccaaaacgatgactcacgaaaacaatgttgccctatacacaaaatgaacgaccactccttggaggattgtcacgtcttcaagaaggagcttgcgcgacatataggaatcgagaaggggaagcgagtatgcggttgtcgaagcgaataccgaagcagccactcctgacttcgactccacattcccggactatgacctcgacgtcacacacatcttcggcggttcttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagactagggcgacgaccacaggcacttgacggcaggcacgagctagacaccaaagccttcatcatccaggggctcctcttctgtgttgggaaaaaattgagcaagactgagtacaaccaccgtactcaacaagacacacccacaagtgcataataaatacaagggagtacaagggagttataatataaagggttagggttgcagtaaacagcatttaaagatgcttagttgctcaaagctattttgtaaacacgattctagaactatgcaatattatttatcaaggccgtcaacccacacaaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccacgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaaatagcgaagcatccacctaacatcatactagaggtaccatgagtagagtgtccactagttggggttttgtttaatctagggtgaacaaggaaataataacaataacaataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatttggatttattgcgtcagccgaggggaggggcgcgcggaccgggtccacgggagtggggcccacgcggcagcctcacggtccacggtggaccgggtgcacccggctcacaccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatggtcgccgccggcgaccaccggcgcggcggagcggcgcccgagagaggggagggaagggggaaacgaatcggcggtccacagctcaccccgggtcgacggcgacgacgggaacggcgaccggagcggaggaaggcggcggcgcggctcgggtagacggggacggcggcgttccggcggtcggcgggcgaaacggaggggtggacgaggtcggcaaggttgcggcgaaaccaaaggaggcggcgccgaagcgggagaaggtccggggcgacgacggcggcggactggagctcggcggtgacggcggagagagagagcgacggcgcgagctcgattccggcggagagagagagcggcgagtggcggaaacggtggagggaggcacggggagtgtttatatagggttgggagtgagagagggcggccggatgagggggaaacgggcgcggaagatccggccgccattgatgcgccggcgaggtttagggggaaagattccgaacgaatccgagggagagagggagggaaaaaatggggggaaagagggagggaatcacggggaatatttcccccctcttgattgcacgcggggcggacgggagcggcgggatttgcggcggcggcggcgctagggcacgggcgaggcggcgggagcggcgggaggaaggggatgacgggtgggccccacccgtcagcgagggtggcgggcgggcccgcccgtcagcggcgcgcgcgcgggaaggaggccgaatgggccgcggggaggaggagagagagggaaggagatgggccgagccggctcaagagggggagggggggaaagactttttaggatttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgtgggaggctttcacaaggattttaattattctaggcataatttcgaggatgtattttagagtcattttgggacgcgacaaacctaccccccttaaacggaatctcgaccccgagattcggaagaactgatgaagagatcgggatgggctgccttcagctcgtcttcacgctcccaagtagcttcttcctcggcgtggttgctccattggaccttgcaaaaacggattacccggttcctggtccttcgctccatggtgtccaggattttcactggcctctccacgtaggtcaagtcttcgcgaacttcaatttgctctgagtcggcctgctgggatggcactcgaagacatttcttgagttgcgacacatggaacacatcatgcacgttgcccaaggaggcgggcagctccaactggtaagcgacttctccgcgccgagcaatcatacggaaaggacccacaaaccgaggtgcgagcttcccctttgtctgaaacctgtgtacacctcgcaagggcgtgacccgaagatacacaaagtcatccactgcgaattccaggtcacggcgtcggttgtctgcataactcttctgccgagactgggccacctttagattatcccgaatggttctgactttagcttcagcttctctcaggatatcggtcccgaacacttggctttccccaacttggtcccacaatagcggtgtccggcatttacgcccatacaacgcttcataaggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattagcttcccctatcggatacaattttcttaggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagcggctttaccttgtttcatattcttgaggagtccatgcatgtccggatcgttcttctgagcctcgcggatttgatcgagcaaggtgggcttggcttccaacgcagccaagaatccgcgacccactatgcttagattcagggcttccatctgttgattaagttcgggtggaatgccacggacgttaagagtgttgcaatggctttttcgactttgagcatcggcgaccacgttggccttaccaggatgatagtgaattcccacatcataatccttgatgagttctaaccatctcctctgccgaagattcagatccgactgggtgaagatgtatttcaaactcttatgatcagtatatatttcacagcgattcccaatgagatagtgccgccagatttttagagcatgaaccaccgcggctaactccaaatcatgggtagggtagttgccttcatgaggctgtagctggcgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagttttgaacgccttctcgcattgcggactccacacaaatttctcctctttcttcaacaactgtgtcatgggtcgagcgattttggagaagttctcgatgaacctccggtagtatcctgccaaacctaagaaactgcgaatttgagtgactgtcttgggttgcttccaatcggtgacggcggtcactgtttcgggatccacagcaactcctttagcggatatcacgtgccctaagaatttgacttcggacaaccagaactcatacttgctaagtttggcatacaattgatgtttccgcaactttcccaacaccagacggagatggtgctgatggtcttcctctgattgtgagtataccagaatgtcatcaatgaaaaccacaacaaacttatccaagtatttcatgaacactttgttcattaagttcatgaagaaggcaggagcattggttaaaccgaacgacatcaccgtgaattcatacagtccgtatcgcgtggtgaatgcggtcttcggaatatcttcttcacggatgcgcaactggtgatatccagaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacgtctccgaactctctgacaatggggatttctgacagtcctatctgatgaagttctgaactactgacagaggttgggggtgcaaagaaaacaaccggttgtttcggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacggcaggactataatactttgctgtcataacccctccaggggtggtgatgagtagagggttcctaagcctttctacccccaactgatttctccccacgaatggcacagatataaacgagtgggaagctccagagtcgaacaaaatggtagcagggatggaatggatgaggaacgtaccaacgatgacgtctggaggcgcttggccttgctggcgcctcgacttcgggcatttatccgcaaagtgcccgggctcgaagcagttgaagcacagacgctgcggaccttgaacgtccctgcggccttgaccagactgcgcggctggcgtaggaggacggggcgcatgggtcccttgctggctctgctgttgctgcggctgtgggacgcgcaccacgaattgaggtcgaggcgcggagcgaggttgctgctgctgcgaggaagatccccctggatagggattggtgtagcggatcctttggttagcaccctgttggttgcggaaattcgccaagcgacgcttgtgcgactcaagttccttgtgcttggcttccaagcggatgctcttgtccaccagacgttggaaatccggatagtcaccggagactagacggacagacagctccgggtccattcctgccaagaacttctcttgcttctcctcatcttcccgcacatcctccggggcgtaccgggccaagttgttaaactcatgcaaatactccatcacggagcggttgccttgcttcaactctcggaactcccttttcttaagggccatgactccggcgggcacatgggtcctccggaaggcggcggtgaagcgggcccaagtaataggctgcccctctggctgcgtagcctggaaatgatcccaccatagagatgcgggtccctgcagttggtgggcggcgaagacgactttctcctcatcgctgcactgcacagtgtctagctttttccccacggcatgcaaccaatccaacacatccacggggttgttggagctagagaaggtaggtggacggatgcgtaggaactcggcgagtttagagtgttgtgggggtggtggtggagcattatgttgtggcggattttggatgtggtggaggaaagcagccatcatgttggcctgctaggcgaggatttgggtgagaatggcgttggtgtctggtggtggtggtggaggcggtggaggaggtggaggtaggctgccatggttgttgtggttgctgccttcaggttggttgccatcactggtggcagcatttctcctggtcgtcaccatctgaaaaccccacatagaaccagcaaacagagagagctgacaattaaagctaaccatccacgactaccataactcttgaatttattactgctattaaattggttcattaaagttcaagttgcttaagcaaataaaataaagacaggctccgacacagttatgccacacaccggcataaccatgccccacaagatcccaacaagaagacaaacgagaaagaacacacgcgcaagcctactaactgctcgtctaccgctgcgacgggccaggacggaaggtgagcaacagcgcatcctccgtgctaccgacgccggaggcttccccctcctgaggaaccacgggcgcgggctcggcacgaggggtctccacgaagcaagtccacgccagggactgacgaacaagctcgggcctggaggtgctctttcgggcggtgatcttctggctgcggcagacgcggcgacgcttggggtgacagacctctccctgggcgatcttgagctgatgcagctgtgcctccactgcgtctaggtccttcttcagctgcagattctcctgacgcagctctaggatcttcaggttgttctcgaccatcccacggcgcaccatctgatggaagtcgatacgagccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcagctcgtccgggtagcgctggtgaagagtgctgatggcgaggagagcggcgctctggcaagcggcggagaaagaatctccacccgcggtgactgccaacgaagtccgctcgggtgagccagtgaggatcactgcagtaacctcccaagcagcgtgggctctgcatcgtcaccctcctgctccgggagcggcctgccctggtagtccagtccatgcggataccccaggacaacgcacataccccgcagctccaagacgaaaccagtcatgtccagaccacgacgactgacgctgccggccatctacaaacaaaaacaaaaagaaaagcaacatttaaaagtcagattttggcgataaatgaagcagcaggacagagagagactagagagttttcacaaatagcaaaggatttttatttttgataatattgctaaggcttgggatctacggctcatcctagggtcaagggggctctgataccaacttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcgtaagactagggcgacgaccacaggcgcttgacggcaggcacgagctagacaccaaagccttcatcatccaggggctcctcttctgggttgggaaatgtcgcgaccgagaaacttgcattttcccgaacgctagtgtattaatccctgtcccaggaaaagccggggtacaccatacaaacatgatataaaagacacatctttattatatcgataatatttacattattacaaaggcacttaaggcctgacaatcaaaaataaacagcagcggactagcggtcctacggcttcatcttcacaggcgctcaactggggtgtaagccaagactccacctaagacttcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacagcatttaaaagtcacttagttgcccaaagccattttaaaaagacgatcctagagctacacagtattatcaatcaaggtcgtgaacctgcacgaacctgccttaacccaaggcctacgatgattcagaccgaactggcaacccgaccctgggtcccagctcgtcccaagccaacccaggccaaccattccacattttcgttgttgagcaaattttaagaattaaaacactaacttgggtacattgcttggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccacctacggccggaacctccgggacaggtaggcaggattgagcccctagcagcaggacaccagccctgtgccatgacatctcgactaccgggccgcagctcgtgtagccttcatttgtcctagagatgtccatcaacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatacagggggcggcgtgaatccaattccacaataaaccaacaattccaaagtgtccaggtgttatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaaaaataacaataacaataataataaggtcagaacaaaggtagataggcatggctagataaaacagtgataacgcgggaatttaaataaagcgataatgcaataatttaaagcaacataattttataaactgggattcaatatgttcaaggatgatgtgacttgccttgctcgctttcccaaacgccggcttcaacttccacgaagagcggatcctccgaagctgcagcgtctacacgaccaacggaaaagaaaaggcttttactctaataaactccatataacaagcagaaacaaagcacaaaaatgggttcttgacttcttagggaaaaattagagacttgaacggtccaattccgagttcaaatggccaagttacggccatttgaagtttatatgctctttaaatgaatatttgcgaatttcttcattcaaattttaatttaaaatggatttattgcgtcagccgaggggagcggcgcgcggaccgagtccacgggggtggggcccacgcggcagccccacggtccacggtggaccgggcgcacccgggctcacaccggccggcgccgtgggtcccacgcgtcagccgcacccgagggcgcgggcggctgatagccgggccccacgcggtagccgcacggtgcgcccgaaggcggccacgccggcgcagcggcgggaggcggcacgcccgcgcccctatggtcgccggcggcggccataggcacggcggagcggcggccgagagaggggaagggaagggggaaaagaagcggcggtccacgactcaccccgggtcgacggcaacgacggaaacggcgaccggtgcggaggaaggcggtggcgcggctcgggtggatggggtcgacggtgctccggcggtcggcgagcgaaacggaggggtggacaaggtcgccggggatgcggcgaagccgaaggaggcggcgccgaggggagaggtggtccggggcgacaacggcggcggaccggagctcggcggcgacgacggagagagagggcgacggcgcgagctcgattccggcggggagagagagcggcgagtggcgaaaacggtggagggaggcacggggagggtttatatagggtcgggagggggacagagcggccggacgagggggaaacggcgcggaagatccggccgccattgatggcgccggcgaggttaggggagaggtttccaaacgaatccgagggagagagggagggaaaaatggggggaaagagagagggaatcacggggaataattcccccctattgattgcacgcggggacgacgggatgcggcggattcggcgacggcggcggcgctagggcgcgggcgaggcggcgggagcggcgggaggacagggatgacaggtgggccccacccgtcagcgagggtggcgggcgggcccgcccgtcagcggcgcgcgcgcggagagagggccgaatgggccgcggggaagaggagagagagggggagggatgggccgagccggtccaagagggggaggagggggaaaaaggactttttagagcttttcgttttataaaatcattttaactttgtttatttcttaataattattatttgtgctctgaaaattccactaaaatttgagggctctttttagaccaaggagaatttaacaaaaattctccgggccacctttgaatttttcttgtacgtattttagtgtttgccaatttcttttcgaattttaattaattatattattccttttagaaaatgatttttatttcgggatgaatttatcaggacgtgacaaatccaccccccttacaagaatctcgtccccgagattcgaggaggctagcaagaagataggttgggcagtcttctcttcttgtttgacttcttccgctccgtcttcacaaactttcagcaaaacttcaccactcggaactgcttggcttgaccttctgttgcggatggaatcttctcttcacctgacttgaaccagggtgcaccttttagctgactcagactaggttgcggtagtttaatgatgcttccgttccagaacttctcatgattcatatcttcggagtcaacctcatacaagttaccacttcatgtcatgcgtcaacactagcttgtcattactaggataccatgtttgtcatcataagaatatcatgcttgtcatttacttctaacctgccaccaactgcctcatattagctttcctggtctccgggtgatagctacttctgctatttgatgcaagggtcgataactttgcctttgaattatgcttcccaagagaaccaacttatcccacttgacatactttgacgtcttcccaaatggctttactgctggatttgttattgtctaatcattatcctgccaaatctgaggcttcgttgttagatgtgattttaatctgacctctgtagattatcttcgaacatatcacttgattcataactgggaatagctctcacgaacaagcaactcggattcactttctttatgttcagtttactttccactattctcttcatgttgtcatcatttagcattcaacgtattcctttacaccttcagccttgatgtgttctttctcgatggatcgattgctaggaaagtgcgttgaacgatactagtgcaagtgcttttattctagtagcatctgatacaaagcccaaggttgaaccgagctttagattccactgttccggttttacttcttgacttcttggtcatgtcacaaaagtttccatccttgtccccatagaagtacttctacctgtggtcatctctcttactcgtgaattcacctactttaatgacagggcaactgttgtagggttgattgctatcgggagtcttcctcgagtgacacaaatcatggttctcgttatcctttatcaatcacctttcgtcctacttcttttcccagtaaccaaacatcttttccgatctcttccattaatcacctttcgacctttctcaaccaggtactcttcgctccgggtgttgaggatgcttctggggcaatgaggtccttgggcgtgctgtctttcagagaaaccttgaagtagttcgtcaaaagctagactgacgattgttgcctttgatccaaagaagacacatctgaaacacttagtccaaacatatgtctctttggttaatcacttgattttcttttccatcatcaggttggttattaactcaaggttcgaacatagttcctctgaaatgagaccctaggtctcctttatcagcaagcaattatacacataatcacatatccgcatcttccaaaagaatcctcatagaacttgtctgtattacacatttctccctcattacatgaatactaagcactgcctaaaaggaaaggtgcttagcatcggtacattgtttctgctatgggttctgattaacacgaggcctcacgggtacggcgtttgctccagtgaccacaatacgattgggatgtctgcttcgtgtaaattggcggtaatgtggaggtcgactttgccttgattgcaggcagtccctcgagtaatgccctggttctttgcaattgtagcaaatcaacgtcttctttgctgagctatccatctggggacgatcattctgacttggagttggaattggtggttggaaatccttgctaacattggcatcagtggtaccatagttgctatcaccattggagtctttctcagagtcacaattgctagggttgtcattttgggtgccatcattgatactatcgtcgacaccttggtgaatgatgttgacattgcacgcttgatttgagtggtcactaatggggcaagaagcatggttggtgggggtatcatcatcattagtattgctaatgtggttgtctgcattgtgtccatcttcttggggcggaaactcttgatgcgcaacagaagatccggtgatctgaagtggctccgtgcgctgtctttggttaccactgggaatactgggatgctgacaatccttctcttacagttcttcatccgattatgctcactttcgagttgtatggctttgtccacaagtttctcaaaatcttcatattcctctaggagtagttgcactgcgatctcatcttttaacccctggagatacttctcttgtttgtcttcatcattttccacatcttctggtgcatagtgagccaaacgatggaactcgtgcaggtactctgtgacggtcaaatcttcttgcttcaggtagcggaactctcgttttctcagtgtgatcattcctgcgggaacatgggatctcttgaatacagatgaaaactcgtcccaggtgatggtatgtccttctggccgtgatgcttcgtagctatcccaccattctgaagccagtccaaccaactgatgagttgcgaagacaacccgctcctggtctgtgcactgaatcaaccccagcttcttctcgactgtgcgcaaccaatcactggcttccataggttcgacgacaatggcaaaggttggagtctcagttttgagaaattctgataacttgcactgttgctggactgtaggtacttgaacgttggttgcccctgctgggtagttccaattctgtaatagttgaaaggctgttgccaacatgttggtttggttaaccacaatttggattagctctggtgaggtttcgttgatgcttttctcattcccattggcttgggttcttcatcttgtacttgatttcttggctactgtgctggaacatccaaaggtacaatgccgatactggcctctgtcttgtcaactggtggctggggctgaaattgagcattgacaccttgtggtaatgcactcgctggagttggagctgttgcaacgcgggctataggactgcttcgggatgcatggatgacaattcgctgaggagcaagcttctgattgcagggagttgcgtggactgacgtgctggcagctatgtctctcggttttgggcacttgtcggcgaaatgacccattccttgacaattgaagcaacagatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagcaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttacgttccattttattctggttgaaaccttggggagacttctcatcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatctttggttcgcattggtgtttttcttttctgctgaggacactcccttgcatagtgcccttgctcatcacacataaaacaaatgatacttgcttcttttgagtcaacatgtggcacgtcaccatgggtccttcgggatgctggcggcatgctgactcgtggtgtgagtgcttggactgcctccaactgcacttgaggttgtatctgactcaggttcagaattggcgtctgatgctgctgtagtatctctataagcaatcggttatggttaatcaggtgttggaccagtgtcacacaactggtgtctggtgcttcattcactcgggagcttgaggtaccgatgtcctgacttctgaccttattgcctttctcattgtcagccatctgttgcaaaggtttggagagggagagaggaaaacaaaggggagagacagattagaaactaaggataggaccttaacagatctaagtcttttgctgttatgatgtatgttaggcttattctgcaagttgattaagcaaacaacttagcatggttacatcacaacccactgatgcaaaccacgcgctacacacacaagcaaggaaacacacgacaaacgaaacactagagggtggcttaggttctgcgacgggttctccaagatcttcactcctgcttcacagctggcttcactgcttccttcacttcactagcggatcctgcagccttctggagcttcggcagacaattgacgacatcttcttcttcacaaagctgaccaactagtactaattgaaatccgaagaaggaagaagggagtaaacattttgcaaatagcattaggggaaggagaaaaaaaggaactttcgcaaatagttttatttataaaatatgtccttaggttttatccacttggcttatcctacagtcgagatggctctgataccatcttgtcgcgaccgagaaaattgcattttcccgaacgctagtgtattaatccccgtcctagaaaaagccagggtacaccatacaaacatgatataaaagacacatctttattatatcgataatatttacattattacaaaggcacttaaggcctgacaatcaaaaataaacagcagcagactagcgggcctacggctccatcttcacaggcgctcaactggggtgtaagccaagactccacctaagacttcttcttcaaagcttctctt

SEQ ID NO: 36540 - DNA, 1117 bp, Oryza sativa
gcccgtcagaggcgcgcgcgcggagaaagggccgaatgggccgcggggaagaggagagagagggggagggatgggccgagccggcccaagagggggaggagggggaaaaaggactttttagagcttttctttttataaaatcattttaacattgtttatttcttaataattattatttgtgctctgaaaattccactaaaatttgagggctctttttagaccaaggagaatttaacaaaaattctctgggccacctttgaatttttcttgtacgtattttagtgtttgccaatttctttttgaattttaattaattctattattccttttagaaaatgatttttatttcgggatgaatttatcaggacgtgacaggaaaaaattgagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtgaacccacacaaacctgccttaacccaaggcctacgatgattcagaccgaaccggcaacccgaccctgggtcccagctcgtcctaagccaacccaggccaaccattccacattttagttgttaagcaggttttaagaattaaaacactaacttgggtacattgctcggcttgcccataaccgagggcgcggctattcgaatagattatactctgatcagaggtgtacatctttacctacaagacacatcttcctcacgtgcaaccacgtgccacataccaccacggtatacagacggaagacgtgacatagtttccaacctatcctagccatagacaagagtaccgacccaattccacctacggccggaacccccgggacaggcaggcaggactgagcccctagcagcaggacaccggccctgtgccacgacatctcgactaccgggccgcagctcgtgtagccttcatttgccctggagatgtccatcgacccccgacttcatccatctccatccgtgtacttttgtttataaccagact

SEQ ID NO: 36541 - DNA, 30816 bp, Oryza sativa
gggaggaaggggatgagggtggggccccacccgtcagcgagggtggcgggcgggcccgcccgtcaggacgcgcgcgcggggaggaggagagagagggaaggagatgggccgagccggcccaagagggggaggggggaaaagactttttaggatttttctttttataaaatcattttaactttgtttattttaataattattatttgtgctctgaaaattccactaaaatttatttacgcattttaggcttttaggaaatatacaaaaatcctccaagccttatttgacttttaactttgcacattttaattgtgggaggctttcacaaggattttaattattctaggcataatttctaggatgtattttagagtcattttgggacgcgacagttctacatcgtacacgtcgaagagggagtacaagatgatagaatgcgaagtctgctccacattacaaggggctactgccaagatgaaatggtccaagcacaagattgagttctcagaggcggaccacccaaagatcgcgaccacacccggcagatatccgatcgtggttgaacccaccattcggaacatcaaggtggcaccggttccgatcgatggcggtagctctatcaacctgcttttcgccaataccttagatgcaatggcgattccacgaagcgagttgatgcctatcaacccttcgatgggatcactccagaatcatcatctaagccattgggtaaaatcacattaccagttactttcggataagccgacaacttccgaacagagcagatcacctttgatgtcgcggaattcaataccgcacatgacgccatcattgggagaactgtgctcgtgaagttcatggcagcatcccactacgcttatcaagtactcaaaatgccaggaccaaaatggacaatcactacccagggagacgccaagttggcggtgcagtgcggcaagcggagcctcgacatggtcaagcatactcccaacccatccaccacgactgagctgcccaagaaagtgagcaagcccaacaagatgccaaaaccagacggcgcaatcaagatcatctcgctgaccagttccaaccccaacaaaaccatcaagattggggcagcgctggacaacaaataggaactcgcattcatcatcttcctctgcgacaatgtagacgtgttcgcttggcaaccgttagacatgccgggagttcccagggtggtgattaagcacaagcttatggtgcgaccccatgctaagccagttaagcaaaaactgcgaagattcgcacccgatcgaaaacaagccatacgagaagaacttgacaaacttctcaaagctggcttcattagagaagttctccatccagagtggcttgctaacccagtaatggtacgcaaagccaacgggaagtggagaatgaacgtagatttcactgatctgaacaaggtgtgtcccaagtatcacttccctctacctcgaatataccaacttgtagattcgacagccagctatgagttcttgagttttcttgacacttactccagctaccaccagatcagcatagccaaagaggacgaggagaagacggcattcatcactcccttaggtgtgttctgctataccaagatgccatttggactaataagcgcagacaacacatatcagcgtaggatccagggggcacttggcgatcaactcagacgaaccgtcgaggcctacgtcgacgacattgtcgtcaaaactaaaacaagagactcgttgatcgatgaccaaagggaaacgtttgataacctccgacgatatcaaatgaagctccacccggagaagtgcacgttcggagtaccatcagggaaactactcggcttcctagtctcgagacgaggaatcgaggccaacgctaagaaaatcaaagcaatcgaaaacatgaagtcacccacaagactcaataaggtccagagattgaccagatgcatggcttcgctaagttgtttcgtcacaaggatgggagaacgaggacagccttttttcgccctgctcaagaagccggacaaattcgagtggacccaagaggccgagaacgcgttcatcgcgctcaggcactacttgtcaaacccccctatactcgttgctccacaacttgataaagaattatttctatatatcgctaccatgtcttattttgtgagtacggttattgtcattgagaaggaaagagtacaacacccagtgcactacatcagtgaggccctccatgatgcaaaaactagatacccacagattcaaaagctgctctgcgttgtgaccatgacgtcaagaaagctatgccactactttcaggcccacaaagtaacggtcatctcttcttttccttagggagaagtcatcaggaacaaagacgttgtgatccgtatcgccaaatgggtagtcgagttatgccaattcaatgtccattttgtcccaagaacaaccattaagtcacaagtcctcgccgactttgtagccgattagactatcccagaagatagaccagacgatcaaacagataacgaaacttggactatggcgttcgatggcgcactcaacagccaaggagcaggagcagtattcgttttgacatttcccacgggagttcagttcaaacatgcaatccacctcaatttccgggcaacaaacaacacggttgagtatgaaggacttctcacaggaatacgagtagcttccgcactcggcatcaagcgactgattgtgaaaggggatttagaattagtcgcgaatcaagtgcataaagactacaaatgctctaatccagagttggccaagtatctcaccgaggtcgacttgatcgaagttcaacatgtctaccgcaaagacaacatcgaaccaaacaacctcgcacgacacgcgtcaagatgagaaccactggagcctggaacttttctggaaaaaggattgcgggtgtaaggttaaatcaactcttgttgttagagaaggaatggaaactattggtaataaacccattaaacaaattcacaaatattaatactacttttttaatgcatctaaagtagatattttctaagcaatgcaatacacaatatctatgtttctatttccttcacctaataaatttcgatccttttgcatagagatgggcattgggtgtggaccaaccttaaactggagtgaggaagtactacctacaattcagcccacaccttctaaaagtgctatgagtggtcggtctccccatgtgatctttttaatttttccatcttttttcccctctttccttttttggcaccatagtaagttttatctaccttgggtttatacgttgaaagtttatatacccgtttcaattcgaatttagattctaatctttttatatttctaaatcaaaagttcacatactattttcaaattcgaatttggtttccaacattttttacacaatgtttctacacataaagtactttatatgtgcaaagtttataatgcatatattttttgtgtataaaatctatacacaaatactccctctgggctgataatacttgtcgttttagacaagggtgaggtcaaattttagaatctttgattataaattatttttaaaatatttatctttcaaatatggtgactacatgtatagattagtcttgaaaagtactttaataaaacaatatatttgttaacactttttgtcagggttacgggtaaggtataccctttacccttcgatatatgccgcgtatcggtatggtatacctgcgcatatacggacactctctgcatacattaagggaatccatcatggagttcacagatggaaagagtcctactcggacaagactgggtcgtcagtgcatcgtgcagggtccgatgtctccgagttctacttggaaacggcgtgacctgcgatataaaagggatcccctgggaggacctaaagggggaatctaatagccaacatcaccaccacagcctacgaagtcggagcctgcggaagccagattgccgagaggtgtagtcggattaacccgatacgatctcgtcggtttcatcgagttccatctttccctttgtaacttgtgatttccatcatataatcccataccaactggatcagggctattacctatcaaggggcctgaaccagtataatcttcgtcttctgtttgcttgatgtcgtactacgtagacccttgtaccagcgtaccccaatactctctatatccggtctacgggtatcacccgtcgacagtggcgcgccaggtagggggacttggtgctcaaggttctactactatgtcatccagcctcgtcgacaacagcgtcaacaccaacctcaactacgggcttcctgcctcaacaatgctagcgtggactcaagtcggcgaaattgtctttccggtttacaccacgatgccgatctcagctgggccatcgatgaccagaaacgagaacgcagtggctgtaacccaagacggctccacgtcgaaagttcctcccggcgaagtagagaacggaacatcgacgacatccgaactcaagaagaattctaatgcggccaaaccttgtcgttccgacaagaaacacaagctgacgagaataacttccaaagcgacagggtcctggtgccctattcagaaatccaggaaacatactttgcaagcctgctgggttttcctcaacgcccgcaccaagattcgcgcctgcaaggagcgtggaattcagcgtgtttctccaactcgtggtgtgtattgtcctattcacaagacaaagaaccacgacctctcgagctgtaaattttttctcagcgtcacaaagatgccatctcccaaggttcagcagccaggcaagacccttagagacgaagacaaagaacgaggaatgacgctgaccccagattgtttcatcgatgttatcgacatcggttcttccgaaccgttagtcctgcacctacttgaggactacgactcctcgtcgacaagtacgcgacgtgaggtattggctatcgacgagacaggcacattggcacgcgctaacaccggggcggaaaatatgacgtctacaccggctcagcacatcaggaccctcaacgcaatactgagggagaccccttatgaccccgttctacacgatgacctcacacaatagacggaacggttacgggagtcagtgaccaacctcagcaacgcgttcgaagaggccgccgctgcaacccacccggaacagcaaccaactgctggtgccaatggcgaaaaccccgaacagcgggaatcaccctatcgagccagccctccacctcacggcaccagcaatctctgtgatcacccaaacggtaaccgagaagctcgtcgcacacgggaaaacgagaaccgtccccggcatcacgtttcttcacgacatcacgacaatgaagaacgaggacgccactcgaacgaagaccgagactgtgatcaccaccacaaccgtcatattcgcgacgatcgtgagcgacggacgccggccgataccagtcgagggcgccgccatcatgacgaagacgacagagaacggcgccgggacaacaacggagggcgacgacaggattctcgagaacacggccggcgttctcgtaatcctacaccagaaccaagcgacccatcgtcgtcctcatcttcttcctcctccacatcgtcagacagacatccacgaaggacatacgatcgccgacaacccactgcccccagtgctgggtgtagggctttcggtcgttcgttgcacgatgtccgatggcctaagaggttccgaccgggagcagtagagaagtacgatgggagcactgacccagaagaatttcttcaagtctactccacagtactctatgctgtcggatcggacgacaacgcgttggcgaattatttgccaactgcgttaaaaggctctgcgcgttcatggttgatgcaccttccgccctactcgatttcttcgtgggcagacctatggcagcagttcgtcgccaacttccagggaacctacaaacgccacgcgattgaagacgacttacacgcattgacacagagctcgggtgaatccttgagggaatatgttcggcactttaatgagtgcagaaatacaatccccgaaatcaccgatgcttctgtaattcgcgccttcaagtccggtgtcagagatcgctacactacccaggagttagcaacgagacgcatcacaactactcggagactgttctagattgttgagcgatgcgcccacgttgacgatgcacttagacgcaagaacgacaagccgaagaccggggtcgagaagaaatcaaccacggacacacctgagtcaagcaaaaaaaaaaattgcaagaacgcggaaaggaaagctcaagcagaagtactcgcagcagaatatgctaaccctcccaagcgcccagacccacaaggtagtgacgcaaggaaagcatggtgtcccatacacaaattgaacagacattctttggaagactgccttgttttcaaaaaatcgctcgagaagcacatgacatcggaacaaggaaaacgagtacgcgtggtcaagaaggatacagagatgaccgctcaggagtcggacccagcgtatccagactctgacctccacgtctcacacattttcggaggctctagagcgtactcctccaagtgagagtatgagaaaatggagagagaagtctgctcgacgtggcagggggctgcacccaagatgaagtggtctgaacagaagatacaattttcggaagatgaccatcccaagaccgccgttatcccaggacgctatccgatcgtggtcgaacccactattcggaacatcaaggtcgcgcgggttctcatcgacggtggcagctcaatcaacctcctcttcgccagcacattggacgccatgggaataccacgaagcgagttgacacccactgatcaacctttccatggaattactccccagtcttcgtccaaaccaatgggcaaaatcacgctgcctatgactttcggccaagcaaacaacttccggacagagcagatcacctttgatgtcgctaaattcgatacagcgtataacgccatcatcgggagaactgcacttgtgaagttcatggccgcatctcactacgcgtatcaagtgctcaagatgccagggccgaagggaacaatcatcatccaagggaacgcaaagcgggcggtacaatgtgacaagtggagcctcgacatggtcgagcaaacaccaagtccacccgccacaaccgagccacccaagaaaatgagcaagacaaacaagacgctgaaaccggacggcgcaatcacgaccgttcctctctctagtgccaaccccgacaagaccgtcaagatcggggcctcactaaacgagaaataggaactcgcgctcatcaccttcctccgcgacaatgctgacgtgttcgcttggcagccgtctgatatgccgggggtccccagggaggtgatcgaacacaaactcatggtgcgacccgatgccaagctagtaaagcaaagactgcgaagatttgcaccagaccgaagataagccatacgagaagagctcgacaaacttctcaaagctggctttatcagagaagtacttcatccagagtggctagccaacccagtcatggtgcggaaggccaacgggaaatggagaatgtgtgtcgacttcaccgacctcaacaaggtgtgccccaaggatcacttccctcttcctcgaatagaccaactggtggactcaacagccggctatgagctgctgagcttcctcgacgcttactccggctaccaccaaatcagcatggcgagagaggatgaagagaagacagcattcatcacactgttcgaggcatacgtggatgacattgttgtcaagaccaagaaaagcgactcattgattgatgacctacgggaaatgatggacaacctccgacgatatttccccatgctcaatccagagaagtgcaccttcggagtaccgtcgggcaagctgctcggcttcctcgtctctggtagaggaatagaagtgaatcccgagaagatcaaggcaatcgagaacatgaagtcgcccacaagactcaaggaagaacagaagctaaccggatgcacggcagcactaagcagattcgtcgctaggatgggagaacaaggacaacccttcttcgctctgctgaagaagcaagataaatttgtatggacacaggaagccgaagaggcatttattgcactcaagcgctacctatcaaatccccctgtactcgttgctccccaacctaatgaagaattattcctttatattgccgccacgccatactccgtcagcactgtaattgtcgtcgagagagagaaagtccaacgaccagtatactatgtcagcgaagctctccacgatgcaaagaccagatatccacagatccaaaagctgctctacgcagtaatcatgacatcaagaaagctacgacactacttccaagcccacagagtcacagttgtctcctcattccccctcggtgaagtggtgagaaacaaagacgttgtcggtcatattgcgaaatgggtagtcgagctaagtcagtttgatgtccactttgtaccacgaacagccatcaagtcccaagtactcgccgattttgtagctaactggaccatgcctgataatcaatcaaacaaccagatcaacaacgaaacgtggacaatggcgttcaacggtgcactcaacagccaaggagcaggggcaggattcatcttgacatctccttctggagatcaattcaagcacgtgatccacctcaacttcagggcgtccaataacacagccgagtacgaaggactactcgccgggataagagcagcagccgcacttggggtcaaacgactgatcgtgaaaggggactccgagctagtcgcgaaccaggtacacaaagattataaatgctctaaccctgagttatctaagtacctcgcaaaagtcaggaagctggagaaaaggctcaatgggatcgaggtccgacacgtataccgtaaggacaacatcgagccagatgacctagcgcgacgtgcatccagacgagaaccactcgagcccggcacttttctggacatcctgacgaagccatcagtgaaagaggcaatcagcgagatcaacacagccgcccccgacatcagctcggaggccacagaggcggaacgcgccatcgccgatatcgagaccacagacgacttgcacaccccaccgatcaaattcatcaacagcaaagagttgcccgaggacgacgcagaggctgagaaaataacccgtaaagcaaaaatctactacatgatcggcaacgatctatacaagaaagcgccaaatggagtacttctcaagtgcgtctcgtccgacgacggcagacaactcctcctcgatatacatgaaggcatctgtgggtcacatgccgtcggtcgcacattggtcgggaaagcctttcgacaagggtttttctggccaaccaccctcaaagacgcatttgacatagtccagcggtgtgaagcctgtcaattccacagcaagcacagaaagctacctacacaagcgctccagaccatccctcttacttggccgttctcgtgctgggggctagatatacacgggccattcccacgaggacagggcggctacaagttccaattcgtggcgatcgacaaattcactaaatggatcgaagcggtacccacgggggaaatcaaggccgccaacgccatcaagttcatcaaggggatattttgcagatacagactactgcatcgcatcattaccgacaacggctcccagttcatcagtgccgacttccaggatgactgcatcgggctgggagagtcaaaatatgcttcacttcggtttcccatcctcaaagcaacagacaagtcgagagggcaaacggcatagtactacaagggatcaagacccgtgtctacgacaggctcatgtcacatgacaacaaatgggtcgaagaactcccatcagtactatgggccatacgcaccacaccgacaacgtctaacaaggaaacacccttcttcctcgtgcacggctctgaggccatgctccccagcaagctacgacatcagagtacacgagcacagaagtattccgacgaggaacaggaggagcagcgaaacgacgatgtaaatctactcgaggaacatcgcaaacgagttgccgttcgagcagccgcctaccaacaagcccttcaccgctaccacgagaagcgcattcaagcacgcatactttcgatcggcgactacgtcctccgaagggttcaaagccaagcagggcgaaacaagctctcacccaaatgggaaggaccatacacaatcacacaagtcttcgaccaggcgcattcaaaattgcagacggtgatagccgcgagttgttaaactcatggaacattgaccaactacgtgaattctatgtatgagtcaataccatccatacctgtaagacaacttacatcatcaataaagcctattttcaggcgcatattacaatcacagtgtgcctacctgacgatccctcacccagatgacacctagcgttgaaacctatcctcatgtccctttacgccatgctgacaaggcgtccgaggaacctaagggatcttcggctggggacgcccagagccgataaggccttgtcggattctgtagagacgaaagaccatgtcagacctggttgtgtaagagttctccccgcgcgtattaaccaagccgcgtaatcggaaatgaactttccaacttcgcggctgggggctaggatcagtgcttgttcaaccgaggcaggtcaaaggtccaagagccttgtcctccaagaaccattcttcgacgacaaggctgggggctagggagagtgtacaactcaaacgatgcccaaagtcaagaactgaggaggcactcttacacactacatccagagtaagaaggactcattacgatagatttcttttctatttcataagatacttcttacaattccgcacaagtccaaaattatattacatttttccctaagatgtctattgcagggtacaaaggctaccaggaaggccaacaccagtccatcgactggaaaacttcctccgcaagcggcgccatcgacttcgccaggtggtctatctccgccgaagtcctccgagaatgagcgaacccttcacggagaaactcgaggtgcagctgcggacgatgatctcgtatgcaagccaacacatgccctccggcatatcggctcaaccgacggcattcctgctttagggcttcgtcaatgcgcttgccgatgccttcgagctgagtacatgccccattcagccacgagatgtagccggccgccgattcctcgggatctcctcggggcacccggagctccctacaaacatgggccatgaacgtgcagcaactctttagataagagtcgaaccacacctcgcgacccctaagtgcctatacggcctggtcttttttcacctccaccatcgccctctcgagttccacgacttcacacttcgtcttccaatattggatgcgacggtcttggtcggcaagtctactctcgaggtctgctcttctattccgagaacacaaaaaccaagttactccgggaagaagaatgaaggagatgaaaaaaagatcaccaacctaaggaggtcatcaccacgcccgtttccacgggtgagttttgtcccatatcgtcctgcgacacaggcgtttggagggtaatcgccggggcgaccaccggtaacttgggctgcccacgctgctggacatcctcgacatcgacatccctacaaacgacaaccaaaagtactcaggaccagggtgccaacagagatcaaggcaacgattgcacgaataaaggcagttgaagccgacaactgttatacaaagtgtagtcgattacaaatgatctgaggccctactcttcaaaaagcgggagaatagactctcccagttcgccaacctcctccatcacacccttacgagcgtcgttggcggccccccggtccaagatctgccgaagatcgcgttcggggtgcgccagtcggacacacgctaggacgtgataggccccagtgtaaatcccgtttgacgcctcctccacgatgctggctgcatgcttggagggtatcgcctccatcgccgtagccagttccgcaagtgaagacgtcagcgagaactcgtcggggttcgctgggatggttgtcgtgacgccacactccccggcgagctgatgaagactggtgtaggtgacccgcagcgacccacggatctccgacaggttgttctcgagttccgacatccggtcttcgagtccccgccgttgccgctcgttaccggccaccagctccctcatcttctggaggtcctcatgaacctcccccaggtcgcgttccagcttgtcagcacgctcgttcgccgacgacgctgccgctgtcttcgcctcctcgatctcgcgactcacgccgcaagtgccagcctcgaggatgcgttgcatctcagcttggagctccccccaggtgaggacattggcagatggcccgcgagcaggtccgagggcactggacagaccgcttggcgtcacttcacggctccttggcgcgacaacaacatcggttgaggttgccgcaggagacgctccggaggccccttcggacttgtcctgcgccgctctcgcctgcgccacccttgcctgtgccgacctgcagaagatcctcaaatcaagccgccagaagataaatgaggagaggatctcgacttctgcttactcacttctcgcctagcgtcaccagtttcctccgccgcggaggtggcgaagacgcgtccacgacctgggtaaatcaagcgcgagttgagggtgacatctcttgaatacgagattaacgagccaagggacttaccggtggggaggatgctctccggcggctgccgagaacggaggtgaatgtccttcccgttttcgggacacgaccgccactagtcgtggcagcagcagcgacggccacgtcgggcgtctcccgagcgatgctctcctttagtgaggccaccgcctggtggtccgcgagcggtccaataacgtcagtcagagggagagcctacaccgcatgaaatcattttccgacccgggaagcaataatagcaaggttaccgagtacactcatgttgattgcggcttcgcgcttagtcgcctccttatcacaaagaggcatggggacgtcgcttgccgttgtcgggccgctgatcatcaattggccgacgcggcgctccacggtggcgtcactcaagcctgcagatcgagaacaaaattcgataaattagggagaacatgcacagaaggggatcaaattaaacacaagaaaaataccccgaggagaaacccaggtcgcgtcctccggcccagagtagtcaaaggctgggtgggcgcgaacctggagcggctggatccgcctactaatgaagtcggtagcgacttcataccccgacaaacctcgcgctcggaggtcatcgatggcatcgatgaacgactgaaaagcaggggtcaaggcgggttttgcggtccaagatgggattttgtctggttgttcctcaggaatgacaaagatcggatctgaatcctctatctgaagatagaacaaccttgcccgccacttgctatgacaagaagggcactggaaggggatatatcgtgacttcaggccatctcgaagtcggaaacccacacatccagataccctggtagattccatccaacgcaactcgtagtagaagcgaaagaggtcgagaaacggctctaccccaatgtaggcctcacaaagatgtgaaaagatgctgaggaaggcaatggaattggggttcaaatggagcagagaaaggccgtagaaattcaagaccaagagaagaaactcagaaggcggaggaagaaagccacagagaatatagtcctcgatcgcaactatacggcccaggacaggttcaggttcagtacctcctggttccctctccatggctccgcggccggggatggcgccatcctcctgtagctttttaagcgacgtgctggtggaggtagacttgccgagatccatcgccgccggagatcgccggagaaggggccgagatgaacaagctaggactttgcaggagcggaggagacaaggaacgcctggaggctggagagcttttttcacaacgggtggacttcaaaatggatcctcaaaatcctcttaaatagacgcatttccgacggtgtgaattccaagggaaggagagagagattaccgccggaaatttctaggtccgttacgcgcggcagtttttcagacttcagtttaaattcactcatgaccgttcggcttcacatggtgttgtcgattgcatcctatctctatggttcgcacaccgagaacgacaacagcctcgacaccagaagtcacgatcggttacacgagtccatttaagcagaagtcgggggctactgtcagggttacgggtaaggtataccctttatccttcgatacatgccgtgtatcggtatggtatacctgcgcgtatacggacgctctctgcatacattaaaggaatccatcatggagttcacagatcgaaagagtcctactcggacaagactgggtcgtcagtgcatcgtgcagggtccgatgtctccgaattctacttggaaaccgcgtgacctacgatataaaagggaccccctgggaggacctaaagggggaatctgatagccaacatcaccaccacagcctacgaagtcggagcctgcggaagccagattgccgagaggtctagttggattaactcgatacgatctcgtcggtttcatcgagttccatctttccctttgtaacctgtgatttccatcatataatcccataccaactggattagggctattacctatcaaggggcctgaaccagtataatcttcgtcttctgtttgcttgatgtcatactacgtagacccttgtaccagcgtaccccaatactctctttatccggcctaagggtatgacccgtcgacacttttatatatattataataaaaataatagtcaaagttgtttttttgaagactgtgcccttgtccaaaacgacaagtattatcaacccggagggagtatttctgcaatgcattagatttttctctattttatttctattttatagtacttatgttttgaattggtttgaaattatgaaggtgcagtgagaacagaagttgggcggttggcacgtgtgcctctggggctcactggcacaaaattgcgtggcgaccacccacacatttggtaaccctaacatcggcgtcaccctaattccacacatacactactgaagaaaccctcttctctcccggtttacagccccttgtaatcctgggttacaaaccgggagaaagaatccggatctttagtcctggttgaaatacccgagatctttagtcccggtagttatttttttttcattgttttttgcagttttgcgtatctcagccgacatccccaaatcataacaacaaaatattatctcccgacatcacaattcatcagcaacaaaataccatctcccgacatcacaaattatccacaacaacaaaatcatccttaagttatagatcaaatgaacaaattatccttaacaaaaatcatccacaaattaagagcaaaagaatagaaaaataaaagaaaatctggctagctatgtgctgcccggccgcctcccctcccggatccggcggaggggaggctgccgctgcccctcccgcttcctctgcagcgtgtgctagagagaggagcgcaggtagagatagaggagagaggaggagagatagaggagagagcgtgtggagagatagaagagagaggatgaggagttgtttgcgaggatgggaggagaggacatatcctacggattatataccatgtttgatcagcgtgggctctgatcttttttgaaccgggactgaaaatgatctttagtcctggtttgtattatcaaccaggactaatgatcatccagtcccatgaaatttttaaaccgggactaaaacatttttagtcctagttcttttcgaaaccgggactattctggttttggccgacccagcaaagatcagttctgcagtagtgatatcactaccaccatgtatcaatgtctgaaattttgtttcagatgattgtcgggaaaaattggcatttaatgtcaaatgttctttacttgttttggcaatgctttctgatagataatctgtcggtaattctttatacgacgacaaatgttctgtgggtaataatattgaccaataaaaacaaacgatctgtcggtattatatttgtgggtcaatctgtctgtttggtaaaagttggtttgccgctaatttttagaggccggcatgaaaaattggtaaatcgcctactgtaatcttatttgtcgttgggctgtagttatggctaatgatagcccgtggaactgggctggtcggattatccctttgctgttggggctcatgctgtcgggaatcatgtgggctttttcagcttttctttggtaggctttgctggggaataaccccatacttaggttgttgaataaactaatatataaaagaactaaaatatctctaagaggatgttgaatatatacagcaaattaagggtaaagatgtaatttcccgttacatacgaataacaaagagaggggacctctcccctattccactcattttcatcctctctcattcactcttgtggtcctcacgggaccaaacttgcactggtggagaagggggtttttactcccggttcgtaaccctcctatagttccggttttttaaccgggactatgaatccgggactaaagatcgctatctttagtcccgggtgaaaaaaccgggagtaaaatatatttttagtcccggttggtaacaccaactgggactaaagatagagcctttttagtcccggttggtaacaccaaccgggactaaagatagagctagattagctagatccggttgctccattattattttcttttcttcattgtgtttttaatatattgttatcactccatccccgtcccaaaatcccaaataaattatccccaaatcctcaaatccccgaatcggccatatccaaatacattacaaaatcttaaaaaaaattacatcacaactttgcaaaattcatcacactatatcacatattcacatctcacatatcacacaaatcaaatacatagatccgaatcataaattccaaaaaaacgcctactgccggccgtcggccgccggcacgccgcccgccgcgaggccaccaggcccgccgccgcgccgcccgcggacgcgccgccatgaggccgcccgggcctacgcccgccggcgtgccgctgcgaggcctccgcccacccaggccgacgcgctgcctggtcgcccgggtccgccccgccgcgccactgccccggctcatgggatgatgggggagggaaaggacgagaggagttagaggagaggaggaggaggaagagaaagagatgaggctagggagaagagataagggaggaagtgataaggctgcctgtctcgcagatgtctcgtactcttcacgcacatgccgatctacatcaaccgggactaaaaatagatctttagtccaaagataaaaaaagtagctataaacttttgaaccgagactaaagatatctttagtcccgatttttattgtaactgggactattgtggattttggctgaccgactaaagatggtttctccatcaatgttgggacttcctcccattggaggaatgccctagccatgcatgttgattttgttccaacaggcttcatttcttagctgggtttcgctgctgctgttctttcttctttggacggtttcgtgccggctgcggctagtaaggcagtaaaaaaccttgtaaaatgtttgacaaaattgttattcccattagagtgggtgcatatgccacgatactgagcttgtggcaagattgcatgagtgcccgtttaaatcatcatggagggcgacgatggtagaaacgaagggaataatacaatgttttcgcgtgtcgagtacacaacataaagaaagtggtaaatacggttgctcatgttcttcgtaatcagttcgatgatctctatcgcgtagttggagattgtgggctcccgctggaattatcgacttgttgaactgtaacactttattctatcgttaatatagtacttcatccgtttcatattataagactttctagcattgctcatattcatatatatgttaatgaatccagacatatatgtatacctagattcattaacatctatataaatatgggcaatgctagaaaatcttataacctgaaacggaggtagcactacataacatgatataggtatcagttcgcaagtgttcataggtaccaatttgacgacactaataaaagatatcaacatctatcagaaaaatagaacgggcacctttagatttgcatgagccaaaaaaaatgagagctggctcgaattgagccgaactcaccaaccatgcccccgccattgtcatcctgctagatcagtcttcatccgccgtcgtctctgtcgatcctggtctccggcgccaccatcattccctatcagatctgacggtggaaatgaagaggccgagggggagagggatcgcggcgtcatcactgctgttgccacaccgtgctgtcctcccgcctataacaccccggtaaccacgtacatagagtgctacaccaaaatacacttaaaaacactaactcctaaaattattagaaatttcagcagagtctcccctataaatacggacatccacaacagacagttataagattaatcaataacgaaataattcacacatttccataccatactagttccataaattctacataaaaaacgaaccagaacattaattgacctttacaagttctacgcaaaacttatgctaagcagaatcataatctaaaaccaaattttaatagtgcaataaaatgtgtaatccaagggtattacttcccgcccatgcatgccgatctcaatgtgtacctaaaatcaaataaacacaagagtgagtacagcaatactcaacaagtacatataaaactagaaagcacatacacacatgatttgaaataaagaatgagcagaaagttttctttctttgaaaagaaataacaaggttaaagaaaatagtagttcccatcccgggcatacatgaaatgacgaagtagtttctatcccagacagttatgaatacatcctagcatttgccggtaaagccaagtaagcgtcatcaatgcttacccacaggagcatgaataaaaaaatagatagcacatccatgactcgcatggaacatgaataattgaaaccggaaacaaagaacgagattgaaaccatattacacatctatggcaagcatggaacttaaattatttaaccaaaatcagaatcctgaatattcaaacaagaataacatcgtaaacacaagataaacttgaaatctaaatggtatgaacaacagcctaaacataagcagtcacatatcacatagaagtataacgaaataaatagataggacaaacaatctatgaatcatataattagttcgtcatacacttgcttttaaccttaacggtaacccaacaaaaccggctccacaccagatctctccgcacctgtgaagtaaagctataggtaaaacctctatcaaggaatcattgagactaacaatacatatccaaaacatcatgaaagatcaaaacctaaatttggtttttatctatcgacccgcacaagacaaactatactagtccataccctgttatgtatacatctttcaaaccacctaacgaaaaagtagcaaaggataccacttcggacatctacagaaaattatctacaactttcatgtttagcataaaaccagattaccctctatcatactcagattaacgaaaactagttgttgtaccagtttctgagccaataagcactactatttttagcgtttctcctgaaccatataccggaattgaacgaaaccagcgccattagaaaaatatcgacgatgactacaaatcttattcaggtcgccaaacttgaatctctatgaataattagcagaattgaaaatacggtttcagtctagcggccgataaaataaagtggagctgccggaaacggatcatcatatatataaattagaaacaactaggatctaaaacaaaatacctagcagtactagtttgtatgaaaaaaatgaatttggaaatattcaccaaattccctaatttttcccttcttctatcggaggcagaaaatagcatgagtgggggctaagaatctaccgcttagatagactaaggaagtaaaaagtgtaagggggcatttgtccccactcgctgtaaaattgagtaggggccaaggcccacgcttgttacactctagatccgccccctgcctatttccccttctctccctccttgttcttctcttcttccctggtgcagcaacaagcaacagcacccaatcagcaagcagcagtatctatcggcaagcaggcaaggataggcagcagtagcaagaggagaacgacgcagcagcagcatcaaacagaggagaaggggaaaaaggaatccaaacctaccactaggaataggagaaacacagcagcggcggcggcgacgacgaccggcgacgctcggcgataatggtgacgtccggcgatggtggcgccctaaacagaaaagacggctagggctgggatcgatccatctctttgccttttttttctgttggttatacaaagtctaggaaggagatcaatggcccacatcgattcaacccctggagcttcgttcggactccgattactacaaacttatagtctacttcgcactacatgatgagccctacgcatccacggttcctgatcgactattcgaacaacgatttaaaagttgaacttttgcgtgtttgttctaatatttctcgaaatacactaattcaaaactaggggtattacactgccatcaccgtgtcatgcgccatatcgtgcgccctctccctaccatcgacgcgctccaccatgcccctgccattgatgtgctgtgccggcgatgggggaaggcaagggggagaaagcagcgggcctgcgatgtgggagggtgagggtgagggggagaaagtgacgggccaccgatggggacggggttgtcactgatggttgatgggaagaaagcggtggtgatgagggtggggatgtcactgatggttaagggggagaaagcggcgggcaataggaggaggggggaaggaatgcgaggtgataggatttggaggagatgggcggccgcgatttctatgtgtggcgcgttaggattggctcgggtgccgcagttttaaaaaccaggacctattgtttattatggatgatccttttgttaaaaaaacggttgccatcttttatatagaatcggcactattatattatataagtacagatttcggttttttaaaaaaaactggcacctatatattggtgtcggtttttatttaaatttttcatcctataaagttacgaaatggtaatagctgccggttttaaataaaccggtacctatgagccggtacacataaggtgttttgtagtggtgatataagctctctctttatcctaaaaggaaaattttttattgccattgacatcgattcatttgagaaaattagaacaggtgattctacctcagaatacacagcatattgataacttctgtgatccgttgctgttattattaacagtttaaaatacccacgggactaaggctgtgtttgagaaaggggagatagagaagattgagaagatacgcaaaacgagatgagctattagtgcatgattaattgagtattaattattataaatttcaaaaatgaactaatatgattttttaaagcatctttcctatagaaatttttttaaaaaaacgcaccgtttaatagtttgagaaacgtgcacgcggaaaacgatgtgcaatctatctccaatctccccgaacgaacactgcctaacttcccttctgacatgtaattgcccgtctctttctccccccccccccccccttctgccaaatcctatcacctctgctacggacagatttggttcataaacttctctgtgcttttgcagcagtcgttacgcttccttttggagctttttgctcttgaaatcagccagatatgctagtacaatgggcttgacgtgttcttgacaaaataactccaaattgtcgtgtttatcaatatgcttttcgagtgtcacaaagaaaaaaaacattttgcattgggtatcatccaaccgatttggtgctccttatatataggatgcgtacaactgtgcaaggcgtgccgtgtgcacgactcttactatttggtattctggcggcaattaagaaacacgcaggcggtacaaaaccctggtgcaagaactgagctaaattcgacaattcgttcatattatttgaggacaaacagaaatatggaaccgagtgacattagaattactgtctctatgtcaaaatttagctacttagactgttcagattgttgtactaggtagctatcttttgaacgtaaggagtttatttttggaagtctgtatgtcatcatctctgaagcgttctcgccgtcattaactcggtggagccgtggagggtgcattagttctcataaaaaattaattcctctaagactgtgttcgctccagccagttcctgacctagacagtagtacggaaaacggagcagtccattagcacgtgattaattacatatttgttattttttttcaaaaatggattagtatgatttttttaagtaactttcgtataaaaactttttacaaaaaacgtactacgtactgttaaacagtttgaaaagcatgcgcgcagaaaacgaaatagaaaacgaaagtatggagttgggaaatagctcttgccaacaaaatcaacgctgcatcacatacactagaattctgcagctatcgaaattttggttgtatttcggaaaaacaatgttttcctaataaaagtggcaagtgtagctttctgaacaaaggctcatcaatcgattttgagaagaaaaggtgttacaaaatccaattctaaataaacatctgacttaattaaatgccaccacaagtataataggccacaatgtggtgggtggaaataggaaattgtggaagatgctaatttaaaaatacatcatcagtttgtcctgctaactgttccttttgttgtagcatgctagatttccttttcttctggatggtaagtatacatctaagcaagaactttacactttcagttaacatatttttctgaaagctgcccttgcgctacccatcactattcattagtgatgaccccgtacttgtaaatgaactccaagtgttctgctacacatagagctggtttctctcctcgtattttttttacatgaacttaatcttgctgtccaactttattctgtaactgtctctcaaactcaattatgtatctttctatctactaagtagaaacttcctagaaaatatgctaaagtttcctaaattaattaaatcacacctagaaaatagcatattgctagtgttacaaaagaatttttaaaaaagaacattatcattgatctgtttttgccaccgcgtcctatatatgtcaacattttaaaatttctgcatgtacttccctatatatgtcctttgatcccacactcgtctatttttttcataaaaaaagttagtagtatacttaattagtggcagacagaggtggttgattcatcactcattccacgccactactttttaaaactagtataagtaaaaaaaataatcctaacaatccaatacactagttggtgtattgtatagatgcctctaattcatacattgagtttcaattaaattttatttaaatctctacaatccgcactatggtaaaacaagaaaatacaatccaaacacaaggcacacacacgttagactactggtagtgagactataagatgatgacaataactgttctcgcgttgaagaaacactgcacatttatactacatcggtcgacaaatataagaatcttagtacagatacataactaaaaatatttatactagtttaggtgctgaaaaatcctttattttatgtcagaggtagtacatcatagatcaataaacagttaggatctattttccatcaaatattcaagatgaatcaatacaaacatattttagaaaaaaaatgaatttctgatgtacctatgctaaaaaatatcgaagcagttgtcattcaaacgttgcacatgctttatgaaaaatgaggttagttgttcatcaattccactaactacaacgtctaatcttttattcaaattaagaaagttaacctgaaaatattacatgccactaattaatccactttcagagccttcagaaattaattgttgctattcagttcacttttctattgcctccactttgttgccgtcttccgttccaccttggcccaagtacgcaacctcgtactcaaaggatccgctctccatataaataaaaaaaatgaaagaaaagtagaatctattcccataggaatacggaaggctacgccccggcatggatagtttgtatattcgactaatttgttttgttattcaaagtattgtttccaaagagtatttttcaaacaatttttcattaggcagctgaaatacataacaagatatagatgaaatacatatagttcatatatataatacacatactgttgtttgctaggttcaccctagaagctgcacatattttggctcctgggtccattgcggccaaaccagggaggtaagttgacccatgaaaattgacccatagggtggcatagtaagaccagaggtagtgcattaaaaaggccaataacccaacactacattcatattaatgcgattgtactccttcttcaatgaaattggccagaatatcattgatttggaaggtctagatgaacttcatgcaaaaattgtgaaaacctatgtgtcgacggggcttatccataaccatgacactatgtatcatcaattgtgaactaagacacctcggatcaccgaatacctcgtattcatcattttattgataatttcaacaatgtatcatcaaatgggggggtgctttgggtcacaaggtatctaacacacttagacaccttggggccccgagcacctcgtattctagaaattgcttatttcgtaagttttcttgtggttagttcattgattatcaaatcatcacaagatatgaggtgctcagggtccgaaagttgtttgcacgagtcagtacatatacttacagactaagacaccttcttcggtcctagagaacctcgtattctatctttttttcataatttgagatagtttacaaaaatatatatttagtaacttatttgtagttagttccttggttatgaagtcatcacaaaatgaaaggagctaaggatcctaagtttgtttggttggattagtgcatacagaaccttgtattctgttttttttttaacaatttgaggtagtttgccaaattatattatcataaaaaatgaacaatatatcatcaaaattcattattatgccttgtatctacttattacttactaaattgttccattcaattgttttatccccttttttaaatgacaagtcgccgttcttcttcaaaaagcattgtcttcgagtaatttgggtaagtttgtggtttcacgagcttagaagaaatttggtaagtttgtggcttcataggctcaaatgaaatgtgaggtagccatgtgcattggaaatatgtgattgtgaatgtaactttgtgtgggattttgaaatgaatgtttattatgttaattttgtgatgcatttgcgatgaattgggaaaaaaaactatgatatctgtgcatctgtttttttcataaggcatggctaataattcctgaggctaaccaaattttagattttttttaaaaacctaatcactaacgagtgaataaatacaccagtcatagatagcatcacctgtgacggcaatttgttaacagtgaaatttggtaagcccaaagttaccatcggtttaaaatcattatcggctgcagcatctcggaatcagccgatgggagttatcaagtcgccaatagtcggattcctgctatattcggttaaggaaatcaatctactaaaggaagcttatccctaagtgaccgagtttaaagagaatgtggcatggaagtttatctattaattaagaatagtttgttagtttccttttatctttaggaaagtgtctttagtgtcctataaggactttatcttttcctttttagtttctttcttatccgacaaggactagtatctccctatgggtataaataagtacacccggggacattgtaatctatcttcacgatcaatacaattcggcgcatcgccaccctttttacttctacttttgtttttacgttccggtgggacttggcacccgacgcggggctacatcgtcttcgatctccggcaaagggataagtccaatgttccgccggtccaggcaattgtatcgtctacgtcggcgtcgttcaaggctgcaacagtacattcgacctctcggattgcactggtttggatgatatatttgcctacctattttatcatatgtctctgttaatctagtcttagcatgtcaatttagctcaatcggctgcttctcgttttagggtttttgccggtatcggctaaatcgcgttgctagattagattagcttagacatctaccaccctaaaaactcagtcaatggcttgattgtctaggtattatgtttcttttcatacttagtgttgcatcagttaagtttgatctactaagtcgggattagaaccataatctctagcctgcttcttgattgccaataagggtttcatcggggtttcagccagtgagtaatctggatgttgcatcggctcataatgattgcatatacatataagttggatttagccgatgacaacaaaggtttcactatttaatctaatcttgtggatttcatgatatcggacctccagccgatgtgtactttaacctttgaatcgatgcttacttatcatatcattgctagccgattggtttatataggactatattgttattttattatatcatcatcagccgattgccattatatcattatctatattggatatatagccgattgcttcaaccctatcgctatcggctggtatcggcatcggctgttatcggctattggctgaaactactccatcggcttgtcagccgatcggctgttttgatctgctatttgcatatcttgtcagttgcaggatcaaactgactggcacgcccgcatctcatcatatttggacctgcactggagctaagcagatctcccaggccggtgtgttcgattttttcgtcaacataattgtatattagttcgtcagagaagattcacctgacacaggtgtggagtaagtttcccacctctaatgggacgcaaactttccgcccgtcagaggtgaccgctgacgagttgcaaaccatcttggtttggtggtattttgagggctatcagaggtggcagttacctctgcccgtcgaaagtgagtggagtcatcactaaccacccatgtctgatcagggccaatcccgtcagagatgagggtttaggtccatcatagttgacttgaccaggagtagtgccgaacgagtaaacgatgtactactaatatagatggccatgtgggctgcccaacacggcacggcccaggctcggccgtgcctgggccgaggcttttcgggccggcacggcccggccgacgcaccgggccgtgccgtgctggcccacgtgccgcactcacggcccaggcacggcccaacacgcctcgggccgtgccaggctggcccgaaggcacgatgggccgtcgtgcttttcctcagaataagtctaaatttcctccctcctattgggctgtgacatatgtatagctaaaaaagtctattttacctccctcttctttgggatgtggtatataaatagctagaataagtctatttaaggtccctattctttagatagtgacatttatatgtctattttttgtccctatactttgtgtaccgggcctggcctgctggcccatcgtgccgggccagcccagcgtgctgatggggaggcccaggaacggcctgacggtcgggccgtgccgtgcttgggccgggccaaaaaggcgtgccgtgggctgggccttcagacctcgggccttatggccaactataactactaagaattacatttgtggcatgcagaagttctttaccgagcccttagttatccctaaatatacgaaggacaaggcgagcatcctacatttaggattaatacatgactacagatttgattagattccatctttacataacgacattattctactaactaaaacgtaatcttgaagtaacgatatattttactaattaaaatgtaccgtgactaagcaacactacggtctatatatgggccattcctagcaggtgcacatcatctgcaggtaatcaggatactgcatctccatcatttatttttttttttggttacagaaaatcgaacctacattgtatataagctactctactgttacaagcatgacattttaacaaattctagtatgttttaaatacgattatgccggattgtttttatgctagttgaaaataaacaatattaatatgtataaatacgtatatgttacagtaagcacgcctctttctcaatcattgtataggaatgtttgtttatgtactaaatgtcttttatagctaccaccactgattgagttgggtcaggtcgaacttctctctatataactccttcactttggactcgtaaagctcacacaattgctacaattgtttgtagtcgatctccattcccccagtaattaggccacaaatcaaatctctcttgtgccctaataacctcctgttataattagccaattgatgatatacattagcatgactcttcactggtctcttctgctgttcattgccattgctttggtttcttcagttgctcaggctgctgttgtggagcacaccttcaatgtaattaagctgactcacactactcgtatatgtgcacgcaattccttccttcagtttgtcattttgttcatgcattagatgtatatatttaatttcatgtcattcgtttacatttatattcatgtgatattaggatgctaacattagttcatgcatgtgataatatcttgtcgttacactaatctatactttagtttatatctacttgttgtttaattaattactctctgtccaccgagctacgtacaggtacgtgccaaccgttcttttttcatttttagattagtagtacagaatactatacagtggtgtatcactcattcatattttcatatgcactattctaaaaaaaaaatttcatatgcactgacacatctgtagttacaaagtcatattttgtttacaagcaaatgcaaaatccttactgttaattactcaacaaatcaccactagctgatgaactaataaacagtaataattctagttagtagagtttttacaatgctccatttcatctgcaggttggcaacttctccatcagccaactttgccagccgccgctgatcatcaccgccgtcaatggccagctgcccggcccgacgatctacgctcgcgagggcgacacggtggtcgtacacctcgtcaacacctcgccatacagcatgaccctccactggtaaatattcaactcatcaaactcgtcacatcatcgatcgtttatgaaggtagtagaatattactagtcagggttttcaatttccatttcggctaaagtttcggccatttctctagaaccggtattttttcggccgaatctttctgaaattttttaaaaaataactgaatttgactaaattcacaaaaatttgagaaaagcctaaaattttggtcgagatattgacttgctggggatccgaaattatggaaatttcagacatttcgaaacttattaattattgcattaatgtaggcatggtgtgctccaacgtggcacgccgtgggcggacggtccggcgatggtgacgcagtgcccggtgcagcccggcggcaactacacgtaccggttcaacgtcgacgggcaggagggcacgctgtggtggcacgcccacgtctcgttccaccgcgccaccgtctacggcgcactcgtcatcaggccccgcggcggcgccaaggcctacccgttccccaagcccgacaaggagcacgtcgtcatcctcggcgagtggtggaacgccaccgtctacgacatggagcgcatggcgttcctcaccggcatcccggcgccccacgccgacgcctacaccatcaacggcaagcccggcgacttctacaactgctccgcccctaatcgtacgtcgacattgctgttggtgaaaagcttggcatgatcagccatggtgtttgacatggtgattgtgtttgcttgcttgcgcagagacggccaagttcgaggtgaggcagaacgggacgtacttgctccggatcatcaacgccgggatgaacacgccgc

SEQ ID NO: 36542 - DNA, 4516 bp, Oryza sativa
atggtggccagcgccgccgtggggcggtactacatggcggcgtcgccgtacgacagcgccatcccgcagggcccgccgttcagcgacaccaccgccacggccatcctgcagtacgccggccgcggcgcaagacggtgcggtggcggccgccggtgctcccgcggcggccgcccgtcaacgacacggccaccgcgcaccggttcttctccggcatgaccgcgctgctgcgccacggcaagccgtcggcggtgccgctcgccgtggacacccacatgtacgtcaccgtcgggctcggcgtctccctgtgccagccggagcagctgctctgcaaccggagcgcgccgccggtgttctcgtcgagcatgaacaacgcctccttcgtcgtccccaagaacacctcccttctcgaggcccacttcaggcgcgagccggccggcgtctacacccgcgacttcccggacacgccaccggtggtgttcgactacaccggcgacgagagcgacaacgcgacgatgcagttcacgaccaagtcgaccaaggtgaagacgctgcggtacaacgagacggtggagatggtgctgcagaacacgcggctgatcgcgaaagagagccacccgatgcatatccatggatttaacttcttcatcctcgcgcaagggttcggcaactacgacaagaggagggcggagaggaggttcaacctcgtcgaccctcaggaacgtaacaccatcgccgtgcccaccggcggctgggctgtcatccgcttcgtcgccgacaatcctggtaattactagtactactgttacatcaattttttaaaggtaaacaaattacgattacaaaattttgtctctgccggatggatgcctgcaggaagcatagaaccttcttccagtactgtgatgaaatgtgtttttggtgacattggaaaccagtgccccatgtaggagagtgacatgataaatacatttcctaaacacaactaaacaaaactccaaggtttcgtacattaatttgaacctagttgtataatcctgcagaattttaattttagattaaaattattggtatcaattaataacataagttgtactgagtttcaagtaaaaaaaatatttatttatttattcaacaatattgatgtttaggatcagcaaaaatatataagttgtataggaattctcaatttcggattttctaattataataatttgaacattacagatttaccagatatgaagttgtggacctaaattttaaatacgaactagtattcaccagtgcattcaaccatattgtattattgcagatagactaaactgatagactccataagggacaaattttctgttaaaattagtacaccttaatctatccattatggggccaaatattgacatccctagtccttctgtatttggcagcaagctaggacgcattatttggcattggtttagcgtgagagataattaattaagttgtggattataattatttaatttggctgcagggatgtggtacatgcactgccacttcgacgctcatattagccttgggctggccatggtgttggaggttttggacgggccgacgccggagacatccgtgccgccaccgccggcggaccttccacggtgttcatgagatcacgccggcggcgaattaaattttcgtatatttataagattgtgcatatatatagccaggtgtatatgtgcttgcatgagatcaatcagcgaagcagatgaattatatatttgttgattacaacatacaatttgcataaattgattacacggtatgatttgatgagtattatgtgtcctttaaaaaaagttaattattggaacggcatgcattcgtatggttggtggacaacctatattattaggttaggttcatttgtatattccaattcttttttgcagtcatattaataaaattttctgcaaggatctgtcattctaaatgttcagaactaattaaactagggctatatatatgtacaacccaacaatcttatttttataagaaggtattaagagtaagggttagctagcttccaaatagaactacatttatactacatacatactccctggcatacatgatcatagtaacgtgaataatcgaataatataagatcgattatatatatatagtaacgtgaataatcgcatggaagttccgtatgtacgtaagagcttccaaattatgtcaagctatgataacgccgattcgaatcattattttacgtacgccgattctatagtttaatttatgtacgtaatttcacaaaattaagttgtccttttataccagtttcggcccaggctatttaccaagcaggactattgtgttgcggttgatacatgtgtacaaattgacacggcctcctagcaacggttccatatgtttctgccgaatatagcagttatatatgtgcagtgtgtagatgaagtaacgacaatacaactatctagaaagaaaataccgtcatattgggcaatgagatttgacctgcaaacccatctttgggctaagccctaagctggccagcatatattgggccagatttaaaatactaatgagaatatattcaccaggttttaccgtggtcaacttgcccactaataaaaacagcttcccaaccgttgaaggaatcgatttgcatcggtttttaaagttggggaacatatgtcatacctagttttgaagttgatatgattcgatcaaggtaagtgaagggacacataatggacttattcatagagaattagtgcttgcaatcatcaggctatatggcctacaagtcccagagcctgtgaaaaatcttttctttctaggctgcgttcttttggaggcctctcccctccacacgcaaaacaaaacgatgaattaacgtatgattaattaattattagctaaaaaaactttaaaatgattaaaatgattttaaaacaactattttatataacgttttttttttgcaaaaaaaccacatcgtttaatagtttcgcatggaaaaagagggagattaaattgggcacgacccagttcttttttcttaactctaaactttaacttcatggttttctattagcatgctttttaaactgctaaatggtcgatttgacaaaaaattatatgtacaagttgttaaaaaatcatataaatccattttttttaatttataataaatagtacttaattaatcatgtgctaatgagttttcttgttttacgtgcgctgaaaatatctctcttaactgggccaagctaaggaacacaaccttattgttcttaccaacccttgcattttcttctttgcctctagcagccagttaggctatatttcaatggtgttatctgaagtatactttctagtatctttattgtgactcatacttcttactaactatatggaactccacgcgttgctgcagaagtttagtatgataatagtaaatataatgtgtaatatatttagattatgtaagcttatataatttgtatttttttcgatcattggaaaatgctataaaccatttaagttgatgtggtttatgataatttaaatatatactatatagattgataataaaaaaagtaaaagtaaggtgatgcggattcatgagagaagaaaaatgagggaaataatttggattatagattaatcatctaaatgactgaaacaattgaggtgatgtggtttaatgagagaagatagaaaacattaactaagtggcgatgatgtataatgtatataggatattgtagaaaatggtggagagatgtatgttgaaatattatataaattatgtgagataattataacaagcttgtaatttaaagctttaaaatataataaaatatagacgatatagcatgtttgtataaggactaaaatgtaataattgctaatggacgatgatgtgtcatctttacatggtgagtgttaggatgtagtgagttgtaactttatagtatagattgagcaacagcataacaatgtacgattggtttttaattgcttagttctcgcctaaatcatagagaaaattaccaatgtccctccaacaatatactcggcccaatccttacgcatccctaccctcaaagtttaatttggatcatttccatacatttcaattagacattagttgactgataaattcctattaaacattctagtttgccttctgcatgaagaatatagggtttattaattgttggagtgtaaaaatttgttatataagactattatatttatgagtttgtgtgatataatttatgaaggaatttatgttttgactaagaaattaatatttatttttaattattacaaaatatttatgtagcatattttttatacactcctagagaactaatctttgccagatggcgaaaatcacatttttcctagttcaaataggaaccaggactaaagaatatgtttagccccggttcaaaagcccaacggcactttatgatctttagtatatgatctttagtct

SEQ ID NO: 36543 - DNA, 30948 bp, Oryza sativa
acactttactatcggttggtataacaaccggactaaagattgaaaagaaagatcatggtagagaaagagctgtgcgcgtgcgtcctttatttttcttcccccttctcttccttatcttctccccttcccctctcctcccctcctcggcttctatcgaggcgggcgggtggggcgggcccgatggcaatgggtggcagcgtcgacagagcctcccccaccttctattcccctctcctcggcttctactagcagtgggtgggcagggtgggcccgatggcggcgggcaacatcggcggcgggaggcatccgaggggtggtggcgctctgcccctccttccccttccctccttggcagcgggcagtaggcggtgatgcggggtggcgccctgggaggtggcggcaagccccaggcgacggcaggcttgggaggtggcagcgccctgggaggtgacgacaggtggcgatgatttgtgaatttgtggatgaattttgttattgttgagtatgatttgttgtgggtgattgttgacagtcgttatcgatcagtttcgaccgtcaatatttcgaaaacaagagagaactagtgatacttgcaatgcataaatatgttagaataataatattccgctagtattaggtctactaaccttttgcatagaacaacaataaagtgaaggagaatcgacatcaactcatacgataaatcaatcggacgatgtcgggaaccagacttgtgtatgaatgggccaagaacgcagacttgacataatgaatcaggccaaaattcacaagtctacaaagtgaagcagcagagcaggctgccagccgaaattgggctggattgggccagccccaggttcggccgaacctggtggttcggccagacctccctcgcctccgttggatctaggttttggctgaacggtagaaatgaagccccaatgatggttggagggtattcccgaccattccaaccgtcacaactgtcatagttcagctatagaaggactttaccttctctcttcactcacacacctcaagcaatagctctctcattcctctcaggtttagtttagtagtatctagctggtggaatagaattagaataggaatcaggagtccggaagtcttcggaagagttcgggtatggctctggtagctttcctttcctcttttgtaaactttgtacttttattagaatactcttctaaatacatttctggtattgaaatactttccgagtatattagtaccaactttacattatgttcttgttatactgaatatgctgctagcttatctgggagatgttttagtgcgagtatagtgtttgcttatgcaattactctatgtcatgacgatgatattagagtagtatctggtagtttagacgtggtgtctagattacgggatatcattatttggggttatatattgcggataagaggtggaccgctgatggtgacagctcagtacgggtattcctccgcacctatatataatcctaagttaatttcctggggaggatattcctccgtatttagccccggttggatggtcatgacgggctgtcataaggaactcggcagtcaggggtggcttctcgaagtaccaggagggcatcggatagaggatattagctagtatatgtcacgcccggaaattcactaataatttccgaactaatttgtgcataaaatcctcgtccaggaatcagccgaggtacacaaactgacaatttaatatacaaatccatcataataataacgttacatacttacaaaagaaaagaaaaacaacggcagcggaataacagtctagcgatggcttcagctccactcccacaggcaactcaactggggtataagccaaacgttttctccttctggatcctttttcttcaactgaggttgattgattattgcaagaatgagcatatgacatactcaacaagccacacatcaaatatgcaagtgcacaaggacaccaaaggatggcataatataggctcatttgcaaaaacagcatttagcaaagatttaagagtagtaaaacagtagagtaattaatcatcaattttaatcaacactgaacagcaccctaatgctgcacaggcccaaccaaacctgaacaaccaaccccggctgtacagatctaactccaaaccaggagctaagcaaattattaccaattatagcatcaataattattgtgagaggtgtgaggctaatcacgaaaaacattgctcaactcacccataaccgcgggcacggctatttgaatagttttactctggccagaggtgtaccactgtacccacaagacacagcctcaacatcatgtctaccatgcgtcgcgatactggaaagtacccgaatagaggctgcgacaataccctctgcacaacacaactcaccacagtgcaccattcctggatcataatcaccccctctataaatataaccaaagacatggactccccagcgacccccacggacttatcaccgcttctcagtctggcaccccgtaatgaatcatgctatacaaaaggtaaagccgttgcccacgctggcttgtggttggcacggttaatgtctcacaacagtagctcgcgaactggtccttaattgtcatgagcacgaccttcaaaaccatgtgctcacaacccaccagtatcaattttagttgacaattaattaataaccaatcacgattaaccatcgtgagctaccattaaatttaatcataaataataatgtaatgtgattcatcccattaatgatctaatgtttctaaacatggctaagcaattatatatatatggcatttagctgaaccaaaccaatatataaggttcaagctaatcagtttattacccgaggtatcaaggaatagggcattcaatgcaaattggctataacaaaggaataggttcacaccacccggtgacatttgaaaataaatgcacagttgaaataaatagagaatttaaatataggatcaacatgctcaaaggattgtgtttaggatctgtgtgacttgccttgcagtaatcagtcttgaattaatcttcttgaacacttccgacgcactcacgaatcttcgcaacgacggaaacggcaagctaacacgcaaaacgaagaaaaagactaataaaaaccaaataatcagtacacataaagtaaacaaacatgtagatcatgattttagatgaatttagcaacttgaactacttaattccgacttcatatgaattagttatgaattttacaagattaaactgattttaagatttaattttagaagggaaaagggctttatgacatcacgatgacgtcatcaccggcgagaggctcgggacatcacggtcaccggcggtcacggcggcgagaacagagggcaccaacgcgacgagcacgacgcggggaactcaccgagtggcggcacgacgacgaacgacgacggaagacggccggcgacaaactccgaaggcggcaaggtactggtcgacgacggcagcggcttttcggcgacgagcagcggcaacggaggggtggacgggcttctccttggtgctgcgatgccgagggaggtggcggcacaagtcggggacgaccgaggcgacggcacggcgcggatggaggcgaagcagatcggcttgacgtcggcaatggccttccggttgtcttcggcttcggggaagtggaggccgctcttcctctcttcgatgcggtcccgatggaggcgacggcgccgaccggtgatggcggagccgacggctatagctggctggagcggcggccggaggaggagagagatggctagcgtggggagagacggctagggcacgggagctcgagctagaggttggaaacgaaagaggagagcctgggggttctatttataggcatgggagagagagatcggactccaaacgagaggatttgagccggaaaaaccgagggttagttggagagataaactcgaaaacgaattcgattccgcgttgatttcttcgggataaagtccaattcttgggggtaaggatagaggaggataagaggaatatttcccctcaactaattttgcaaacggagcacgggatgcggcggatttggtggaggaagcggcggctgcacaggtacaggacggctggctcgggctctatccaagcttgaagacgacactgtagcagggaggcgaattagactttctgtcttgggctggctgaaaacaaagcaaagaaaaaaaagaggaggagctcggctgggccgacttgggctgcacagcacgcgcgcgagggagagagatgttgggctgaaatcagcccaacggcttaggagaggatttaaaaactttttccaattaaaataatcactgaaatgatctttgaattgttaaaaatacttctaatgctcaaataatttcaagaaaagtcctgaaaatactggaacacccaaagtacttaaaaaaattataatcagaccatttaatgattaatttaatatgttgataattactgaaatgttctttgtatgattaaaattaggaattgagctccgaaaaatctgagaaaattctagagagtataattaaccatggagaatttaataaaaaataaattcatccatgctttatatttagaaaattttatttcccacatttaacttctcttgtaaattaatgaacatttaatataaattctaataataatttattaaataatttataaatcctaacacgaaaatcaggatgtgacagtatatcagttaattagaatgtattgtatactatgtatattagaagtataggagtagattctctttctcttttctttccacctagtttaaattatttattatgaggatgagtagttgaatgcttgtgtgtcactctacccttgaattatcctaacccctacttagaatatgattatcacaagtaatatataaattattagttgagttctctctatatgatcttcccatgggataaaataaatactatacccttggaatactctcgggtgaaatggtacaatggtatatccgtgcgcttgcggatgaattctgtaaccataatatgccagaagtatttctgtgtcattgctgggaattatatttctcataatgtcgttaagaaataccaacagtgattttgttgtggaggtggatgatctgggatgtctgatttgtagctattcgattagatgattttgattgtattttgtctgatttgtttgatctgtgatgattttgatttctagcaactcgatctgtgatgtggggatttggggatgtcgggagcaactctgggacgagttcgactcgaaatcaatgtgcaagccagctaaaaacaatgaaaaaaaatgcaagccaactaaaaacaacaacaaaaaaaaagcctagcgccacatggtgggactatcatctttagtcgcggttgatgctaccaaccagaactaaagacaccgctaatcatacacatctttagtcccggattggacatttcggttgcatacccggaactaaagagggttgcgaaccggccgagtaaagatgggttttcaagtactgatagtatcacaacagattcctatgcctatcttatacaacaaatctattgtgctgctataaaaggcaaaaattgccctaggacaaccaaaaattttgtaattggctaggagacgctgtacaatcgcgtcgctactcatgaacaccccaaaattcgtgtaacttgccctcatctgagacaatattttatcatttctgataaaaggaggagagagaaatttcaaactgacaaaattgccctcagccctatctaatatccactaccggttcccgcttcccagcaacgctcaccaatcaccgttgctggcgggctcaccgaccgtcatcgaagccaccactgcccgcttcccagtaccactcgacattgccaccgtcgtcgaagtcgttgccgtggggctcgccgaccttcattgatgctgccaccgtcgcacccaccgctaccgccatcggccaccgtcgaagccattgcctccgccgctgttgccgagctcgtcaaccgtcatcaaagccgccatcgccgccaagcttgccagccaccaccgaagccgttgtccccgggctcgctgttagtcgtcgaagtcggcgccgggcttgccgctgccgcccacttcccagtgccgctaaccgttgcaaccaccgtcaaagctgttgctgccgaggggctgagggcaatttaatctttttgaaatttctctctcctcttttgcccggaaataatagaatatcgtctcgggtgtcctatagaaaattacatgaattttgtagtgtccatcagtggcgatgcaattttatgattcttctagccaattacataaattttgggtgtcctgtagcaaattttgccgctataaaaatactccatataaattttttgataagtaagaacaaactttttatatcatatctaaaaataaaaatactccatataaattttttgataagtaagaacaaataaatttctacactccaacttatatatttcatcatactaaaaagcataatggattttttatagcactttaatttaatgctaaactagcggtcaactaacgaaaaccatatggaatagatctaaactaaaattcaaaagtatataagcaaatgagcaaaacttaggagtatagaagggattggataaaaatttaggaatatataagaaattttctcaaaatcagtcgtgcaaatcgatcgatcgagagtgaaataaaaaatcatggatacccacggttatctttatatttgctgcagaaaccttgggatataaaactagctagtttttgctagatccgtagatgctgccagaggaatataattgcacatgccacgctagtgttaggtactaataaattggttatacaaggttaaatattctggtgtagtgttatgcattcttagtttagaaagaaaaaacttggaagtgcttgtgtgtccaatccttacatatttgaacattttctgtccacagggcataactgtagaaattcctaaaacttcaaattggactgctcagaaaccttacttggaaaataaccccaagatgtcaagcagtgttattcgacaatgttcattgctgcttttaattactttgttggttatatgttttgaagggaatgatatatatggcgattagttatgtcatggaaaattactggaacatcgaaaagggtaaaaatacgacgcaggcagggactatttataagttggaccccccatcaccccatggcatatcattactaggaacagcattatcacaagcggccgaaaagggtcttcacaggcggggcggcagtccgcctgtaagccaacgactgtgaagatcaccgatcttcgcaggcggggtggccgtccgccagcaaagataattttcgcaggcggacgttggctagtccggtccgcctgcgaaaataggaatcggccacctgaaaaaaaaaacttccgcctgcgaagataggtagaaaatattgaaatttaataataatttgcccgtaaattacttttaaattatttaatataaattcttgcaggtagattattatgtacatatattagaagattatcaagcatttggtaatgataaatgtacatatattacatatctcaaaagtgttgccaaaatatatatattacaatatttttttacattgtcactttaaatacgccatgtagttaatacattatggcatagcactgttccactcccgaagatccttgaattcgtcacttgtggctagggcaccctctgggtcgaagaaatctcctttcacatgacagcactcatggttgatgaagtggcacagatcacgctggacatttttgatgcctgtatcatcaaaacttgttcgatattctaatcttggcaactgcatgcattgaagataaacaatatattagtatcataaatatgtgaagctgtctagcacatagtatagagacttatatcctctgcgttagtcctgtacctcccattaactctaaggaattcgcaagcgtaatacccgcaaaggatcgttccttgcggttgcttgtgatacttcaggacatatcataaaaaaatagttaaaatttgcaattagtgaaacaattggtatacattaagtgagtggagtattaccggccaataggtacgtactagcagcttctcccttgttcgggtctgttctccacccatgaacttgtagtactggtacactctgtatggatgtcgtaccgtttcacattaaggaggatatttatttaaaatacattcatataaaaatgtaagagtcataatcacctactactgtaagattgttagaaattctttgtatgactggtgtttgtaatcgagagggtccaagactaacacagctccgtctttagggtggatgagtaaacagatataatgatcgctacatattaacaacatcatagttagttagtaccagctaaaataagacatatgtgtagaagataaatgtatcggacttaattaaaattataagcggccatgacgactctcttattttgaaagtgcaagaaggctcgtccaatgtactacgcgacagtaatcaatttctccttgtgcaagcccttcttgtattcagctatctattttggattcttgcccttcagttggtcagacctggtgctagcctcacggtatgttgtgtttggtagatccgagttggatccaagaagccgataggttcttttttcttcttagcatccatgtattgcatcctacagaagaagtttgttagtaacaatcacatggatttgtattgtacatatttttcatataattaattaaaaatcatactcacatgcaccaaacaccgaagtagttgacatccatcttatcccgacgatatatggcatggagatctgagaaatctagccatacgtaaccttcttcgccgaaacaatctgtcggtgatcgagctgttatattgcccaagcctttcttgctggcctccatgtagaaggtatgtaaccttttcatctcccatggtccttcgttcagtgcccattccggcaagagtgctttcccatgttcgtacttttccgggcaatcatcggttgcgaagtatgttggcccggctagttcagcagccttctaggggtcatcatttctgagcttggcacgttccttaccccttctgaagacggttaccatgaacttctccttgttctcatctttgacttggagtcgtggctcctaagcactctaggcacctcagaactggtagtggccttctcagggaccgtggtctcttgcacctcagggtctttcgcaggagaagggttttcaaatatttctagctttgtaccgtcccattccaatcctggtacttcttctatttctgacccaactgatgccacaaattgcacctctggttctgccactgtaatctccataggcacattcggcactggaatctccatggctaccgccggtactgcaatctccggtggcacttgcagcactggattttccttttgcatcttgggttcctccgccttatcagtcaccttcctcttaggaggtctcggaggttttcccaaccccggttttggcaccacaggtttttgcgtggcgtcggtgcccaatccaaaggatatgtcattcttgtgccagagaattacaaggtcgaccgcatccccaagtacggatacaccatctgcagtcgagaagtcaatgtcgtaggactcaaacccttcgtggaccacttgcggctgcaccttggcatacgcatcgggtatgaattcttcattgtatgttctcccagggatagcaatggctatagcggcctcaagagttttcccggagtgtccaatgggaacgtgcaatctacagggtgtattctccatgaggtcatcgaaggggtaatctggctcatgttctttggtttcggggtgaggcaaaatcatgtgcttgacgcagaaatccatcatttgcctttcaaactccgcagccccttcgtctctaagtttatccttgtacgcttcacgcttcttgtgggggtcatgtttgaaccctttcttccaactcatcttgctcgacacacctcgaacccttcccccatgctcaggagtacccagcaccgtacttagcacatctttctccctcttaggcttgaaaagtcctttcttctctgaactggataaattctctattttatcggcaacgctctgcagtttcggatcttcaaacgatacttttccttcatccgtgatcttcagagttctagctcttacccagtccttgatctttgtgtccattcctccattagtaccggttgccccttcttcctcatttcctcctcctcttttgtccactgctccacctttggtgcgtattccgcggagcctaagcgatgaggaaatttgttcttcttggccaactctgcatacttttggctcctttgaatttcttccggggagttcttcaacgtcagaaagtcatcccactgattcggggttatgttggcatacgtccaaaacggtgtgcatcccgtcttcacaaatttcttgcttaaggtggttttccaaccacgccaagacttggccattgtttgcagtgcacagttccacactgctatctctgatccatctaggaactggaagattttcttcaactctttccataggacttccttatccccattcgatacatgatcccagtccttgaccgtgatggggatcttttcccttactattatgccacactgtgaactgaattttgcacgtgcagtgttaggggcgagcagctctccttctggcgaaacatgggtaacaacatggaacccttcatcctttctattcatgcttctttcgcccttccttttcttcgcctttgctgaccgttcgcttttctttgagccggttgtgttagctggtacctcgtcgtctttcgacataacttttttcttcggctaccgttttgatcgccgtggcgccgtttcctacgagaaggtatacatgaaagtttcgaattagctcgggctaatagttatcacgatgaacagtttacatattaagtttacttaccccttctttagggggaatgtagtctttgtcgtcttcttcatcgtcgacctttttccttctcttcgggctcgggcttgggcttggacaaggatcgcttggcaacgagtactcatcgtcttcgtcagctatgtcgttatcggaactatcttccggtgggaccgttggtaccggagcaaccacaacagtaagggactgctcttgctcacctaaacccttctcttcagtccctttagtactatcggccatcgtttcaaacctctaacataaaaaaaagagttatcctccatattttaaaatactcaaattagtataaacaactttgtacaaaaataaattgtatattaacaatatgtcgtatgaacaaatttaaattgtctgagattaccatatattaacacgtagggaaaatagatatgttattaattagtacttactattatgctaaattaattagtacaaacaaatttaaattgcgaaattaattactacttacaattatgctagaatagatatgttattaattagtacttatgctattaattagtacttactattatgctaaattaattagtacaaacaaaattaaattgcgaaatgttattaattatacttactattatgctaaattaattagtacaaacaaatctaaattgcgaaatgttattaattagtacttactattatgctaaattaattagtacaaacaaatttaaattgtgaaattaattactacttactattatgcaaaattaattagtacaaacaaagttgtacaaaatttgatatgttattatcatgtagtgcactaattcacaattacatttcctcgacatgttaacatatcctccacatatcctccacattcttttaaaaaaaaatgttaacataccctcccacatgttatttaacaaatatgacaaattcacatatactgcaaatttgaacataccctcccaatttcattcacatatcacccacattcccaaattcacattcacaatcaacatataacccctcattcacatatcacccacccctcattcccattcacacccacatgcacacacatatataccccctcacacccaaatgcacacacatataaaaagaaacacccacatgcacatacgtccgtggacgacgaacggccgacgacgagcttcggtcgtggacgacgaaggaagggccgacgacgaggttcaaccgtggacggcgaaccggccgatgaagccgttcggccgacgacgtcttcgctcgtggatgacgaaaggccgatgaagccgctcgtggacgactgcgagagagagagagagatggcggcggcggctgtggagcggccggcgacggtggagaggtcggcggcgcggtggaggggccgggggggaagcagccggcggcggtggacggtgccggcggtggagcgctagcccgcgagcttgcgcgcggtggacggcggtggatcgatcgtcgacggcgcaagctcgaaggcccgtggcgcgtagaggacgacggtcggcggtggcggaggacgacggtcggagggtgaaggtcgtaggcgggcggcggcggaggacggcggaggcatgcgggggcgaaaaaatttggcagcctgacggggccaaaatttatagggttcccgccgagacttagaaattttggcaccgcgggcttgcccttatatagggaaatgatctcagtccgcctgcgaagatgtaaaccctactcggcataataattttacaggaattattacaagaatgaccctatctatttcagaattattttaaaatcatttttgtgatttgaaaatgtctacagtagtcgtaataaaaatggtaattgtacatacaaatagataaaccttagtattactacttttcaaatgtaaatattacttaaatgtttcaaacattaatattactactttaaaaaatcatatagtagcaattttatatgtgcacttaccattgttctaaaactttttaaaatataaaaaactgtaaatgttaccctacaaatggtaattgcacataaaaattagtacaaactaatatgcaaaatgttgagtgcaattgttcgtcaatttgcgatatgatcacacatcaccttacataccaccattacataactactaacttattagatgcttacatgcgactcaacaatcattaccctttaacattttttcccacaccgtccgtgcgcatgtaaggcttcacggtcttccgagtagatgtctcgacattcttaatcttctgtacaaactgactataaagtggcatactatcgtattgactgtaatcttcgacatcttcaaccccagacttcgtttgagggtaatctttaattccacaaaagatttttgggtttttggtcttccctaccattcacccctcctctggtaggtttgtttggtcttgtgcgatcccctccacacatttgaatttgacaatgaattcatatgtcatcgtgttatcgttccatgttggagtgaattttctttagtgcacaccctgtacatgatattctttggattgctaatactcttctttctggatcagcatctgtaggcagtactacgtgccacgatacttatatgttggagtattttgcaatcaacaattaatattatttcattttttgcattcctgtccaaactttcatgtatagttcctactacacttctaaggtaccaaattctgaaataaagctcattgtacttttatgatatgttcactgatcaaaactactattgcaagtctgatatgttcaactgtacttctgatgtaccaacacattagctttgtttattgattgaaatttatttttgttctattagtaccgctgtccaagtgtgcagatcaattcgtaatcgatcagcaggcctgggtgttgcttcaaggtataagtggacttgattgaaccatatctatttgtttgatccttatttgcatataaacagttgataggtactccctactatggtatgttgcggggtatattttaattaatttccttttgagatttattattttataagatggggattgttcaactgcaactgatttcgtagtctattgttcagacatttcatttaagcccatccatatagtttgtgaaatataacagttgggccattaagagtgtgtaaagaactcgctgagtcattctatcaaatgtagagcaagatcgatgacatgcgctcccagtattacctgacatactattatctggcttctttggtaaattcatctgaatcacatactagaatgttaaaacgacactgtatatagtgcatcattgtttgaatgagttatcatcaaaagcatcatgctgctagttataatcaatgtagaaaggcctgaatttattcttgtgatttatgctgcatttcacatgtgattagcatattagacaattatacacttttgtcctgaatggttaagtttgccatttgcaaaacgaagtatgcatttcagttagccagggtattattccagattaccattgggtttgttttttggctttgcggtgaataagtatagtgcatagttgtgtaattgtacctgctgatgcattagattagtacggacatttcacattcaaactggtatcaaaggagtttttagaaatcatggtttacatacatctggaatctttcccctcagtaatgaataatgaagtcactaagatataatgtacactgattggattatactgtacacaatgtggagttcaattttctttctattgcgcattttagccatacttctattgtattttagtatgtggattgggatgggtggttttagtctttaatatgcgcctttagtttgaacccaggcttggagaaatcctggttccgccactcatataagcaaatgtatatattgtgtgacacaaatttttttcagtttgaaacttattttactcaacctccatcctctctctctctctctctctctctctcacaagagaattgtcatcaaatgtattgattcttatgcatgctatctgaaaattaatgttatgttctcaggttctgaccattaaccagtggtacacattctcatgttttggaaagagcacacaaataaactacaatctcattgcacacaacacagtgtcctttattggttgtctccagttgcgtttacttggttcctagatctgccattcttttcttgcatccacaaccatggaaaattttcgtatactggatttgcaacctacctgctttatgctatatatagttaaattgtatatggcttgattaatttacgatattttaagtggctgaaaattgggtgaatttcttctttattgagcaccttgtggctaggtctcttatatatagtactactgatgcaaaggcttccctgtgcattcaacgagttcaatgctcgcagatatatcttctggttgtgattgctgtctttatgcatctctattgttccttggccattgaaatgattttcgatacataggcatcatataatcatttgagtatactgttggagtaattagtaaagttggagctgaatttacatcagatgcatctgtactaagcaccaatgttcttgattttattttatgacttgtaattgcctacttttttgtgacctggagctcaaattagaaaatgatgttaggaaagcttgtgattcctttcggcccaatctgtagttatttcttttctgttaattctgaaaagttgaaaattgtttttcatattctaacaaaaaaatatgcatacatctatgattgctaagcacataatgccatgcatacttccatatgatatgctttagatggtagaaaaagttattgacttaactaaaaattgattctgaattttttttctttatattcctatgatatgctgacaatagctaatcttgactcatttgggcccttcatcctcttctcctccatcgtcatcaacagagctagacaattcaagtcagtttttttcacaaatttctttggctatatggattatatacaacctatgtgaacttattttgatgttagtagcatacacatttctatcaactgattcttctgataaatggaaatcaaaccgacagaaacaaattactaacttcttctgataaatggaaatcaaaccgacataaacaaattactaacttgaaaggattatctttagaaaaccttggaggaaaatgtactgtggtagagaaacatgacctaacctccattgcaaacgtcaatgctaggtagaaattgttgacggtcgttatagaccaatttcgaccgtcaatataactaaaataacggagaactagctatgcttacaatgcatatttgttttagaataatctattttcacttgtacttggattctatttgcttgtagagattgatacataatacgaaggagaatcgacaacaaaacaatcgaacaatcaatcagccactgttgggaactcagaaatgacatgatcaaataagcccaaaattcactgttctagattaaggagcaaacgaggagtcatcctgccaaaaatgggccaggttggcccagcccatggttcggccgaacccactgcagcgccatttgatccagggttttgattggatggctcagatggacttctaatgacggttggagggtgttaccgacctttccaaccgtcataaccgtcattaatcagctataaaaggagctccccttgttaattctcccacacactcaagcaagctcaacatttctctctatactttagtttagtattctagtgctaagtggagtacaatagcatagctctcggagtcctcggagtcttcgggggaattcgagtatggctctagtagtttttctttattctttcgtaagagtttcagaattaatgaaatattattctttatatactctccgtactttagtttatctgagtatcagctttactttatatttgtattggtatagttgtgtagttagcctaccagagaggtgcaatggtgtgggtttagtctccgattactcggctgctctatgtcatctcggaggatatagagtagtatttaataatgtagatgtggtgtttagattattaagtatcattatctgggcatatatgctacgggtcagtcgaggtgggccgctaatggtgacagctcggtatgggtattcctcgacgctagtatgtgtttctaagaaactttcctgggaaggatactcctccgtatttggccccggttagaggccatgacacgttgtcgtaagaaactcggcaacccggggtggtctctcgaaacaccaggagggcacttttaggggctattggctactgttggcggctgttaaatgctgattctgtaccgccaacatctgcataaagttcagataataaaacatttaacatagcgataggtgcttaatctcacatattccacagggttggtgtatatttatatgcagataataaaccatgatgttgggaggaaatatagactaaagtgaggataaatatgtatccatacaaggatgggttgtgaacttcatagaaacactagagaatcagcccataacaccgaagaatggatagaggaggaccataagaggagccaggccaaaggccaggccagggggggccaacccaggttcgtggttcggccgaaccctggtgagcgccgttggatctaggtttttggcatggacgctccatatttctccctgatggcggttgcgggacagttcgaacatttctccttcgccaaccgtcatacctacctctacataaagacttcacttcactcacttcaacacacacttccaagtttgagctgaattataagaggctctattgtaatatattgtatactagaaaggaagagagtaaagtagaagaagtcggaagaattccagagttgttggtaatcttctcctatttcttttattctgtttattactctgaattcaatataatattcttcctgaataatttagatttatcctgtgagaattatttcttggttagttcgtaagttgcatacgggattattgttcactataatcaactaaaatatagtgatcgctttggtgagttataaacactaaagtagatattaattgcttagacgtggtgttttggtaattattatccagtaattgctgcgtatcccacagtatgtttgaggtaggtgtagaggtggtgacagccttcgagatcacttaagtcctgcctgtctgggtacgtagtagagcgacatctagaaacagcgggttgctagtgcctgaagtattgaattaggattaaagttaagctttccctgacactgtttctcactagaaaatcctctctatcctggcctatcatttgcttggtgtccttaaataaaccggaggaagatctgaccacacacgttcccttgaattcgatacccttgtaatactctgtaggggaagtgctacagcggtatatccgtgcgcttgcgaattttatctgtaatcgtaagaagtaccaacagctacatagttgtatactagcagatgtaaactaaaattgactttatactagaagtataggaattgattgcttttctatttcttcttccacatagtgtaggattgattaatgagagatatgagttctttgcttcgtgtcactctactcttataaatatattaacccctacttagaccctaatcatataagtggtgtgcatacattattagcatagttctctcttacagtcttcccctgggattaaataaatacgataacttggaatactcccaggtgaaatgctacaatggtatatccgtgcgcttgcggattcttgtaaccatatatataccaggaccatttctagtgccattgttgggatgcatgcctggtatgatatgatttggtaagattgtgatatcgtaatcctgcacacgcatgagatcaatgcattgactctgcaccctaaacactgaccagtttaaaaatccattctatccaattaagcatttatggtaaaaatagaatggatgcgaaaattataactagccaatataggatcggttcaatatatatatttggagaaaagtaaagcattacattatctagtaattaacaggaacccaaaatagtagaccaattattttctacttaattggatgagtttacctatcatagatgaactcaaatgatggggattcaatggaataataaatcacaattaattcatagatgaaatgcttgctatctgttgcctgtagcctccgtgtatatattggcttagcctagatgaaatgcttgctatcttatatgaattgataaacaggatcaatggaagagaagagcattcggaacattgttccaatacagtccatgaacacgacaagtgaagcgccggctattttcccttatccgttacaagagagtgtgattcatgcacttgctgcaagggaagcaactgctttgcatcgtcatgctgctacgagtcaatatgtaaccagatgcaaccaccaaaccattgcataaatcggcggatctcgtattgcggttgtggttctagtagtatctaatcatcttatttctgcaataataaatggatggctgtcgaggagtaatcctctctagcgggagaacgtgagacccccctttgtgagttcggccaggggataaggtgcgatgatcaagagcctatctccgccggggatctagctaacgaggtggttcgcaagcgagtaagagacaagggattatacaggttcgggccgctaggaagcgtaacaccctactcctatgtgtggaattaagcttgtgctgttacaagggaaatccaaccctagactcaagcttctcaagtgttgtcccttttctcggtgggtaaggtcctccttttatagttcaaggggataccacatgcaccgtctgtatatatttcatcattggagggggggggggcacacaacctggctcaagccaccgtccatgccttcaaccggaagcaaggcggtcgttcgcccccaggtgggtcccagcggggacatccctgtcattccctcttaatttcatggagacttttgtggattcatctcttaatttcatggagacttttgtggattcatgcacagggggcacgcttggctgcatgccgatgggacggggcatacctgcccccactccgcctaacacagggcgggacgtgggtgcgctgccacctgtcccatccgcctgcgactggtcataggccggtcaaggccgattgatgcacgtcaatcgggcggcgccacacgcctacccacgccgcataaaacgcggcgagggacggttggggcgccgctcattaaagcgcttggcagcaccccttcctccgcctactcggccgccatgtggcagccgagtgagggcctcggggcggcgcactccaagggcccgaggggtgcgacggggcaccccgaggccccttggccacttgacgactgcccgacctcccccgagggggagggaagcaggctgcgcgaccacgtggccagatgaaaggattctttccctctattgtgcgtacccccgagcccatatcaccgatagtagcccccggcactacgtctgaccgtgacccctccagggctgtgtggttcgatgcctcataacttctgtcttgtgatggtgggtcccgtgaggagttcaaatagccgtcatcggtatacttagttcaagcgcccaccatgatgatgactcgactgctaataactgcgccacgcatgggggcgcgtagggcgggaagaccggggggtctgccaggtcgtgcctagaataattatctgccgtcgcgttgactacctgactatcaggtgtgcgaggaaacgagactatcggtgggcccgcccagccacaaccgtaatcatagcgcgccccgcgtcgattatgccgctgacaggcgcattaaacgcggggtgtggatttagtggggcgagtgggatgagcgggcgcgaaaaatgaggaggcagctgtggttatgggaaacgaggaggcgggcgctagcgaggcgagaataaaaatgaaggaaggaagagagctcgtatccttcctttcgccattatcactctcgcacacacgctcctctgcccccagcgttccacccttgaccaccgcgcttcactcgcccaacttctcgctcatcctcgccgattgccatggcccaagacaccggcaacgccgttctcctggcttcgcgcatcacggcgcagaaacatttgaacctcatccgcaggttcatgccgaagggcgccgtcgtgagggtgggggagtcatggcgctagactcggaagcccggacaccccgtgaccgccattctcttctttttccttgctttcttttttgtgcttttgtaatggacgcggttgactgcaggctttcgtgccgcccctgttggatgtacataagtcttcctcttcgcatttccgcactctttttatccgtgaatgcctgcgacaagggaggatagggaaaaacgcgcagtcaatttccttgcgggtgaatcgctgttttcgttccttcgctcccccccctcgggctcgttcggatatgggaagagggttcgcgcttaacccccggcaccaaagtggcgaggggcagagccgtcaccttgggagaaccgctcagtggggctggccagaccggagctaggtgaccgggggtcggggatgaccgtgtgtaggtccgtccgagcccccagggttcaccgcagttcggggcgcggcccacgtccgggcttccctttggcacttttcaggttgcccgacaccacctaggggccacggtaaggacgaaccacccctaagccggaacgagacttgaggaagggaacgaaaaagtacacaacaactttgattaaacaaaaggatttcttgctggggagaaatggtaagatacaaatattgacaaaggcagcccccggccaagcccgcatggcccgaggggcgtgcggggttggcctgataccaaaaacggaaaaacaatcaacatcacgggtagaagcggcgaaggtgctcgatgttccaagggttaagcagctctgtgccgtcttccgtggccaatcgaaccaagcccggccggtggacaccgatcactttgtacggtcgttcccacattggtgaaagcttgctcaatcctaagcgcgactggacgcggcgtaggatgaggtcatgggacctatagtgaccgggcccggacgtggcgctgatgatagcgccataggctctgttggtagcgcgccgcccgaacggccgcacgccttcttcgctcttcgaaatagtcgaggtcattgcggcagagctcgtcctggtccgcctcattgtacagcgcaacgcgaggcgagcccagggagagctctgacggtaggaccgcctcggtgccgtataccatgaagaaaggggtttctccagttgcacagctcggggtcgtccgattggcccacagcaccgtgtgcagttcccctacctggcgcgctagctgtcgaggagtaatcctctctagcgggagggcgtgagaccccccctttgtgagttcggccgtaggataaggtgcgatgatcaagagcgtatctccaccggggatctagctaacgaggtgagcgtatctcactagtggagataggcacatctatgacaatctacttttgtcacggaagacgcgcaaatcgtcataaagtaacttctatgacgaatttatgacgaaatgggattcgtcatagaagtcgcgtcacatatgtttttctatgactaaacagtagatttcgtcatagaaatgcttatatccatgacgaaggtgctcgtcatagaactgctttccagctggctaggacagacgtcgtccatgccacgtggctatcacacgtggagtccatgttggctgtgatgtggcggatgacgtgtacgccacgctggatcatcatctcccgtacgctagagccaagtggcagtcgtatttaacgccacgtgttggcatttggtatgtccacgtggtggtgcaagctgatgccacgtggtcgaacgtggtggcgccacgtggcagccatattaatgccacgtgttggcatttcttatgtccacgtggtggagcgcgctgatgccacgtggccaaaggtggagacaccacgtggcagtcatatttaacgccacattgccgaaggtggaggcaccacgtgctctcattttgaagcgccacgtgtacatatctgatttgtgacacacgtctttacctgatgttgccacgtgttgatttgtttggatgacacgttagcacagtagggatgacggcccgctcattttttttttcttagcccagcccatttggccacatacttcacatattgttgtggcccatcccactatgagatctaggaaatttttagcattcacccatttcaagcaacaattaatcagaacttcgcagcacataagaaaataggcccaacatcaagattgatcacatggacaaacaatcagaacttcacagcacattacaaataggcccaacatcaacatatatcacatataccaacttcacatagcaccatattacaaaaaagttcacagaacctagcacacatatgttcacattaagtccacaaaagtttgccataggatgacattaagtccaccatagcaccaaacatcatttcacataatcaagtccaccacatgacaataagttcacagaaccatcaaacaactaatataagtagatggagttcatcacagtgcagaagatcataaaggagactaggacagatttaagttaccctgggaaaggctcaagatacatcgaaggagcaaattgttctcttcctgctgctgcttgaactctgccaactccttttgagtctttgccagtgcttcatttgcaagatttgcttgttcttttagtgcgacaacttctgcatggagaatggctgaactttgcttttcagctgcaagttcttcctgaagtgctgcttctgtcggtgtcactgatttcttggagctcatctgcagaccagcatttttcaaaaacgtggtattggagttgtcccgagagagaaccttggacacaacttctgcactagttcttggtgtctcaccatcaggtacaggttcttccataatagctttcatacttgactgcagcaatgattgaacattagctatgaaattagatacatgaaaaactggcagctgcataacacattcaaaatactggcagctgcacaacacattcaaaaagtcactgaaaactgatggaaagctaccaggaagcacaaactagaggtaaggaaacttgtatagaatgcaaatttaaccaaatttgttttccataagccaaaacagaaacaaattatatgagtaagccaagcattcccatatttagaaatattgcattgccctcttaactgtgaaagagaccagaaacattttgagctctaactatggtagaatgtaattattttctatctagcctctagcaacaatgcaggccaaatgtttcttgacagaatctaggatactgttttagcatatatcagaaggctgactttagactatatttgattagctttcatggcagcttttgattgatggaacaccctggtagctataaaagaacaaggttttcccctcaactactttcataaaatttggagggggtgcaatgttacttagcgttggttattttctattcctcctatgatgcctaaatattttccctagaaaccactaatgtttagaaagaaaatactagtgtggagtacataatccctcataattaagtttacttttccaagttacaatgaaataagttttgaagtagtaaaggctgaaatatattcagtcttatgttcatatgattcaaaacctcaatacatgcaaacaccactacagcagcttaggtaaaaatgagttttcatgaatcacaccctcaaacccgggatattgataaaaatacaaactgcaaccaggatcaattgatgaaaaaatgtttatgtagcttatttggcattttaacccaatctcaacttatgttgtatatggtaagttgtctagcgacaagtttccagcagctacaaatttagtttggtatgtattctaacattgttagagtctataaattccattaagtctgtaatgatcttagctgcaaatatctctgcacactaaggacagaaattatcctatggatgtaaatataaaatgagctgaattaataatatgttggcataggtaacaaggaattgagttcaatgttgtaagaatatattgagtgacttacaattgcatctttggcagcatcacttagacctttttccctactggtatggcagtcctcaaaggcatccacagcatcaagctctacaaccttgttattctccttctatttcagtacagaaaatgcagatcaattattttatatatctattacattagataagtggttcttaactacaattaatgctaaaagataatgggaacttacgtaagcgtgcaagtgtgcagcatagctgcgagatcccgtagcctgatggaacctaacattaagccggttttgcttgttctgttcagagatttgctacaaaagatgtatgtgttagacatagtcgcaggtataaaatgaaacaaatatgtcattagagatgacataccatattctttggatttgaccactttgcaacaagttccagccactgttcatcagtcatgctacttatgggagaggtagttctaatctcgttagcaggtactccattgaagtaggccttcttcaaattataccgtgtttgtcgtatccctttctgcaatacatcagcacaagcatcccttgttggctggtgtttttggttaatggccaacctgacctgatggtttgaattgcaatcattaaggagtaacactaggtcatataatagatgaaatataaaagaatatagataggctcttacagataacttgcccatgaagttgttaatatagccttcatcatccttgtactgcttccaatgagggaagacaggaactttagtcctaatgataacaccagcctctgatgcaaacttggcagcttgcaccggttcatctggccttttcttcccttcggcaacagcaatgggcattcttcccatagctttggtcatcttgtcaagcattattcctgcagttggtggccttgattttcttgtgcctcttcgtataggtactacagagtattcaattacaatgttagcattcatcaaatagttaaaaataataaatttctcttcgttgaactaacttgccttcaacatcagaattggtttgctgtgcaggttgctcttcatggttggcatcatgtccatatgaccagtccatcaccgggctcgggggcctgttcacatcattatcttgaagcaaatgtccactgcccacatcttcatcaccattgttttctgtttctggaggcagttcttcatggccattacctttaccttgttctgctatgagttgccttttcgctgaccttgttgagactccaggaggcatttcggttggagcacccgccctcactctctttgatatccttactcctggtggcatcttgagggtaggtttcttcttcgtcgcacacttctttcgtctagtttgtcgagggtactacaataataaacacaaaagttgtaagcatgtgaataaattggcaacaatcattaaaaaaataatcaaatgctgcacaaattaaatgcggaaaaattattgcagatatcctagccccccccccacagccaagatagaagagcacctcaatcattatggggacgggctgctccgcttctaaatatgaatcatcatcacactgaaccccttgttcatcatcttcagggagaaactctgatgtgtcagaaccttctccatgacttttcttggtgcctgagttttttgtctttgaagatgcatgttgtgtttcgatatgtttaatagtggcagctatgtctttgatgccaagttcatccatccttcttatattctgcaagattttctcttgccgcgttctttcatattcgttttgtgcaggttcttacatgaatacacatattttaatggtcagaatactagatggcattttgatggcatttcctaagcatataagcattttcagaaacagaaacaataaagtatctaggcatttgggatgaaaaaaaaagagaccatgctcatcaacattggggatttaatgatcaatggtgaaaaacaactttacttcaatatctagtaaaaacaacagggtgattcacttttccattttaaaagacaattttgatgagaactctggaaacacttttacagtgaacaacattggtcatataaatgatatagccattatatcattctctttcacctaataaactgtatctatttatacgacctcaatcggattgcacacagaaaattcttaatagaagttggacggcaaatcaatccacatgatgtataacatctaatagcttgagacagtacacataaacatctgagcttgagacgacaagataattttgcgtacctcgtgctactggacgtcgacgtcttcccatcggctaggtacggcgacggtgcagggaccttgtcgatggggtacccggctccggtgcggcagtaggcgtcgacggtgttgtgggagatggcttcggtgcggcagtagtcgtcgacggggtaccggctccgatgcagcggaagtcgtcgacggcgtagtgggggaaggatctggtgcagcggtcgtcgtcgacggggttgcagcggaaggcgtcgttgcggcggctgtcgacgacgaggaagtaggggacggatctggtgcagcggtcgtcgttgatcggtttgcacgggaaggctccggcgcagcggtcgtcgttgatggggttgcagggtaaggctccggtgcggcggtagtcggcggcggctctggtagagcggcgccccgatggtgtggcggctggatttggggattagggtttggtgggtgagaggctttgtaaatatatagtggttgcacaaatgcccctgggtgttgttttgctcttcgttagatggaggataaaagtgacatttcccattctgatttgggcaaatgggcggcaatggaatcttttggggctgtcattggcggtaggtttaggcgccgaacgaaaaatcctccatccatgagtaattaacattatccataaatcgaaaacattcaaattatactaatctatctggattaacaatttgactttaaaaatatactccctccgttcaatattatataacttgaaaatttggattaagggggtgtttagttccagggtgtaaagtttttaaagtatacggacacacatttaaagtattaaacgtaaactaataacaaaactaattatagattatgcccgtaaactacgacacaaatttattaagcctaatccattagcaaatgtttactgcagcaccacatagtcaaatcatggcgcaattaggctcaaaatattggtctcacaatttacacgcaaactgtgtaattggttattttgtctacatttagcactcaatgcatgtatgtaaacattcgatgtgacatttttggaaaaaaaaatgtgggaactaaacaccccctaatattatttttttaaagcaactttcctataaaaactttttggaaaacacagacaatttagcagtttaagaagcattcaccgattaatcggaatacggttgtcagacggaatacggttttccacaacactgctttaagcatgactgaatttatttttagaaactagcacctataatatattataggcgtctttttttaattaattggcacctatgacaaattaaaggtgttggtttttttttaaaaaaaaagaaaaccaacacctatagtattggtgtcagctcttctatgtcgcgttttccatctactccctatccacgtcgcgaaatttgccgacgctttccctttcccgtgcgtgggagccgccgccgctgcactcgatggatatgatcagtgatagggaagggtgctactaaccgggactcgtctctgctgtggacgtctaccacaggggcgcggtcgtcgtctcccatgtcatcgagacctccatgtcatcctcgtggttgctcacctcgccattcaccatcgacaccgtggaatgcaagaacctggttccagcctcggtggcgttgccagtggatctaaagccaagctggaggatgatcggcgacggaggatttgagccaggcaggtgataaaatcgtctcagtttaccattcatggatactccctccgtcccataaaaaaatcaacttctggctatgaacctggacacatgttgcgtccagatttatagtcagaagttggttttttatgggacggagggagtatataggtccaattgaaaattgaattttaaaaattttatgttcactttaaactgggtgaaccggtcagtgtttgtaggaaaaatgttggaccggccggttttaatagaatggaccgggtggtttggaccgacttacccctcattcttatcggtagaactgacatataacgagggtacaatcgtaaatcaacacacatataacaacggattcagatccaaaccaaaccaaatcgtaacaaaaaaaaaagagcttcctcctccatggcggtgagaattagcaggaagcgcaggagcccgccgacgcgtgggctggggacctccacgacggcgtgctggagcgcgtcctggcacgcctcccgccggacacattcttccgcctccacgccatctgctgccgatggagcgcggccgccgcgtcaccacacctgcggccgcatcccgtctccgactccgaccgcatcgccacagtagtagctggtccaggtgccgcatctccaaggccgatgctcccagcgctgctggtgaagaggacctggtgctggccatgatcgagtagcaagcttctggtgcttatgctgcttgcttcctggatgtgggcgacaacagtagcttgagaagaaatgatacttctttgtacagcttggtgaattcagattgagatcgtgaatgtgaataaacttatggctgattattgtgttattttgaaaatgtgatgtcgcgtcccaaaatgactctaaaatacatcctcgaaattatgcctagaataattaaaatccttttgaaagcctcccacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaatcctaaaaagtcttttccccccctccccctcttgggccggctcggcccatctccttccctctctctcctcctccccgcggcccattcggcctcctccccgcgcgcgcgccgctgacgggcgggcccgcccgccaccctcgctgacgggtggggcccacccgtcatccccttcctcccgccgctcccgccgcctcgcccgtgccctagcgacgccgccgccgcaaatcccgccgctcccgtccgccccgcgtgcaatcaagaggggggaaatattccccgtgattccctccctctttccccccattttttccctccctctctccctcggattcgttcggaatctttccccctaaacctcgccggcgcatcaatggcggccggatcttccgcgcccgttcccccctcatccggccgacctctctcactcccaaccctatataaacactccccgtgcctccctccaccgtttccgccactcgccgctctctatctccgccggaatcaagctcgcgcc

SEQ ID NO: 36544 - DNA, 844 bp, Oryza sativa
gctgtgccggcgtggccgccttagggcgcgcccccgcggctgccatgtggggcccggccgtcagccgcccgcgccctcgggtgcggctgacgcgtgggacccacggcgccggccggtgtgagccgggtgcacccggtccaccgtggaccgtgaggctgccgcgtgggccctactcccgtggacccggtccgcgcgcccctcccctcggctgacgcaataaatccaaattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcatgtagacgctgcagcttcggaagatctgctcttcgtggaggttgaactcggaatatgttcacatcatctttgaacatattgaatcccggtttataaaattatgttgatttaaattattgcattatcgctttatttaaattcccgcgttatcactgttttatttagccatgcctatttacctttgttatgaccttattattgttattgttattatttccttgttcaccctagattaaacaaaaccccaactagtggacactctactcatggtacctctagtatgatgttaggtagatgcttcgctatttaattaggtaacattaggcggttttacaactctagactttgggatattcatatcacctggacactttggaattgttggagtattgtggaattggattc

SEQ ID NO: 36545 - DNA, 942 bp, Oryza sativa
aaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtaccgcacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggagaagcatcatgagccacttgcgggcact

SEQ ID NO: 36546 - DNA, 32044 bp, Oryza sativa
tatagaatactcaagctgctcctgcgaatgataacaacatgcagtcctatcacatcatggcagaaccactcaaggatgcagtcactagaacaatgccagctatatctctccagaatcaaaatgagcagccatgtttgtggttttcagttcgctacttatcattgtgtaatcgaaagtttgcagcaatcatgtaatacataaatatattcatgtctataaacagtgagcttgctatgcttatggatgattcatgttgaggatacaatgtaccgatgttaagcaccttccctttttgtttaaggcagtgcctcgtattcatgtaatatgggagaaatgtgtaataaaaacaagttctatgaggactctttcagaagatgctgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcagatgtgtcttttttggatcaaaggcaatggcagtcagtatagcttttggcgaaacacttcaaggattcactgaaaggcagtagaccaaaggacctcatcgccaccagaagtgtccgcaacccacattaaagagtaccacctgttagagataggccgaaagatgattgataaaagatattggcaaagaggttctctagcaggaaagatgtaggccgaaaggtgattgataaaggataatcaaaaacatgctctgcatcactcaaggaagacccctgatagtaatcgccctgcaacagtcaccttgtcattgagagaaaaaaaaagtcgtgagtaagcaagatgacctaggtaaaagtgtttctatgaaggcaaggagtgaaatcttcaactcagtatcagatgctacacggagtgaaaactgcaagcaccggttaccaggcaatgccatgtcttgggagatgatccaatgggaaggaactcatcaaggtcaaaggagtaaaggaatacgttgaatgctaaataatgacaacctgaagataatagtgggaagtaaactgaatgtaaagaaccaagtgatatgttcgaagatagtctacagaggtcagattaaaatcacatctaacaacgaagcttcaaatttggcaggataacgatcaaacaataagaagttcagcagtaaagtcatttgggaagacgtcaaagcatgtcaagtgggataatttggttcccttgggaaacataattcaaaggcaaagttatcgaccctcacaatgaatagaggaaatatctagcaccggagaccaggaaagctaatatgagacaatcagtggcaagttgtcaatcatggtattcttagtaagcaggatatcatagtctaaagcatatggtggtaagttagaagtaaatgacaagcatggtattctcatgatgacaagcatggtatcctagtaatgacaagctgatatcggcgcaaaacgtgaagtgggtaacttgtatgaggttgacgccaaagatatgaattatgagaagttctggaactgaagccccatcttccaatgccgcagcctagtcgaagtcagctagaggtgcaaccagggaaaagtcatgtgaagagaagattccatctataacaggagatcgagccaagcagtccagagtggagaggttttgctaggcaagtttgttatagaagacgcgacggaagaagtcagataagaagagaagcccgcccaacctatcttcttgctagcctcctcgaatctcggggacgagattcttgtaaagggggtggatttgtcacgtcctgataaattcatcccgaattaaaaatcattccctaaaaggaataatagaattaattaaaattcgaaaagaaattgacaaacactaaaatacgtgccagaaaaattcgaatgtggcccggagaatttttgttaaattctccttggtctaaaaggagccctcaaattttacttgaattttcagagcactggaaataattattaagcaacaaaaacaattatcaatgtttattaaaaagaaaacctaaaaataaatcctcttcctcctttgggccaagcccagcccaaagtcctctctcccccccccctctctttctccccctcctccctttgggccccaaagcctccctccattcctctcagcccggccgaaagtctgttttacctcccccgtgctacagtgctccttcttccagctcaggcagagcccgagctctccagccgtgccgtgcacagtgccaccgcctcctccttccaaatctcgcctccccgttgctcctttttccaaattagttgcgggaatggaatcctctcaatctcctcttcctttcccccaactttccccctttaatcccgcccccaatcaccgggatttaatccctcttctttgaccaccattgatgccgccggccacctcctccggcgccattttcggcctctcccgtgaccggcactccgtccttgccctataaaacgaagccctcctccttcctttggtccattttgctctctcccgagcccctagccacctccccatcaccttcccctctctcctgtgccgacggccatctccggccgcccctgccgcggcgcctgtgtgccggccggccgtgccgtcgccatccgcgacgtcgcagctgcctcctcttcctcggcttcgcctccgtttcgcggggaaatcaccggagacgcgtcttcgccggcaaaacagtggcgttgccgccactgtaccgccttcagtcgccccggtcgccgcgtcagagcgtcggccgatgtcgccgtctccttcgtcgacgtcgcggcgtcgccctccaccccggcctgccctcggtttcgccggaacgccgtcgcccgcgccgcctctccctcggtcttgtcggcacccactccggcagccccttccgccgtgccagtgcgccggccgacgtcgccgtctccacctctggcatcgcagcggcaaggtcgtcctcggcatcgtttcccctccatccaaacccctccgcggtccatcgtcgtcgcctccgttcgttctcgtcgtcgacgtcccgtcggtcgcccggctcgtcgtctcgcggcgtcgcctccgtcgtcggattcgcagcggcgcgttccacgtcgtccccgtctccgtgcagctgttgccggctgccctcgtcgcttcctcgccggccccggtcgtcgtcgtcgtcgtcctctcgtcgttcccggtcgtcgtggcgttcgtccctccgtcgagccgttctcgtccgtcgtccgcgttcgtcaagcgagccgctgcagccccgtcgtcgtcttcgtcctcggctccgcgtcgtcaagcattgcgccggccgcgtctcaccttcgtccaaggatcgccgctgaagtcgtcccctcgccatttgtctccgtcgttcccggccgcctccgccgcgcccgttcgtcgttgtcgttcccacgcctcgtcgcgtggtggtaaggatctctcctctcgctgccccgtcctcgtcctttcggtgtcgcccgtgcccgttgtgcggttgtcagccccggtatccatgtatcggtatcggtagtcgttcgcttgtccgtgtagtgtccgtgttagtgtgcccgcttggtagccgcgttgtttcctcgtgtgcaacccgtgtggtgtctagtggagtccgtttgtcggccactcgcctcggttgacacacggggtccgcttccgtcgacccgtggaccgtctctgtgtacctggtctaccgcggtcctttaggttgacatgtggggttcgcatgtcaacagcgcagccttcctgtcttttccaggctagcgcttacacatgttttatagtcgcaaagcctaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagttgcaccccggccactataaggattaagctcaggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggatggctagggacgagctgggacccagggtcgggttgccagttcggtctgaatcatcgtaggccttgggttaaggcaggttcgtgcgggttcacgaccttgattaataatactgtgtagctttaggatcgtctttttaaaatggctttgggcaactaagtgacttttaaatgctgttttctgcaaaacttaacccctatatcattatcccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttattgttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacagaaactacaatttagttgtactctctggagctcaaaagttgtgtgttgaagtgtgttaggtctcctactttcatagctgccaatgatggttggaatggcggttaacccctcagaaccatcattgggactccactggagccatccacgtgtaaggtggagatgaggtgggccaggatggattctctagcagcttataggtgggcccctatggcggtttggtcccaatgtaagtcagtttcgactgacttgtggtccgtccaatccttgtactcgcacatgattggtcagaggttcatttttgtcgcatggcagatatattttctccttaaatgacctgcatacatatatttaccaaaattagttgaagtggttagtagtaaactcctaccactatgttttgagagtatatttgatatcttttatgtaggtgttaacggttaaagtttgcacttaacgaccttcaatgacaccccaacacttatcttcaactcgtccctgagtaaagctcatgaacctactagagtaatgactttttgcttcatgacatgacataccaaatattccaagacatacttgaggctgtaaacattgatgtgtttaccatgccatctttaggcgattgaagaacgtaacagtcctcgaaccaagtcccctctactacttctgatgaattaccataggattttctttgatgtttataaaaacataacttttactgtacttctcaattgactccctcaaatcactcaaagtgtttattcctcaccaaggtattgatgttgcattttctcatcctacctttctaattaggcttatatggatctcagggtagggaataagaaatgacatacttgcatcagatatatagtaaagtcaaacagaggatacaacaagataactaatcatataaccatgaccaagcttgtgcacctatgtttatgggtagaaatgaaaagggtgaaaaatctacaataaaaaatgggatggtgactctttttatctctacctttttttcatcgtgctcgagtttgatcattttcttttgagcagagttttttattttagctcatctctcatttggcatggatcatgggaggagagaccacaaaatttttagagtctttattctgtggatacattgcttaaaacatagaagtttagcatatagatatggatggattagttttctttttggctaatcctccagtgtagagaaaaagcaatatttttggtgtctaagtgcacaagactttgctcatgagaatatgaaaagaatctaagatggtcacaaccatttggcaaaactcaaaatgatagcaagcaattgagtaccaactttccgataatgtacaaggtttcatcattaagatcgatatatggctttggtaggaagggaacatcaatgaagagtacgcaaagatatttattttctttttataaaatcccaaggattcattattaagagcaaggttcatatctgttgacggtcgttagcgatcagtttcgcacgtcaatattaccaaaataaagtagaactaagttttgcttgcaaagcatattatgtcaaaataagatatattccactagcactaggctttctaacctcttgcagagaataaacataaaatggaggcgattcgacagtaaaatggacgatcaatcaatcggacgctgtcgaggatcagacttagaggaagatgggccaagaattcagaaagaacacaaccaatgggacaaaactcgcaagtctgcagaaaccaacagaagaggaggccgccagccgaaattggactaattttggcccagcccatggttcggccgaacccccttgagctccgttggatgcaggggttggtttggacggtgtggattagctccgaatgatagttggagggtatttccgaccattccaacagtcacaaccgtcattggagagctatataaggccttcacctcctcacctcttccacacatctcaagcaagaagcttcatacattctctcaagtttaatatagtttctagagtatagtggaatagaaatagaatataatcttcagtccgcagagtttttggaagagttcgggtaagactctagtagcttttccttcttttgtaagacttgtactatttatagaatattcttctcaatatattctcatttttgggggttatatgctgcggatacgtcgaggagggctactgatggagacagctcagtatgggtattcctctgcgcgtgtatataatcctaagttatttttttagggagggtactcctccgtatttagccccagttggatgggcttgacgggttgttgtaagaaactcggcaaccaagggtggtctctcgaaacaccaggagggcatcataagggggtattggctatacggttatatagtagataatattgactaaagtgtatgtatgtatattagaagtataggaaatgatccttttcttattctttccacttagcatagaattagtaagtatgagaatagtgaatgcttcagctttgtgtcaccctaccctttgaattgaactaaccccttcttagactttgattattacaagtaacatataagtattagcttggttctctctattataattttcccacgggattaaaaaaatacgatacccttggaatactctcgggtgaaatgctacaattatccatgtgcttgcggatgaaatctgtaaccataatataccacgagtggttttgcaccattgctgggaattatatttctagtaatatcgttaagaaataccaacaagcatttctagcgccgttgccggggaagatttataaaagagattactaatattttatatttatctctgtataatcactgtccttttgcaggctaaccttggttattttcgcttttgctgtgaaaatagggcagtgtatgactagtttcaacttgccggaaaatttcaaagaaaatcaaaaagttttcttctggagtgttaagccgcgcatcgttcctccgcagaaatctctctcggcaaagaaatcagcgtcaccgagcttcaagtctatggccgagaagacccttcaagagttcgctgctccctcagctgagaacgtgcccgttaggccacaaattaacttaggagacacaaacttcgatctgaagtcgagcctcatcatgatggcgcaggctagcccgttctgcggcaagcctaaccaatatgccagcgcacacctgcagcaattccaggagatatgtagctcgtacactatgaagggtgtcagtccagacgcgtcaggatccagctgcttcgtttctccctcctggggaaggtgaagcagtggttctatgccaactgtgctacaatcaacacctgggacagatgctctacggcatttttgttgaagttcttcccgatgggtaagaccaacgcccttcgtggaaggatttctggattctagcatacgagggatgagtcaatccccgaagcatgggcacgacttcaggagtatgtggccgcctgtccttatcatgggatggatgagtggctgatactccagagcttctacaacgggctcactcccacgtctcgtgaccacctagacgcggaagctggaggagctttcttctctaagacagtcagaggagccgtcgacttcatagagaagatggtctccaccatggactggagcaaagaacgactccagacccgtaagtgaggaatgcacaccataaaggagaccaagatgctcgctgcaaaactggacctcctcatgaaacatttggacgaccacgagaagaagccccagggcactgttaaggcattggactcacatgtaacgtgcgaggtctgcggcagcatgggtcattgtggaaatgactatccggaaacacgtgaagaagcgatgtacatggataacaacacaacgggttccgtccacagggaggtcaggggtgaaaccaaccccacccatatttccaaggagccaacaataacggtaacctttctaaccaaccttccttgaaggatctcgtctttgcacaagccaaaacaacttacgcacttagcaaaaagctagctgctaatgacaagatactagagaatataaacgtcaagctagatggctttggttctgcatttcagaacaagcttagttttaaaagatgattgaaacccagctggcgtagcttgctgcattaattcccgctaatgaataagggagggttccggagcaaccggaaccttatgttgaaaatgctaaggcgattacaacgaggggaggtaagtccactcgcaatctgccatatcctaaccctgcagggaccggcaacaacagcaacagggaagcaccatctagtgacacaactgaagaagaggttcagtcaaagaagaccgtgctgcaggagtattgtgacacgagaccgctgccactcccccagagatacaagaagccgtcggtggacgagtagttcgctcgttttgttgaggtgatccaaaagattcacattcacgtgccgctgctagacgtcatgcaagtgcccacttatgcacgatacctcaaggatatcctcaacaaaggccactaccgacgactaaagtggtcaaactaatggaggaatgcagcaatgccatactccacaagctcccggaaaagaagaagggtccagggtatctcatgatcacctgctcgatcgagacacagaaattcaaccaggccctctacgaccttggagcaagcgtgagcatcatgcccaaggatgtcttcgacaaactcaactttacagtgttggcaccaacaccaatgcgtctgcagctgggcgattcattggtccattacccaactggcatagtggaatacgtaccggtcaagatacgggatttcttcatcccggttgacttcgtggtgttggatatggaatctgacaaggagacgccaatcatcttggggcgtccgttcgttagtaccgcagatactaacattgatgtgggaacgggaagcatccgtttttgtatcaatgggaaggaagaaaagtttgagttccagccaaggaccgagcaatgctccatggtgaggataaagtatgggccaaacccgcaaaatattcatgtggtcgaagtggagccacccaagacagacagcctagtaaaattcatgcagaatttcctggagaagggaatgccggtaaccaggtcccttgagaagaagacgctggtaaaatctagtacaccggctaagaaacaagagaagacggctcaaaagaagccgccacctgttgacggtcgttagcgaccagtttcacccgtcaatactacccaaataaaggagaactagttatgcttgcaatgcatatttatgtcaaataatataggcaaaatttgctacaggacaccgaaaaattgcggtctttgctgcgagacacccgaagatcgtgtatttgctcgtggacactgtaaaaaagtggtaattagctgctggacactcctcccattattttattatctccggtcaaaatagagagagaaagagttgtgtaattaccaaaatgcccctgtacagtgttctttctctcacttcttttcttttccccttcttcttctttgcagtggagtagagggtgacggcggccggcccgagccgggacggctcggccacggcagggcggcggcggcggcgcatcgcccatggcaccgccggtgatgccctccgcatcggcggcggcgagctcgacttcttcacgtcgcgctcccgcgccgcccgccttgccgacctgatcaccttgccgtggcccgcctgcgtcgtcgtgtccaagcacgctgcccgaacagcacgtcatctgcttcatcgaggaagccgcgcaccgcgtctgtgaggcactagcaacgtcgtcgaggctgtccgccacgtgcgctccatcatgggcgaaatccgcacgctccgcgacatggacgacgacgaggtcttcgcctacgccaagcgcatcgccgcgccctacgacctcgtcatgcagaccaagcagctgggccgcctccccgtcgtgctgttcgcggccggcggcgtcgccacccccgccgacgccgccctcatgatgcagctcggttgcgacggcatcttcgtcggctcgagcatcttcaagagtggtgaccacgcgcgccacgcccgcaccatcgtgcaggcgatcacccactgcaggtcgttgcgtccaagcacgctgccgcctcgtcgtcctcgctggcacaccttcgccgtggagctctgcccggtgtgccgtgacagagaaagagaggaagagatgaacggagagaaagagaggaagaagaagaacggagaaagagagattgacaagtgggcaaatttgtctttaaccaaagtttctctctccattttgaccggaaataataaaataatgggaggagcatccaatagctaattaccacttttttacggtgtccacgagcaaatacacgattttcgggtgtctcacagcaaagacctgtagcaaattttgccaataatatatattccactagcactaggattactaacctcttgtagagaatgaacacaaaatggaggagaatcaacagtaacacaaacgatcgatcaatcgaacgctgtcgaggatcggacttatcaatgaatgggccaagaatgcagaaatgacatgaccaattgggccagaattcataagtctgcagaagagatctagagaagaggccaccagccaaaacttgggctggttgggccggcccatggttcggccaaaaccatcgtgcaaccgtccgatgcatggtttgcgctggattgtccggattgctccgctatggcggttggagggtattaccgaccattccagctgccataaccgtcgttaccaagatataaaaggagctctcatcctccattacaagacacacctcaagcaaaaacttcatttcatcgctcaagtttagtagtcttctagaagtataagtggaaataggaaatagagtaggaattatcagtcccacggagttcttcggacagaattcgggtggtggctcttagtagctttttccttccttatgtaaaaacttgtacctttagaatatttcttcttttatactaattctggtatctgtattttatttccgaagtatattaaatcccacctttccttatattgtccaagtttatatgttataataatgttagctatctggaagatgcaatggtgtaggtataatgatcgtgtatacgatgactctatgtcatgatgataatattagagtagtatttggtaatttaagcatggtgtttgttgacggtcgttatcgatcagtttcgaccttcaatattaccaaaatagaggagaactagagatgcttgcaatgcataaacatgttagaataataatattccactagtattaggtatactaacattttgcagagaatgacactaaagtggaggagaatcgacatcaacacagacgataatcaatcggacgatgtcgagaaccagacttatgtgtgaatggccaagaactcagaattgacacgacaaactgggccaaaattcacaagtctgcggagaagaacaacagaggaggccaccaggcaaaccatgggctggttgggccggccccaagttcagccgaaccagggggttcggccgaacctccctcatcgccgctggatgcagggtttcttctggacggtgtggattagctcccaatgacggttggagggtatttccatgatgaggacataactagctcggatatgaccatgactaatttatatattcatcaaccaaaggtgcatatgttctatgttagatttacttattatatatttgaacaaatgttgctacacagtgagtttcgtgtgttttcgtttgcagaggtacttgcttgggagaaggaaaagaaatcgagcataaggaatacttggatgatcaaagaagttgattggggaccaaaccaagaccttctccaagtctatttctacctcaccatgtcacttttggtccatagaagacaagagatgaagttctacacgtttttgattcggattcgggcctcctgacagcatcagtctactttcagatggttttggtcccacgtcaaaattcctatcgagctgccggggatcttcaaaaaaaggagagggctacacgtcggacgtccgatgctttagggaaaaatcggatgctgacgtcagcatgacgtcagcgcccgatttacgtgcaaaactacttttaaactaatttttctcttaaattacttatccaaatcatgatccgattacaccattaaattcgttgcaattaaatcttcaatacaagaccacacatggatatattccgataaaaagaaattttagcttattattgaattatctttaaatttttagcttattccaccagttatatcgaaattgtttcactaagtagatcgaaaatgtttcacttgtttaaatctggtgttgtttcaccttatataaaaacaatgtttcagcaaatagcgaaagaatggttcggttcactgcaacattagatctatacatagtgaaacattataagtacactaggtgaaacatttttcggtgaaacaaaaaatgaaacgaattcccttaacaggaggtttccaaaatatgtgggttttttgttgcaatgaaatatttcagttcactgcaacattagatctatagatagtggaacattgtgagtgcactaggtgaaacattttttgtggaacaaaaaataaaccaaattcccttaatttagagtttccaaaatatatgggtgatttattgcaacggcgtgttccactgcaacatttgatctgtacacagtgaaacatcatgagtacactagctgaaacattgtaaaactactggttaaaacatcaaaagagaccacatgcaacattaaaaaaatcaataaaaaattaaaatattttgttgtcaaaatataattatgtgtggtcttgttgtaaagatttaattgtaacgaatttagtggtgcaatcagatcgtagattagataaatagtttacgataaaaattcttttcaagaaataagaaaagaaaagattctttgcatgctgcagtggcaggaaaaaacaacgtctaatttttctccaacccgccggtggttcgggtgtgagcattttcacgaagaatgggttaaatcaatagtgggccccacctaacttttcgtccgatattttgtttcgctccggacgctcgatacgaagcgttttcgtcaaaacaagccacatatctcatccagtcccaatctgatttgggttttgggcctcgtaattgtgtcgtgggcttagcccaaggtggtgtgcaccctagggcaacactaggacgtccctaatcacatttattcagtagccgtcatcgtttagagttgggttttgcttagattattatgtgaagaatagtttcgccgctagttcggtttgtggaaccccaaattctagtgcttaatcattcatatgcaattgtgttgcaatctatcttgttcttgcttgtgttcttcgattcgcatgaagggattagccttctcggcaaggtcaactgggtttcggcacggttgataaccagaggagacatggtgctgcgattgcggggctcaagagcgtgcacgttcaacaagccggatcaatttgtgtcgtgactccacccaaatcgttgtttatcagaacctttcagaagatcgggaaccctagtgcacatcaagtggtatcagatttagttgaaggcatctgagaacaaccaaggtaatgaggaggaagagaagaaagacgaagagcaaaaagatctatccatagctccatgcatgcttgaggaatgtttaattgaccaagcgcttacaatttctgaagatgagaaaaaaggtagtgacaatggtgctacaactgctcaaggtatgcatacttatgatgtgccaaatatgtccactacttgtgctacattagagcaaagcatagtggaaacaattgttgaaatacctttgtcacaaaacaatttgcttgatgtttcttgtgataaagaagagttgtgcgatgcttcacttatatccatgccacaactagtgaatgaacatgttagttctatagtacagccactgtgtgttgagtttaaacatattattcacattgctagtgagaacgaagagattaaattgctatcttctttaaatacttggggttaaattcaatttgatgatctttgtccactcaactgctaagagaagaaattatttgctagatttgaattgccatgcccatctgatgtgatttttcatattattggcaattacgataataaagaagaatataatgtgcatcgagtatatatatgttcgaatttgactatacctccttttcataatgaaatgcattgtctagaggacctcatgcgtataagtaattctctatctatttcctctagttgttcaaatgagttacaggttggtttgcaagaaggggagtgttgtggtgtttcgactacaaagattttaggatccaaccatatgtccatcaagaaatggtcctcaccagatgttgtgatagataaatataagtacaatacgctccatgataaggtgaaaccgaggacggtttccaatcaagaaggggaggatggtaaggacataactagcttggatatgaccatgactactttatatattcatcaaccaaaggttcatatgttctatgttagatttacttattatatatttgaacaaacgttgctacacaatgagtttcgtgtgttttcgtttgcagaggtccttgcttgggtgaaggaaaagaaatcgagcgtaaggaatacttggacgatcaaagaagttgattggggaccaaaccaagaccttttccaagtctacttctacctcaccacgtcacttttggtccatagaagataagagatgaagttctacacgttctggattcggattcgggcctcctgacagcatcaatttcgaacggtcctagccgctgatctagaaggaatttcggggcccatgagtacttgttggaaagcttatggagtctactttcagatggttgtggtcccacatcaaaattcctatcgagctaccgggaatcttcaaaacaagccacgtatctcatccagtccgaatttgatttgggttttgggccttgtaattgtgtcttgggcttagcccaagggggtgtgtgccctaggacaaccctaggacgtccctaatcacatttattcagtagccgtcatcgtttagagttgggttttgcttagattattctgtcgagaacagtttcgccgctagatcggtttgtaagaccccaacttgtgagcttaatcattcatctgcaattttggttgttttctatctcgttcttgtttgtgttcttcgattggcaaacagggattagccttctcggcgaggtcatccgcgtttcgacacgggtgataaccaaaggagacatggtgctgcaattgcggggctcaagagcgtgcgcattcaagaagccagatctatttgtgtcgcgactccgcccaaatcgttgtttatcagaacctttcggaaggtcgggaaccctagtgcacatcattccgaccattccaaccatcacaaccatcattgggaggctatataaacccctcgccttctcacttcactcacagacctcaagcaatagctctctcatttctctcaagtttagtttagtagtatctagctggtggaatagaaatagtgttgaaatcaggtgtccggaagccttcggaagagttcgggtatggctctagtagcttttctcttctcttttgtaagctttgtacttttattagaatactcttctaaatatgagtacctactttatactatgttcatgttatactgaatatatggctagcttatctgggagatgctttggtgcgggtataatgtttgcttatgcaattactctatgtcatgacgacgatattagagtagtatctggtactttagacgtggtgtctagactacgggatatcgttatttagggttatatattgcggatgagaggtgggccgctaatggtgacagctcagtacgggtattcctccgtgccggtatataatcctaagttaattaatttcctggggaaggtattcctccgtattgagccccggttgtatggtcatgacgggctgtcgtaaggaactcggcagtcaggggtggcttctcgaagtaccaggagggcatcggatagagggtattagctagtatatcggttaactagaatatatgtatactatgtatattagaagtataggagtagattttctttctcttttctttccatttagcttagatgaattattatgagaatgagtagttaatgcttgtgtgtcactctacccttggattatcttaacccctgcttagaatatgattatcataagtaatatataaattattagttgagttctctctacatgatcttcctatgagataaaataaatacgatacccttggaatactctcgggtgaaatgctataatggtatatccgtacgcttgcggatgaactctgtaaccataatataccagaaatatttctgcgtcattgctgggaattatatttctagcaatgtcgttaagaaataccaacagtgtttagattattggatatcattatttagggttatatgctgtggaagcgaggtgggctactgatgctaacagctcagtacggttattcctccgcacgtgtatatagtcctaagttaatttcctggagagggtactccttagtatttatcctcggttggatggtcatgacggattgtcgtaaggaactcggcaatcagggtggcttctccaaccacaaggagggcatcggaaagaggatattagctataatgatatgactaggatgtatgtataatatgtatgtatactattgtcacgccctgaagtttcccccttcttctttctttaaaaatttgttaaataaatcgtccaaagagatggttcaaattaacctagagctaattccctaattaataaatgcaattaataattggaaatggcattgtgggatttttcttgggttccacatgtcgcaattgattaacaagatttttagtggaattttcagagccttggaaataattttaaccaattaaaaatgagcaagtgcaatatttaatcccaggaaaaatcctttcttctttttcttttttcttttccttctttttctcttatgggccgccggcccatctcctcccgcgccctccccctcctaccgggctggccggttccctcttcccctcccgaagtccacccggcctccccctcactctcaggtgctgacaggtggggtccacctatcagcccttcccctacctccagccggttggagccaagctccaaccgccggcgcccccacctccccacgccgcccgccttcttcggtccacctggtgcccccactccacacacgcgccgggtcaccgccctctgccgccccactctcgtccacgcgcgcgcttgcaaggggcgggattcaatttgaatccccctctctctcttcctccccactctcccacgtcgccagcaaaatagggaggtttcccgtccacgtctgccccctcccgcacctataaatcgctcctccgagccccctcaacctttttccgctctggccgcgctcgcccgtgcactccgccgctgtccccacgccacacccgagcttcgccgccgccgctgccgcccatctccggccgcatgccgccgccgctagagccgccgccgtgctaagccgccgctaccattagcttcaccgccacaaatctttcccggccgctgccttgcgttgccggaatcccaccgaggccctattttcctcgcgtcgccggtgagtcctctctcccctccgactccggccgacattggtggccgccgtggggtttttgctccgccctaattcctctcctcccctcctctaggtgtcgccgccgcccatccacccctccactcgccgggtcctcgttgtcgccttcgccttccgcaccggtcgccgccgcccctccggtgaggaacctgccccctccctccttcccactccccgtacgcgccacttcccgcgccgccggtcaccgccggtgaccagcacgccgccgccgctcgccatggccggctggccgtctttgtgccgagccgagccgtgccaagccgccccccgcgccgtccgatcggcctcccgtccgatcggcctcccggccgatctggaccgtcggtcccgtggaccgccgcggtggaccacccatgtggtcccaatccacggtgtaccggcgccctttcagccgctgacaagcggggcccgcttgtcgacacagcccccccggatgacgtcagccctgggcaatatcgcgcaataaataattaaggactttttctttactagtaaaaacacagattatcttctaaaaatcatatctaattcatccgagctccgtttaagtccattcaagtcttagtaaattcataaaaatccctagaatccattaaaaatggttttgtttcctgtttcagtagtcttatagcatgttttgcttgtgtgctttgtttgtcgagtagatttcggccgttttgtcgatccgcggtttctcgaagacgttgctgagatctcatcagtgcgagagcaaggcaaatcatgcattacaattgatcatattgtacccaatttacaaatatcctgcatttctattaaatgttgcattcttttacaatgtcatgtgggatggttcctattactcatccatttattgtttaccctatgccattgataacttgggtatcaaaatgactagatgttggtttaggaaatgcttagctatgcttagctcaactagtacacaaatggggatcatattactatatagactttgactattagcatagctttggattagtgccaccacaatggtgttagttaattaaaatacactgaatggtgggttgtgggtgcatggttttgctggtcgcacccatggcaattaaggaccggttcacgggaaaccctgggagacttaccgtgcttaccacaagcgggagtgggtaaatgcttgatttgaagtacagctcgaccctttcctaggcaccggtggcgagggtgggcatgatggagttgggtcggcgggggtgtccggttgtccagctgccggattcaccgcggcgcaagacgggaccgcccactgccttttgaggggtgggggtgaaaccttagcgtggtgtggatggttaggggagggttatgcagagggtcttgtcacgattaccccctttgcagtatcatggtgatacttcgggcatggcgacatgtgtggaatcgtgtcttgtgggtacagttgtacacgtctggccagagtaaaactattcgaatagccgtgcccgcggttatgggcgaccaaccagattcaccgtgattagtctcacccctagtttagcttaatgaactggtgtagtttaagtggttggttgggcctgttgcagcgtggtgtagcgttggacaatgattggttaatattaattaattactacaattgttttactgctttcaactactgcttttaaatgcctgctttatgcaaatgaacccttagcctcctttggatatatcctgcatcatacctcctcttctggtatgacttgctgagtacagtggatagtactcagccttgctctcttttcccccacaccagagctgaagatcttcctagttggagctgtcttattgaggttggtttcgtcgctgccgtcaaggattgcctgtggagtggagtcgccccgctgctgaagtcaagcttccaagtctagctcgttttaccttttccgctgcatttgtaatcttttatatttttgtaagatgtggatctgtgtgtcaacaattatcgtttgtgtaccctggctagtcctagacaggggtttaatgcacattcagcttagaaatcctggttcgtgaatttctgggcgtgacaactataattataggaatatgatctttctatattctttccacttagcttagataatcatgaattagagtataaatgcttctgcttagtgtcactctacccttggaattatgttaacccctgcttagactttggttattacaagtaatatataaattattagtacggttctctctattataatcttcccacgggattaatcaaatacgatacccttggaatactctcaggtgaaatgctacaatggtatatccgtgcgcttgcagatgaaatatgtaaccataataaaccacgagcgtttctgcgccattgctgggaattatatttctagtaatgtcgttaacaaataccaacagtcacctgtgagctcgtccatggcggctagaattcttttgaactaggtgattccccgcgctttactgcaggaactaattaacaattttcactatattttttcgacaattgagctaggagttagaagaataatgaaacatcaataattatcagaacttatgataaaaaaaaataatacccgcactttaatgagtgaaacatattgataagtatatagtaaatattgttaaaatgatagacttgttaaaatattacgaaaatcatgtgagggtgtgataattgaatatgcttgtatgctgatttgtagaattaaatagattgtagatgatattgcttgattgcatgagattaaatatgtaattattgctagtgggtgatgatgtggcatggttgcatgttgagtatagattgagggacacgcttgggagggttgcatggatgaatttattttgtctgttcttccatttgatgcagtggtgatttagacgatttcatttgaatttcatatttgatatgtggaaatggaatgatttgattttaatttcgtgtttgatacatgaaaatgggccgttgcatgcatgtggttttttttgtctatggccactctaaatgtgtcctttttagattattgggtggctaataactaacaaacagctaatattctaataactaacaaacagctaatattctagagaaacaaacagctaacaacttattttatgtcgacttattataactagctcaataatcaaaattacaattatattaagcttaaacaaacaggcttatgctggcggttatcttaactagttgcctacaaaaattagacttttgcacacggtcagcttaatgtagccgcgagagaaaaacattttcactgtcggctgggctaggtcgcccggcagtgtaaatgcctttttgtttgcggctggtggctgctagtgaaaatgatgtcttctcattggccattagtcactggtggaagtgctggtcactgtagaaaacccaaattgaccgcaacaaatccattttgtagtagtgttttcacagttttggtttttgcgtgcttcaatcattcaggctttgttctcgctgtgtggtcctacattgttgttatcatgccatgtaccgcttctttgaattttgtctaaattaatgtgcatttgaaaaagttaattacgtcggtaatacttcaatgtgtggcggaggccgggacggcgagcggcggcttcaccggcgtgacgacgagacgaggacggattgaagaagggcggctcccgtgcgcgcagccagggtaccggtccggccagaccccagtggcgcgggagtggaggaacggcgtcggcgtcggcttggtgtcggtggaggtggtggaggagcggttgatggtggcggcagcgactccatctccaagggaagatctcatggctcgccgggcagtgtcaccactgcagtccaaccgtggtaggcgcagtactgcaccccctgcacaaggatccggcgaggttcttcggcaaccggaggcggaggaggaggcgcaacagggacgggcgggggaaccacaaccggagttgcggtcacacggcggcgagggtagtagcagcggccaccaaccctagccctgcctctgcgggatccccgcgcgtactcctcatcggtcggcgaagaagatgacggagccggcgtacatgctgatggcaagggaggccgagaacggcatccatgatccaatgaaaggtaggcatcgtaccttctctgatgattcttctgttcgcttttctgttagatcaaaagcgatgttttttccttctttcacttcgcgatctccttcgcgagagcgaaagtgctgataacgtattgtgaatagaattgattgagcaagagagattgagtgagagagaattacacacaagaatgtagggaatgaagtgagcgattctttattgataacaatggttacaatatataggggggagagaggcggtaatagaagacgcgatggtttgggaaccatcgcgtccgttactagaatcgccgtgaggcgagaagagatgtggggcacgaccaaccgtcgtgtcccagagttggttgctgctctatccatatagttggatgagatcacctaaatatttcataacaaggatgactagactagcttaatttgttggtctggtcattataccacatggtctactacagttatcgtttctttcgtacggcatggtgtccagcggcgcctgtgttcagtgggtatgtcaagagagtaggtcacttggtgctcttgagattgtcatcataaaataacagtagcgcggtggctgctaaagcttgttatttaattgactattccaaattaacttaattcgttaagcacgtgtactgtcagagaaagcgaagtgttgggagatgttttagcaaaacattgatccatattaactactgtagctgagctgaaataaaaacttaagcacgaatcaatgcatagaaagatcaatatagatttgtattgatcgtggaaccagaattaattttaggtatttccttgatggaaaggtctattttaggtccagctgattttgttgatgatcaggaaattaaaaccttttactcgttgtatcttggcagttaattaaagctagcgccaagtagacatatattttgtttagggctatatgcacatattgcgttaacatcttttccttgtaatttcgggcggtggtagtatttactggctgtatcgaaactaaaaaggctaaactagctagctaacgagatatacttcaggatatccatccacgatcgggcgcgacgggcacgggtagttcctacccatacccgtgcccgtaagattatttgtgcccgtgagtatacctattactacatgacgggtaacgatggttgcccatgcccattgcccgtgggcgccttatgcccgcgggcgtgcctgtttacccgccacaacaaaagcagtagtggaacaaaaaatctacaagcttctaagttcgaatcgaacttaaaatatcaaatattctccgcctcggtgtcgtatctcttctctggcggcgatacagtaaggggagagaaataataaggaaaataaaagggaaaccgtaaaaaacaaagaacgtggcttatgtattctagtggattttgctcctagcctacatgtaagttagatttcgcgggtaaacgggcaaagcgggcatgcgtagtgattacccatacccatgcccatttacccatcgggcatagcttttgacccaataagatacccatgggtataaaatggagaacaaacccaaccctaatagggattttacccacgggtaaatgggcaaacgggcacaattgccatccctactaacgagatatacttcagaatatccatccacgttgtcccggcggctaaactagctagctatatatataacgagcttgattaggtgtatctggctgatgtgtcactaccgaacgataaataagctataataaggtgttgtcgcagctttggtttatgtctaatcatgcattatttaaatgcatatccatgatttcaaatctttaagagattgtactgcgttcccaagtcagctagcatgattaatttgagctttgcattttgtccagtatatatatatattgtaggtggtttgaggaatatttggcatgtttctgcgtaaaatcgagggatcgagggaaacggtaacaaaaggagatcgtgctttatgtagaagctgattttgaatttctaaaaataagataatttgaagtaacataattttgaaattcaatcgatgggtactcgaaaataatgttacttcaaatttacactagtagaaaaactatttttccacatgccaccttttttcacaagcggcccttaaagaaaagcatatgcgtagatacttaaggccgcctcaggtcgatgaccacctacgaaaacctatttttaatttacgaatgaatctctaagaaatttgctcgtgaaacatgtctatttatacgggcaggtccctatgaaattagcctataaacactaattgagatatggttttacataagaaatcaatcttgtaactccattacctaaagcggtaaactttatataaaaattataactctctacgagatttattaccactttgttgcttaaagtgtttctatttgagatgctttaagggttaaaatattcatgttttgtgtaaaaaaaaaccactctaatatgaagtccacctataaaaataagaggccagaagatgaagcgagaaggagaagaaagggacaaaaagacaaaaggagaagaaaaagaaaagaaaagaggaaacacaggaaaaaagaaaatttcgaagtaggtcccacttgtcagttggacctaaccctcgttgaaaccaccaatgaactaccgtggtatttcacgatggcgcatgcagcaggttaagacctatttgaaatatttgaactagtgatcgatggtgccctggacgaattcgggatctgtaaaatgcattttcaaaggcttataatgcatcagctgttgatgtgcatatataccaagaaattatttattattaagatcattacatgctttattgttcacggacgtcgatcccagagtcacaaacatcgatgaaatgtactgcggcagcgacatagcatgcagttcaacacgactgtgtacgagtgagtggtcgtctacttggccgcggcgtcgagggtgaggaacgggcgctcgccgttgaagttgcccggggggtcgtagttgcaggtgatgaacacgccgcggttcgccgcgcacacgacgcgggcgcagccgatgcgcaccgacttgcgccacaccacctgggtgtagtggccgcacaccttgcccgggtcgcacgtgttggtgtcgtagtggtagttcttcttctcgcccacccacgacgccaccgcgtcggcggcgctccaggcgcgccccgccgagccccagaagatgttctcgccgtacggcccgccggagtgctgcagccggcagtcgccggcgcgcttggccgcgtagctctgcgcgaagctggcgaccttggggtcccagctcaccgggccgacgccgtccgcgcgccgcgcgctgttgtgcaggttgacgtagtcctgcggcgtgttctgcgccgaggtggtggtggtggccgccatggccagcgagatggccacggcgagcacggcggcgaggctgaccttggaaggtgccattttctgtctcgtgttgtttcgtgggatgaacggagttggaaatatggtgcttatttataatctgtttgtgtggaaaaggagtcggttaggtgtgatggcggcaaagaaaaaatgcgaaaatttgcgagtggcttgctacaattgggtgcgtaattgcctgcattttcttgtccatgcatgactccatgtgtataattttgaatatgcagattgcattatccaagttccacaaatttaattagtatatatatattggtcatgttgagtgaagttgtaagcaattgacttgaatttttacactatggctgtggatcgtcgtggcttgattggatggcatagttgaaatttgaatacccatccacttccacagggaaggaagcaactacctacccagagaataactaatagctccactatacggggatatagttataccctgcttgaaagattaatttacactagtctcttaattatgggcttccgttgataataacttccaagggtaattatgtcagtgttaacgataaggggtacccaatactcttagagttagacccgacggagcccactatataccaattcttaatacagaatcatgcctcatatacgaaaggtatttcagacaaagaagttgaagaagagttctactcggacattacaaggattactcggatcgtatccatacttgtcttcctagttcttggagcaccccgagagtttaaaaacaagactccataagagaagaggggacatgccaagtgagaagaaagatctagacagatatatacaagccaacatacaccaggataagtctagacaaacttaatttagagccacaaacaccaatatgaaggatccagagcttgtggtctaaacccaatcagatgtagtcgatggctagtgtggtcttcttccttgaatattaacttccaatctccctgagttcatatttgcggaagaaggctacactagccgttgatcatatctgagacctccatgctgctataccactcaaggtcaaagcacactgacgtgcgtaatcatttgattcgtgatgtgttaagttctcggaaaatgcggcttgagaaagtctgcaccgatgataatggggctgacttgttgaccaaggtgatgacaatggagaatctcaaggtttgttgccagctcattggtatgactaccggaaggcagccaggtgctccatgatgtcgggaggtggagtttgttaggctaaactccatccacatagagcctttgctctcagcccattctagtccaaaagtcttacaaatatgagctattgatacatgtcttcatcaatgatgaagattgcctcatatttttgtggtgcaaacgaaaacctagcctccattgagagagagagagcagcagccattggagagaggagaagcaactagcaaattaaacacaagagagggggaggagagtggagaagaagagttgcagattgttcagcttagtggttgttacccgatctttatcaaatcagtgattggaggctcaaccgtggttggattggcaccaaacttagtgaggtttttcctcacttagagcacttcaatcttatcagttcgtgtgaggattggttgagtagagcactggatttgagtcgggttgggcagagtaagaccaaaccgaagaaccgaaccgaaaagaccaagaccgaaaaaaccgagactgagaaattcggtctcgaccagtgaaagacttaaatctgttcggtcaattcagtcagagccctcggttaaccgaaatgaccgaattgggcccaataagcccactaatttgctagaaaccctagaggcagagaggtgccctccggctctcgcatccatccaaaccattcccatcctcctcagttcacaccgtcttctcatctccttcgtgcttgcctgactacatcggcgtgcgccgcctcccgcctccgcctccacctccatcgccttgcaccgcctctaactagcccacctccgcctccattgtcatgtgccgcttcaagctagcacgcctccgcctccatcgtcgtgcgctgtcatgcccggaaattcacaagtaatttccgaacttatttgtgcataaaatcctcgtccaggaatcagccgaggtacacaaactgacaattcaatatacaaatccatcacaacaataacgttgcatacttacaaaagaaaagaaaaacagcagcggaaaataaaatctagcgaagctccggctccactcccacaggcagctcaactgggctataagccaaacgtcttctccttctggatcctttctcttcaactgaggtttgattgattattgcaaggtgagtacatggaatactccgcaagccacacaacaaatatgcaagtgcacaaggataccaaaggatggcaataatataggctcatttgcaaaagcagtatttagcaaatatttaagagtagtaaaacagtagagtaattaatcatcaattttaatcaacattgcacagcaccccaatgctgcacaggcccaaccatcctgaacaaccatacccggttgtatagatctaactccaaaccaggagctaagcaatattattaccagttatagcatcaataattattgtgagaggtgtgagacaaatcacgaaaagcattgctcaacccgcccatgactgcaggcacggctattcgaatagttttactctggccagaggtgtaccactgtatccacaagacacagcctcaacatcatgtctaccatgcgtcgcgatactggaaagtacccaaatagaggctgtgacaataccctctgcacaacacaactcatcacagtgcaccgttcctgtatcataatcaccccctcaacaaccagaggcatagactccccagcgacccccacggacttctcgccacttctcagtctggcgccccgcaatgaaccatgctagacagaagataaagccgttgctcacgctggcttgtggttggcacggttaatgtctcacaacagtagctcgcgaaccggtccttaattgtcatgagcacgaccttcaaaaccatgtgctcacaacccaccattgtcaatttttaattatcaattaattatcgtaccacgattaactatcgtgagctaccattaaatataaccataaataataatgtagtatgattcatcccattaatgagctaatgtttctaagcatggctaaacaattatatatatagcatttacctgaaccaaaccaatatataaggttcaagctaatcaatttattacccaaggtatcaaggaatagggtattcaatgcaaattggccataacaaagaaataggttcacaccacccggtgaaattcgaaaataaatgcacagttgaaataaatagagaatttaaatataggatcaacatgttcaaaggattgtgtttaggatatgtgtgacttgccttacaataatcggtcttcaattaatcttctgaatcacttccaacgcactcccgaaccttcgcaacgatggaaacgacaagctaacatgcaaaacgaagaaaaagactaataaaaaccaaataaacagtacataaaaagtaaacaagcatgtagatcatgattttagataaatttagagacttgaacggcctcattccgacttcatatgaattagttatgaattctacaagattaaactgattttagccttgaacagaaaaggatttacgatttaatttagggaaggaaaacgggctttatgacattattgatgacgtcatcgccggcaaggcattgaaccgcaaggccacaggtgctaggaaactcggccggactatctgagagcaacaccgcggagaggacgacgagatgaactcaccaaggggtgggacgaccacggatggtgacgggagacgaccgacgacgagctccgaagggcggcgaggttctggttgacgacgacagtggtgctccggcgatcttcagcggagggaaaccagcggacgggcttcgccttggctctatgatgccgaggaaagcaacgacgacgtctagcatccacggagttgacggcgaggctcggacgaattgaaggaggagtagatcggcttcacgtcgacgaggggcttccagcgggttacggagaaaaggaaccagtggccgggcttcttctcctccttgcgaatccaacgacggcgacggcgactgaaggtgacgttggacggcgacggacggagaggatggagatcaaaacacagtggcaatccactggttcacggcaacgggcaacctccggtggaactcggcacaaaagaacgggcggccggggcggagatcttcactgcagtcccggtggtggcgacggcgaccagaggcggcggctactcggcggtgcggctcggatggaacgacggccgacgcttggagagagaaggcagctgcggggagagacggctagggcacgggagctcgagctaggggttggaaacgagaaaggaggtcttgcgggttctatttatatccggaagagggagagatcggctcagacccgagaggatttggtggcggattgattaaggttcaccggtttggagataaggtttatctgactgatttgatctcgaatcaaagggataaaatcttattccttagagatgaaacagaagagaaagataggaggaatatttcccctcaactaattcaagaaacggccgagagaagcgggcaaatcgggcagaggaattggcagcgtcacacacggctcggcggctgcactgggaggaggggtggggggg

SEQ ID NO: 36547 - DNA, 18869 bp, Oryza sativa
  unsure (1)..(18869): unsure at all n locations
atatgcgtatagaaagtttgtatacgtgtatataaactttatatatgtgtatacaaactttgtatatgcgtatagaaagtttgtatacgcgtatagaaaatttgtatgtgcgtatacaaacattctatatgtacgaatacaaacttggtatacatacgaatacaaacttggtatttatacatcttgaaaaaaaaggaaaaaaagccgaacagaagagaaaccggaaaaataacaaactgaacagaaaaaaaggaggaaaaaaaccaaatagaaacgaaaaaaccggtgaaaaaaaccaacctaacagaaacgaaaaaaagggaaaaaaacaaaaaaaaaacgaaaaactcgcttctccctccggcacgtcgccgccacctctccgcgcgcgacacgtgtccagtcgcgcggagagggagtcactcgactgatcgcccaatagcaatcttggctgcaggggctctgtccaagcttgaagacgacactgtagcaaaggggaggagtattagactttttgctgggctaaaaagaaattagagggttaagaaatagacttctctgggaaagaaggagacgggaagcagagacaggcaaagaggaaggacaggctgaggatgatagatagacttttccagtttaagcccgaaaaggaaaaggggatttttaattacttttccaattaaattaatcactgaaatgatctttgaattgttaaaaatacttccaatgctcaaataatttcaagaaaaatcatgaaactaattggacactcaaagtactcaacaagattataatcagaccatttaaagactaatttaatatttagataatttctgaaatgctctttgtattattaaaattaggagttgagctatgaaaaatccgagaaaattccagagagtataattaatcatggagaatttaatgaaaattaaatccagccatgctttatatttaggaaattttatttcccacaattaacttcacttgtaaattaatgaacatttaatataaattctaaaaataatttattaaataatttataaatcctgaaacgaaaatcaggatgtgacatgcgctgcctccaactggccggccacaccccagaggctatatattcaaaccatgctttaatgaaaattaaatccagccatgctttatattcaaacttttgttacggttagttcggtctatgaccgagaccgaaaaaaactaaccgaagacaattgcttggtcttgagctttgttggagaccgatcggtctgaagattctgaagaccgaattttcaaaaagacggagaaaccgaaccgaatttctcggttagaccgaatgcccacccctagatttgagttgtggattgtcagcttgattgactgcagtttcagcttgtgcaacatttggaaaaaaatgttagtttgagaggtcaatggtgtctgataaagctatttttgacagcttggaagggactcacagaaccatcatttttgccaagtttcatgcaatttgcttcttggtttgggagatttttgttgagaatcaaaggggacagaatatattatttctctacatgttagttgctatagttgatgttgatggcaccaagtatttaacttgatgatatagttgctgttgtgatatgccctaagatgttctagagaagactccatttgtaccaattattgcttatagtggaagcttggagtgaaccgttggtcccatggttttttatttctcacaccgaggaggtttttccacgtaaatcaccgtgtcttgtgtgcatgtgtttatttctgttccactattgatttgctagttgaaaccatcctcaaagctcatggcaagataagtggttgattgtgtgatatatgtttgccagttggtaaattggagtttgcacattgaagtgatttggttcagccccaacaacaagcagaaataatatgcaactaatgacggttatagttatattggagaagaacacatgagtggtggacatagcttaccaactagcaaacatgaccgatttgtttaaacacagaaaaatcattgtgtccgggtgcaacaattatacttttaaaaaaagtataaaaatagaatcatgcttagaacacgtgttaacattatcattagaagctacagatattcgaggtggttatgacttacgattgtcatcgaatactttgcaaagtcaagaaagtcaaaattgttctatccagattagtgaaagaggagtataacataaaaaaaggatgggatgagaatatcctcgaacatattataatgtattattgaattgtatttaaacccaaaatttggtagccttatttttaattcttgagttaatttcagatctggcaaaattgatccaactcaaagaattaagaagataagggataaacgtgcacaccaacgctcatatgtgagtgtgaagatgtgcagctgcgtgtccaatggttgattcatcttgtctcatgaatgtgcaagcgtcgcggtgtagcacagacatgggtgaccttgtatatgactgtgtcgtgtgagctcaagatcacctccacacttgtttttgtacctagggtgcttcgaagatacatggacaaaataaaagtgaaagcaaatgggactcacctggtgaagcccggtgagtcaatttattttattaatctcgttgatatgcgcaattacatgaaggaatgaaataaacaaaaagaaataaagaaaatgattaaagtaagtcctaggggtgggcattcggtcccccgccaacctcttaatgggaggtggagagagatggcacctgattggcagggagatatgagaagcctacaccttcaacttctcgcagggggacagggatggaatgagcaccttcccatgtccaacgggtgtgctcgcttccacgaagcaaagtggtcgcttcggcagagggcaaagtggtcgctttggtggagggctatctagcaagtaggacgatgtgtccatactcggacaggggttgttctcatttccattgggcgctgccacaggggtcacaacaccaccgttagcatgggatggcctgagtgcattgttaacttggaacaacgggacacaaattatcatccatggtatgtcaaaaagagggaagatgacctcatggaacatcttgcaggcatgcttggcatcggcggcatggcatgacattgcttccaccatggcaggacgtactctcgcaatcttgaactttgggaaaggttccatgtagtcaatactccatacatcaaaaagttccacttgaaggttctatgttaggggcatcacatcacgagcggtgatacctccatgcttctggtatcttgcacatctccgaatgaactcatttgtgtcttcatacattgtaggccaaaagaatccactctgtcagatctttgcctgggtgaggaatgcaccatagtggcctccttagggtgccgcatggcatttttcaatgatttgggtgccttcagctgttggtacacacctcctgagtagtccattggaacactcggtaaatgcccgactcatcccataagtgccttcggctctcatatatgagtcatcttttattcttcccccgtggcacatactccacaaccatgaagttgacgatgtttgcataccacatgttcgagtccatcaaactttaagcgcatgtcgtcccgtagaaaatcatttatcggtagttcttgcatgttagtgacatgcatacgcgacaaatgatttgctagagagttttctactccccttttatctttaatttcaagatcaaattcttggagtacaagaatccacctaattaactgaggttttgcatatttctgagtgagcaggtatttaagagcagcatgatcaatatagactattaccctggctccaactaagtaagatatgaaattattaacaattgcaataactacggccaggagttcatttttagttgtggcatatcttaataggtgaaaacagcaagctttttttgaggagaatgaaccctttctgctgcactaacaaggaccattggatagaaatggtagaaaaaatgtataccgttagatcatcaagctcatcaatgaccgtgaaaaccattggaccaatcaagacttcaggaggcttctagaacaaaggtgcccaatctttttagcactatatatatgtttgcttaactaatcttccgatgaaatagaataaatgaagctttagccataaatttgcattgaatttatctgcaggtttatatctataatgtacgagagcttacactgttatactcttttgcttggtatatattggagcacacatcagctaagcagcgtccactctataccaattttattttaaaacatagtcgctcgccctacgaacgcatacaggtacaccctacacctaagaaatatatctacctttaacatttaaaatttattagaaaataaagctacttctgcgtgtaatttattcgcttattttttatgtcaatcaattacaactttcatccatttaattttacaccgctagctacttcctcattcccaaaataagtatttctaggactcaaatttctacacagttatgagcatttctatgacattaatttcaacgcatggaaatccaagcaattttagccaatcaagtatttacaaagatccaactgaagcttttcaaaatttaacagtaagtgcctaaaagtgatcatttctctctaatgtaaatctttactaaataaactataaatgcctatatataaaaacgaatggagtatatttgagaacggagaaaataatgtactttgggaaacgtcccttcaatgtcatgagatcaatggcctacttataaaggtaggttatgcaaagcgcgactaagtggctagttcactagggcttacaataacaattttattcatctaattgttgtattgttgctaaaaattgcataaatacgatcattagagtcctcttttaatactgcaaaattctctgtatcacactgacgaaatttaaaaagaaaaatagcagcgatggaggaaaacatgtatctttccttgtttaccaatctcaagcaaaatttgcaagttcaaaatctccctccaattgtagttatgctttggagagagaaaacttcgggttggaatagaaggagctcaagcaaaagtacagtacataggtcgatcatcacaaacgggcctcttaacagcttgcctacgataatgcagttaagaggcccgcctgcaatataccgtacattatcggagccagccttcttaacggcccacctgcgataatgcatgtttgtaggcaggcattgaccttctctaagctgacattatcgtaggcgaatggtggtacagaccacctgaagactggagggggactcatctataaaaaagtagtagcgactgccacattggcattctgcatgggcatttgctcataaaggtgatatcaagccagtgcaaaacagttttgcacatatgtttacatatttaagcaagcgtatattattggagacaagagctcttaagatttaagatgaatgcttcttctttcgcatctatgtgagcattgtgtattgtatatgtcgtgataattaattttgattggggtgtgagcgacatctagggccatatatgtaaatgtatgttaggaaaccgaccggcccatgaaggcctagcccaggttacacactaatgggccatcactaaatatggaaggtgagagagggagatggctataaatagatgagtagagaggagaattgtacacttgagcaatgaaaggataaatgagaacatggccacaccctcatatcttgtgtctccaattcttatagaattatacaatctctcttggactacctcggtagcaggaggggttgcataatacgttatcagcacaacgttctaccggagaccgaggaagaagaaggataagaaactctagaatccgctttgcatgttgtagattgaattgcaaaatcggattccttgcatcctcctcgttccattttttgtggttttcgatggattccgtcatcgccgacttggagtcgccggcgaacgccgattgacggagttccaccactggcaaccggctgcaccatgcacggcgccggctgcgcaccgcaccaagcgcgcagcgccctgcatagccgctgcacaacgccggccaagccgagcccacgagcttgcccatgcacgacagccgaagcgcatggccgctgctcgatcatgccattcatgggagaaaagaaaggaaaaatgaaggagaaaaatggtaaccgcgccgacatcttgttgttgagggtcgttatcgatcagtttcgaccgtcaatattaccaaaatagaggagaactagtaatgcttgcaatgcataaatatgttagaataataatattccactagtagtaggtatactaatcttttgcagaggatgacactaaagtggaggagaatcgacatcaacatagaagataaatcaatcggacgatgtcgagaatcagacttatgaatgaatgggccaagaacgcagaattgacacgatgaattaggctaaaattcacaagtctacgaagtgaagcagcggaggaggccaccagccaaaatgtgggctggttgggccaggccgaaccgaacctatgccagcgccgatggatgcagggttttgagggaacggtggagattcactccctatggcggttggagggtattatcgacctttccaaccgctataaccgtcattacctgcctatttaaggagttcactctcttcacttcaacacacacctcaagcaatagctctctcatttctctcaagtttagtttagtagtatctagctggtggaataggaatagagtagaaatcaggagtccggaagccttcggaagagttcgggtatggctctagtagcttttctcttctcttttgtaagctttgtacttttattagaatactcttctaaatatatttatggtattgaaatactttccgagtatatgaatacctactttacattatgttcatgttatactgaatatacggctagcttatctgggagatgctttggtgcgggtataatgtttgcttatgcaattactctaagtcatgacgatgatattagagtagtatctggtagtttaggcgtggtgtctagattacaggatatcattatttggggttatatattgcagatgagaggtgggccgctgatggtgtcaactcagtacgggtattcctccacgccggtatataatcctaagttaattccctagggagggtattcctccgtatttagccccggttgtatggtcatgacgggctgtcgtaaggaactcgacagtcaggggtggcttctcgaagtaccaggagggcatcggatagagggtattagctagtataccagttaacttgaatgtatgtatgtatattagaagtgtaggaatagattctctttctattttctttccacttagcttagatattttagtatgagaatgagtagctccttgcttgtgtgtcactctaccctttaatttatcttaacccctgcttagactatgattattacaagtaatatataaattattagtacagttctctctactatgatcttccgacgggattaaataaatatgatacccttggaatactctcgggtgaaatgctacaatggtatatccgtgcgcttgcggataaactctgtaaccataatatgccaggagtatttctgcgccattgctaggaattatatttctagtaatatcgttaaaaaataccaacaataagcattgaagaaagaatcaatgaatgcattttaggagcttagatcggacacttgcataatattacatgaagaagtacttggtcccgaaccaacatagaaagaatagaataaatcaggaaagaattgaagaaacaaactcgttcattttgaatttgagtttgatttgaaatattaggcagaatccaaatcgtgctaacgcttgcagctaaaggcatgtgacagatggaagtttagtacatcagttcaaccgcacttagaaatgttcatagtgcatggctttggaatagtcgattaccgccaaataggacggaactcccaaacacaagtgtgtcataacagcagacgaatacctggctaattgaactaaaccgaactaagcatcgctgaactattcagtgcctcggcatggtttttagagatggttacccgcgacagcaatcgcaatttaaaaactgtcacaacccccccccccaccatttatgaaatttgagcaacatatgtcgcacatatgcaaatgagttacgtgagaagcaaactcactaagcacatgagccccaatctcttctacgtatatgaattgcatagaagcaacgaactaagtcatgtgtaagtcttgcaaatttatccactaaattattatttacatcttctcttgtattggtgtgtccgagaaatcggaataatgagacttagagaaatgcaaaattcagggggagaattttactaactcattaccaaatcttgatatagaaaatcaagtacccaaaaatcaatctagaaaaattgaacgaagaattgggtttttccttggataagttttcccagcagtttcttatcaaggtttttaatgaggcaattcgtgcgacattgcaagcgtatgctatgtactaaatttttcccactgggtttttatggagttttgattaagcataggcatcacgcagtgaaggcccaaggggaagtgttaggaaaccagccagcccatgaatgcccaacctaggttacacactaatggaccatcactaaatatggaaggtgagagagggagatggctataaatctatactaatataaaaaagaggagttagcctcctccaatcctacctgccaaatcacccggatcaatccctagcgtccatctgcatatctacttatccgtaccgtccatccgagtatcacctattcatccgatcccatccatcacaatgccgtcacctgctctagcgctatcctcgccccgatgcccgccgccgcgctatccccgcgtgcgccctcgcgcgatgacaccccgcgagtccctacggcagccgctgcgctttcctacaccccctcgcatgcccccgccgcgacggagtgtggatcctcccccgtgcagtgaaggtgccctactaggtcgctgtcgtccagtctgccgaccatatcccaacccatcgatgtaagtattgcaagctccccttcattttggtgaatttaatttgtagtgtatggtgcaaatccgagggttagggattggatcatagtgcaaatctgacggttaggaattggattcgtatggatgaatccgagtactgtaaccccaaccatttgtttgtagatttgcagaaaaagttaaaatcaaactggtaaatattgtagatttgacgatgttcttgcatttaatctcctcccctggttgtgttatggtacagatctgaagctattgtaggttcccttgtgtcctcaaggaaaatacgtgtactccgtaagagcggaaaattcaggcttgcttagccacccaagacgctgccccctgcctactccatctccaaggaagcgcctgggccactggtctggttggctagcgaggtgtatttcaagcatctacttgtgacgttaacaactttcaaacctgtgctgattgtggcagtcagggaattcctgcatcatacagcgaatgtgcctttatggctgctacactagctagctacacttccatcttatagttttaaaattcgttaaattaaattgtgccaaagtagtgtgatattacttggattgatgccatttatcatggatagaaatcaaatatatcatgttccagttcatgaaacttttgcaggatggagagcacagaggagtgacatgattcccatcctcattctttggagagtttgataggtatgtcacactccatgtgctctatggctttgtatgtcacagatctgatcaatctgctctttgatatcctaggagcatatattaaattaatctagactgcatatatattagattgcataattcctgaaacataatttcagctgctcatatgattgtttggctttcccctaggataaaactttgtactttaattagctggaatctggccatacccttgaagaggacaagggagctacacacaaaaaaaatgtattggcaagagatgctttgcactggacaaagcattgatcttctgttttcttaaggtaaatactgtatgagagtcctacggtgaatatatttatataatatataactcacagaattacatatgtagtatgaagatttagctatttgtgcctgaatgtaattatctaaccattggagtaaatcgattaatcaatcctttttgttgctaacaaattgattttgggtgctggtatgatttgattttagcaacattattgtttgctttacggataacattagcatctatatcaggaaattgcctacaaaatgcttatacaaatgtgttaatcattctgcatctcttgacatgaatgctaatttttatttttacgcaatccaaacattttttttaatcgagggaccttgattaattgcttcagcttgttgtgaaggaaacactatctggatattgaatttgattggagatcaaatgaaggcagtgatcatgatccaacactttgactgtcaaggacaatgtgttgccatgtgtgcaagtaacaattacttcatattatattagaagtagttcctgctactgtttaactaattagtgttaacctaatcatatttcttttgtatgttattttgcatgcttctatagatcaggagttccgtcatgattcatgaggtgcagggaataactcagaggtttttctatacataaatcttagtctttactctttgcccctattgttgcttgtagaattttgcaaggttctgttttagcaccaatgttttttaattaatactgtcaaacaactcccaaatatgtcatgtagaaaatcttctctcaatcaagttttatttgtagaagaacatgcaatagttttgacaaaaatagaagaccatgtgaatcctgaaatttcagagaaatcttcaaagattcaaatttggaaaatttgcaaacaaatataatggtcaatccctggtttcggacagtggagctggagagtacatttatcaccaaagttgtataagtgtttgtttcaatatctggattttttttcctaattgtcagcaccatatatctaaaccttttatcgtagaaggctcaaccacttattctattttatgcaccacaggatatttttctcttgtttacccctgcagctaatttttgtgtctattctaatcatgtgaaagaattagattttttttcttaaactagagaggttagcctctcccatttctattaaataagtgaatattttacaggaaaacaagggcatccaggttgacaacaagaaaaataaaagactggttttatttcttcacaaacaggtccaggaattctatcttactataaagttatcccccactaactccttaagtttaacatgcaaacgtgccacatcatcctccactaacaatcatcacatttaaacatcatgcaaacatgctatatctttatagtttttataatttaagagcttttcaaatacaaacatattaaattatcatccaacataattcacataatgtttcaatgtatatctttattatgttttatgatatcctatatatttatatagttcatcctcacttagttagtgcttaaatgattaatctatggtccaaattatctttctcctttttttctctaattaagtcatatcacatcaattgtttttaagcctttagatgattaatctacggtccaaactatctctctacttttcttcttccataaagtcacataccatcttactttttacgtttgaatcatcattctacatactatttaaatttaaattatcataaaccacattaatttacttaatctgatattatctagctatcttacacgttattttttttatcgttatcatactaaattcccgcagcaatgcgcggggtttcacctagttagatagaaagaaaagacacattaagatagctagaaaagagttttaaatttgcatatcggtccatctaacagtttcttgtattattgaatgtcaactatccctgtcaatctttctcatcgtttcttgttatcaaatgctaatccattaatttaatttcagttctttaactcatttccaatagcccacctgctgataactaggattactgggtgcaaataatactatctggaccacctttaatgatttcatttactttttagttcaaatttggcaatatatttcttccctgatgggaatcatgtgccttttttaaagcttacaccaaggttcttaaactggactgttcatttcacttctgcagtttattggttttattttctgccatcatattttacatttacatgtaggaatgaagtaatggctaccacttttttacttgtttctatatgtatgcagccatggctttctttactaacctagctgtggtatagatccaggtagctttatactcacatattgctgtcttccataaacctttccatttgccagccaatgtaatgcgatcctttttctctatcatgttttctatctgaagttttattgtgctccgtatttttccaatattgttattccttcaacaaaatcaactgatccacacattacttccaacacatacttcagttttttttccagaaacaggatgtggctttttttacagtatttctgttgaagtcagatttcataaatcaatttaaaccagcattacgatgggtcaccctcggatggctgggaagttagctagaagccgagattgagcagtattttttggcagtaactgctaggatgatggacatgtgcagtgtgaaatcccttccagtgcccaactgctaggatgatggacatgctcatgggataccccgtaagtccataccagaaatgcatagttgtcatttcaatttttaagatgtttccagcatgttcacacatgacatctccttttttgcacttcagttaagacaacgacgtcgagcactattccgataacaattgactggagtactattatgagacaatgtctaagagtaactgagatataaacctctatggtttgcataccatataaacttctactggtcacacgatagaagatatgcacttgctgttgattatgtaaatgttatatactgaagtactattttgagcacttgctgttgatcaggtaaatgttatactgaagtactattttgagatattttttatagagtaaagtgcacgggcgatccttaaacttgtaggggtgtgtcatctaggcccctaaactctcaaatgcatatccaagtcccataaattgttatagtatgtcatctaggtcctaaatctccaccacccctttaggatcttatgtggcgttgatgtggcatgccacgcaaacatgacgtggcattattgtgactaacaaatgggacccatttaatttttttttccttttcttctccttctctttttttccttctcctttatctcggacccgagcagaagaaaggacataaagaagatgagaagaaaacggaaaagaaaatgaaaaagaagaagaagaagaagaagaagaagaagaagaagaaaagaaagaaaataaagaanaggacacatcacgtccatgtagcaagacacatcatcgccacataggatcctagagaggctatgtcgatttgggacctaaatgatacactttgacaagttatgggacctggatctacattttgagagtttagggacctagatgacacaaccctacaagttgcactttactctttttatactttcagtactttgtatgtgcggtgtgatatgcatattgttggaaaatcaatgcattaaactttgaggacgttcatgtattgtgggaaacgtgcattgcacgtgcacgattacttgtagatgagtaaatagatgagcagagaggagtgaatgacaacatggctacaccatcatatcttgtgtctccgattcttatagaattatatgcaatccctcttgaactaccttggtagcaggaggtattgcataataatgtataccggccgcctgtgaaaatccttagtctgaaaaattgaatgtacacgggccctgtacatatatgggtttcattactttccgcgttcgtggatctggaaaatccaaaaatttacaaactgtggagagttcatctccatagctaggtagcgtagcgtgctattccccttctgtcatgtttacgttagtctctatcgcattgtccaagttaactatagcaacggtgttttgcacgtacaggtcaatactccatccgtttcacgatataagtcgttctaacattttctatattcatattgatgttaatgaatctagacatacatataaatttatctaaattcattaacatcaacataaatataaaaaatgacttacctcatctgtttcacaatgtaagactttctatcattgttcacatacatatagatgttaatgaatataaacacatatatatgtctagattcattaacatctaaatgaatatggacaatgctacaaagcactggtggagaaaccatctttcgtcggtcggccgaattccacaatagtcccggatgcaataaaaaccgggactaaagatgatctttagtcccggttcaaaagggtaacgggtaacaccaaccgggactaaagattcaaatgttgtcagggcatgtcaggccccccccccccgggatctttagtcagatctcggggatctttagccaaccgggactaaagtcccacccctatatatatatcttcttcctcctccagctgcccgagcaagcttcaaattttcttcaaaaaagaggggaggtcatgccaaaatttctagtgaatttattttggtgattacatacaaatcggaggtgcctaaaaggtttgcaacttcatcctccaatgttttttttgtcatattacatttgcagctatgttttgcacacttttttgtctccaaaatttagttgtaagttgatgagagagaaaaattgtgtggggaagaaagaatatatagaaatttagttgatttgttaaagaaggttttataaaatagttgagaaggaaaactctagtgaaagttaatcttaaataatagaaaacaaactaaaatgaaaattaaaagaagtaaaacacattaaaattagtttaaaactttagaaatagtaaataagaattatttggtgtaatattttatgatttttgtatgaataaagatatggcattattgtatgactgtcattattgtaagaataattatttgtgtacggtttttttcgactcatgtagatggatcggcaatggatgtacgctgaccggcggtccaaagagtttattgacggcatgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtacgttggatttgaaggaaatcaaacgggcgaggaggaaatagctgctgatggtaacgacgttgcggatgatcttggtcagatgttgcaggacgccaaggaggactacgaaagtgaaaaggaggcccataaattggacaagatgttggaggaccacagaacttcgttgtacccaggttgcgagcaggggcacaaaaagttggataccactctggagttcttgcaatggaaggcaaaaaatggggttagtgacaaggcatttggcaatttattgaaactcgtcaagaacattcttccggagggaaacaaattgcccgagacaacgtacgaggctaagaagatagtctgcccgctaggactggaagttcagaagattcacgcatgtccgaatgattgtatcctatatcgcggtgaggagtatgagaacctagaagcatgccctgtttgtaaagcactacgatacaagattagacgagacgatccaggagaagttgacgggcagctaacaaagaagagaattcctgctaaggtgatgtggtatttccctataataccacgggtaaggcgtttgttcaggaacaaggggaatgctagaatgatgcgatggcacgctgaagagcgtcaacaggacgggatgctgagacaccccgccgatagttcgcagtggcgaaacatcgacagaaaatttaaagaatttggaaaggacgcacgaaacatacggtttggtttgagtacggatggcatgaatccttttggagagatgagcagcggccatagcacttggcccgttacgatatgtatctacaacctcccccctggctatgcaagaagaggaagtacataatgatgccgattattatttaaggccccaagcaacctgataacgacatcgatgtgtacctaagaccactggtcgaagatcttaaactgttgtggaagaatgaaggtgtccccgtgtgggacgaggacaaacaggaggagtttaacctacgagcgctaccgttcgtaaccatcaacgattggcctgcacttagcaacctatccggacagtccaacaaggggtacaaggcttgcactcactgtatggatgaaacagaaagtacgtatcttaagcactataggaaggttgtatacatgggtcatcgtcgattccttgcagcaaaccactcggtacggaagaaaggcaagcactttgaacataaggccgaccaccgtacgaagcctaaacatcgcagcgggaaaacagtgtttgctatggttaaagatcttaaagtagtgttcggaaaggggcctgaaagctagcctatagagagcgaagatggtcacgcggcgatgtggaaaaagaactctatattttgggagttaccatattgggaattcttggacgtacgccacgcaatcgacgtgatgcacttcactaagaacctttgcgtaaaccttcttggctttctaggtgtatacggaaagttgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccatgaatatcaagcgaataataagcacgaaggagaagaagttcacaaacctaaagtctcatgactgtcacgtgttgatgacacaactgctactagttgtaataaggggtatccttccagacaatgtccgggcaacaataacaaagctatgtgcattcatgaacgcaatttcgcagaaggtcatcgatccggaaagattagaagcccttcagaatgaagtagtgcaatgtctcgtcagttttgagttgatatttccaccttcatttttcaatataatgacgcatctgctttgtcaccttgtgaaagagatcagtattctcgggcctgtgtacctacacaacatgtttcctttcgagaggtacatgggcgttctgaagaagtatgttcgtaaccgtgctcgtccagaggcaagcatcgccaagtgttatggaacagaggaggtcatcgaattttgcgtagaatttatcgaagaccttcgcccaatcgggatacctgaatcacgccatgaagggagactacggggaaagggaactctcggaaggaaagcaataatgatggtagacaacaatttattccgtaaagcccatttcactgttctgcaacactcttcattggtagctccttacatcgaggagcacttggctctagttcgcgctaggaacatcggtaagtccgatgcatggattacacggcatcacattgatactttccccgcgtggctacgacaacatctcatgggtaacgagtcgatcaaccaacaacttgccttcctggcaaggggaccgtctgggtcgatcgcgacattccagggatatgagatcaatgagtacacattctacacgagagcccaagacatgaagagcacgaaccaaaacagcgttgttcatgtcgatgccatgggacacgatggaacaactgccacgtattacggtgccatcgaggacatatgggaacttgactatggtcctctcaaggttcctctgttccggtgccaataggttaggttgactagtggaggcgtaatgattgatgacagtgggatgacaacagttgaccttaacaaggttggatactcggacgaaccttttgtccttgccaatgatgtaacgcaagtctttttcatgaaggacatgtctagcaaaggaaagaagggcagagggcctgacgagcctaagcgtcacgtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgtagcgatcacaaggagggaacaatagtgaggagaaagtacgtgcggtcaaccgtcaccgccgatgtattgctgtaattattattgtttacacccaaatttgacacctatggacgaaatagaggaaaattgctaaagtttggaaagtgtcgggttttttcgcagggccg

SEQ ID NO: 36548 - DNA, 6323 bp, Oryza sativa
tcattgtaaaaccctagaatataatctacttgaatcgttcttttactatgttttctattttaccctagtttagtccatctttgtcggtttgcgccgtaaaccgtccgccgccgcagcgagagtgcgacacctctttgtaggtttgtcctgaaaaccttccgttttgcccacaagacgggtagttatcctcatattgatctaaatcggcctagaggctgattttgatctctaaattggctccgctagccggtttagctgtttttctacaaaacccatcttgatttggccctttggcgagatcgaggtggttgacgactctaggatcaccgcaaggcgtttaggtgctgcgatcgtgcttgtcgacttgtcacaaaaagttgccaacacgatttttggtgactccactggagaacgatctaatcagccatatcacggccgaatttcgtttaatctagtaattgtttcgtcaaaattaagaatttcggctaaacagccgaaatcaatctacactgtcatcgtttcatcgagttgaggcaactttcggccgtctggccgaaattgattgcaatagtactgatctgcagcagcccgccgccttcgacgccatctgcttgtcggctacagctgcgatctgcatcgacgtgtctcatctgccgcttagtgcttagggtcatcaagtcgtagcaacgtagtatacaggggcatgcgcgtgtacctgaccgaggagaagcagtagcagggccggcagagttttgcggtgcacggccagaaattttgagtatcaaatctgttcggtttgctgtgtaaaaaaagagaaaaaaggatcaggctatcacagccgatctactactgctcacgtaccggaaaaaaaaaatagcagccgatctaatttaagatcggttgatctttggtatattttgctacagtaccgaagttactgttacgtccagaaaaatcaacaaaggctagttttaattaaattggctaaacacagtaacatatcaagaccgtatattaatctattcggtcaaatatttcggctatgagctatatggtcggatttaatcaaggaatttattcatcaactatgacgagcgggaacgggttcaacaatattactgcacaatacattagaaccgatcaaggcgtcgtgagaggaaatgttctgctaccacaagttgtaatttcaccaaaggtaaccttcgattcgcccaacccgtcctttgctattcaaaacgttaataatcattgtgtagatgcatatgccacttctagttttgctcctatacaatatgcttataatgctaggggggttaatgggtgattatacagccgattacacaggaatcggctatatgcaaaaccgagctgacggtatgaccggtcgtgacaccggtctaaccgcatccatggccggtcagaccgtgcccaccatggccggacagaccgtgtactacgccggtcagactgtgcctaccatagccggtcagaccgtgccctatcatggccagatcgcgcctcctgtggccggtctgaccgcaccactgaccaccggtcagaccgggccatgggccggtcagaccggttcctgggagtttctccaggttttcataccacgactagcaatattgattttaattattattcatcacctgttaatactgttagtcatgctacttcacatatccctgatgcctataatgatgttgctagagggtatcctcccgatactagacaaggccaatataatcatattgcgctgcaacaaccaccccttaggccaccgaatacaccaccagatccacataggcctaaaaatatggaggagttgcttagtgacattatcagggctacatttggggttgaagcgaaggatcgtgctagggagaaccaaaagccatatcctgatttttatgacgctgtcccatatcctcctaattataaaattcctgaatttaccaagtttagtggtgaggataataggaccacatatgagcatgtagatcaattcttagcgcaatgtggtagggctagtagtatggatacatgtaaattgcgcttgttttctttatctttgtccggtactgctttgatatggtttacttctttaccggcatattctattggtacttgggctcaattagaacaaaaatttcatgattattttcacactaatgaaactgagcttaagttgtctgatttaacatcggttaggcataaatacaatgaatctgttgctgattatattgaaaggtttagagatattaaaagccgatgttttagttttagaataactgacaaagatttggccaacattgcatatgatggattgcttgattctattaaagagaaattaaatggccaaatatttcttgatgttgatcatgtgttgcatgaaacactggctcaggaaagccgagtggataacaatagtttaaatgctagttagatgaaagtgcaatatcatgtatagccgtaccaagcgatggttcggattgtgttaataatttgtgcaatgatgccagaacaattatagccgaaccaaatgttggttcggattatcttgctagcttagataatgatgcaacaaccattatggccgaaccaagcgacggttcggattgtgttattaatttagataatgatggaatagccgaaccaagtggtggttcggattgtgttgatagcttagagaatagcatcattgaagatatagccgaactagatgatggttcggattgcatcacaagtgaaagtgaaatagcattatcacctaagaccgaatcacaaatcggtcatgtggatgttggaaaagataataacaatgtcttgcgggatagtactgaaataggatccaaagtagctatgcatacatatcaaaggccgtatcctgaacacgtagattcggtcccatacccgcaaggatttgaggtgcccaacttcacaaaattcacaggtgaggatgctagaataacaatggagcatatcggccaatttattgatcaatgtggtaaggccggtagtaatgatttgcttaagttaaaattgtttcccctttctttgtcaaactttgcatctacatggtatagtttacttgctcctaattcaatttctacatggttacaaatggagcatgagtttcatggttatttcaaagatacaagcttgatggaacaaagaccgattgatacttcatcggtcacttgttaaactatttcggttacatctatgcctaagaccggaattgttagcgatcctctccctgttagtcctattgatgtagacaaaaagaaagggaaaagtgttattattggggatcctcagcccaaaaataggataaaaaatgcgaaggccgaagatcataaagttgcaaaggatgagtcatctagtatccaaaggaccaaaaagccgaagctcacttttgagatgcttatggctaaatacaagaaaggattagccggtcaacgatttaataaccaaactagtgattcgaaaagaccaagatcatctcgtaggaagagatttggtcaaacatcaaagcaatcggagccatcaaccataccaactccatgcaaacctccgattgtgatgccatggtatccatatccaatgtcactatatggttatccttttatgtattatatgccatggatgcttcaaccacctatgccgtgtcatcaggaatagaagcaatcacctaggacagtaccaagtcattctaacccaagacaagaccattttccacaaaagaatcggtccggtggatcaaaggtgaaaaaggtgaagaaggtgtgggtgaggaaagaagtcaaagctccggaggtcgttgctatcaatgaggaatctcaagatgttcatgtacctactggagatgcggcgaaaactatacaagcggagaagactaaagccgacgccattgctgtcgacatcggctgtctgaccgagccagcttgccggtctaaccgccagacaacggccggtctgaccgacggcttgcagccggtctgaccgggcctagaggccggtctgaccggggggcattggagaagagtgggaaaattgagagcaaaataggagcttccacttcgactaaaaatatgaagaatcgttacttagctcctagaaaacaaccacagctaaagtggataccttctggcttatctcgctctcaaaagaggaggctacaacgtcttcgggccataggtcaaaaagaaaaggaggccaaagatgtggagaacaaaatatgtaataatttagagcctcgaacgacacctaggcaagtgtggagatccaaagaggtaaaagttaagagaccggtgatttcccatagtagagaaatccaatttgatgagagaagaatcatcggtcattagagataagtctccttcacatgatgctatgagtgttagtgcggtatccatcttgcattcgaaatcgcgcaatctagaaagccaattttgcttggggggcaagacattaatatgctcataagggaaccaagagaagatgaacggcgatggatacaacatcacatctttgagccgccgtttgttggatgctaaggcaaggtatgagtttattgtgtttaacattatattatatgcctatgccatgttagaacattgcttgctatctagtacatgtgtgtttttgcttatcaaattgatattatacatacatgttgcaaatgccagttctaggtagtagaattggtaggttggcataaaatttgtttgaagtatgatttggctcatgactctttgacatttatttaaagccaaatcatatgtgtttttatggattaccatataagatatagatttcatatttattgcaccatgaaagttttgcttactagtaattcggctaatgtcaatggtcaatgtgatgatttgctctagagtggttttctttaggaacattggcattgttaatattttgcatacatgctcaaccgattacttacatttttagtttattgaaatctatgcatgtgacacatatgattttggtgattcattattgatcatacttcaattggctaagtgttgtgatgccatgatgattattgtttcaaaagccaattgaattagtattcatctagacatattagttggatattatgatttttcatatgtctagagagaaggagttttcgttcaataatttgatacaccaagcatctggctattatatgaagaaaaatttatatactaaaagccgatgcttgatttcaaaagtttggacgaaattggcaaagtcatagaccaggggcggtctgaccggtggtagccagcggtctgaccggctctgtatggccggtctgaccgggcagacatggtggtctgaccggcattgcgtggccggtctgaccgatcccagacaggaggctggggggcacgttacaattgattaaaaggccgaattaattgtgaattcggacatttgtacccatgagttagaaatagcttggagaatttctttgattagatatttgaaagatcctacacttaaggttgatcggagattcggcggcaagcgttcaaatattatatcgccgaaaaatagatagagtattacttagataatgatcaatctaaagttgctaggagagtagtacatgaaaggatttatgaaattcatcaatcggcccgtaagataaattggttgcttaggagggtggggtttcattggccgaaaataattgatgattgtttcaaatgctatagagggagtgaagcttgttgacggatcggcaatgttcaattagcgcctaccgctgtgttgaatcctatcattaaactatggccgttccgaggttgggctttggatttcattggtcaaatttatccttcgtcatcaaaagagcattggttcgtgctagttgcaatggattacttcactaagtgggccgaagccgtgccgctcgagaatattacttgtacagaggtaattgactttatttttgaagcatatttttcatagattcggtatttgtcacaccctgaaaattcaaaatatataaattgttgtttaaatggaatttctagaatttattttaaaagtcttgaaaagaaaatctaattctaattaataaattccaatataaaattgggccagaaaaatttcattaaatactttgcttaattctataattcctagatttttctgggatttatttgagctaaggaagtatttttaataaatggaattgcatttaagaaataatttaaattgaaaaaagttttaaaaaagtcttcttttggctttgggcccaaagtcggcccaaaaccggcttttttctcttctcggcccagccggcc

SEQ ID NO: 36549 - DNA, 18994 bp, Oryza sativa
gtgggtcccacccgtcagcgagagcggcgggcgggcccgcctgtcagcggcgcgcgcgcgcggggaggccgatgggccgcgggagaggagagagagagagggagggagaagtgggccgagccggcccaagagggaaaagggggggggaaaagaacttcttttaggattttctttttataaaaccttttcaactttgtttatttcttttcacttattatttgtgctctgaaaattccactaaaatttttttaagcattttaggcttttcggaaatatacaaaaatcctccaagcctcatttgacttttatctttgcacattttaattgttggaggctttcacatgatttttaattattcttttgcacaatttcgaggatgaattttagagtcgatttgggacgcgacattgaagctagtgattggctacatgccatagagaagaagttggatttacttccgtgtactgatcaggagaaggtctcatttgcatcacatcagttgcatggccctgcctctgaatggtgggatcacttccgtcttaacaggactactgctgaacctatcacttggcttgaattcaccgctgctttccggaagacgcatataccatcgggggtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccacttatggttggagattaccctgatttccagaaattagtggataaggctattcgtcaggaagacaagtacaatcgcatggagcagaagaaacgtcggattgctcaattcaagacacaacagggaaataatcagaagtcgcgtcttactttaggaccccagtccatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcagcaagcccgtggtgtgtttcaactgtggagatccaggacattatgctgacaagtgtccgaagccccgacgcgtgaaggttgtccctgcccagagtaactctgctgtaccagcatcaaaggcccgtgtcaatcatgttgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctcggtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaaccgttcatgcattgtcttctgagtctttaaggtcaagactgaatcagataactttggaagagattcctatagtccgggagtatcctgatgtgttcccagatgatttaccgggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaatttgatgaataaggtgtttatggaatacctagacaagttcgtggtggtctttattgatgatattcttatctactctcaaaccaaagaagagcatgaagaacatcttcgccttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaattggaagcaaccaaagacagtttcagagattcgcagtttcctaggccttgcaggatattatcggaggtttatagagaatttttccaagattgctaagcccatgacacgactgcttcagaaagatgtgaagtacaaatggtcggaagaatgtgagcggagttttcaagagttgaaaagtcgcttaatatcagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatattgagttagctgcagtcgttcatgcattaaagatttggcgtcattatcttttcggtactcgtacagaagtgtacaccgatcacaagagtttaaagtatatctttactcagccggatctgaatatgagacaacggagatggttggaattaattaaggattatgacatgggaattcattatcatccgggaaaggctaatgttgtagcagacgctcttagcagaaaaggttattgcaatgctacagaaggacgacagttgccattggaattatgcaaggaatttgaaagattaaatttgggaattgtcggtagaggtttcgttgcagctttagaagcaaagcccactctaattgatcaagttagagaagcccaaattaatgatcctgatattcaagagatcaagaagaatatgagaagaggaaaagctattggtttcttggaagatgagcacggaactgtatggttgggtgaaagaatctgtgtccccgacaacaaagatctaaaggatgcaattctgaaagaagctcatgatactttatactccattcaccctggtagtaccaagatgtaccaggatctcaaggaaagattttggtgggcaagtatgaagcgtgaaatcgcagaatacgtagcagtatgtgatgtttgtcagagagtcaaggcagaacatcagaaacccgccggtttgttgcaacctttgaagattcctgaatggaaatgggaagaaataggtatggattttatcactggtttacccagaacgtcatcaggccatgactctatttgggtgatagtcgatagacttaccaaagtggctcatttcattccggtaaagacaacctattctggaagtcgcttggcggaattgtatatggcaaggattgtgtgtttgcatggcgtccctaagaagatagtgtctgatcgaggcagtcagtttacttcaaatttttgggagaaacttcaggaagagatgggttctaagctgaactttagtactgcttatcatccgcagacagacgggcaaaccgaaagggtgaatcaaattttggaagacatgttgagagcttgtgctctagatttcggtggaagttgggataagaatctaccctatgcagaattttcgtacaacaacagttatcaagctagtctacagatggctccttacgaagcactgtatggtcggaagtgccgcactccgcttttgtgggatcaaacgggagaacgtcaggttttcgggacggatatcctaagggaagcagaagaaaaggtaaagatcattcaagaaagattgcgagtggctcaatctcgttataagagttatgccgacaatcgccgcagagatttgagttttgaagaaggagattatgtgtatcttcgtgtcacgcctcttcgaggagttcatcgttttcagaccaaaggaaaattggcaccgcgttttgtgggaccttataagattgtcagcagaagaggagaggttgcttatcagttggagttacctcaatccttggcaggagtccataatgtgttccatgtgtcgcaattgaaaaagtgtttaagggtacctaccgaagaagctaatattgaccagatagaagtccaagaggatttgacttatgttgagaaaccaatccgtatactggaaacaaatgagagaagaaccaggaatcgagttatccgtttctgcaaagttcaatggagtaatcactcggaagaagaatcaacgtgggaacgagaagatgaattaaagtcagctcatccgcttctgttcgccagttcttccgaatctcgaggacgagattctgtttaaggggggtaggtttgtcacaccctgaaaattcaaaatatataaattgttgtttaaatggaatttctagaatttattttaaaagtcttgaaaagaaaatctaattctaattaataaattccaatataaaattgggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagccggcccagtccgcagccgcccgcgcgcgcgcgcgccctcgcagccgctgacaggtgggtcccacctgtcaggcccgtcgtcttcctcgggccgaaaccctagcgcgccgccgccgagccgccgccgctgtttccttccaaatccggccgcctctttccttctccggccgaatcaatagaggggaaatgatctccgggatctcctctaccttttctcctttgggatcttcggctaaatcgctttggaaagcgttggaatcgagttcgattcggatcgggttccctctctccaagccgagctttccttcgccgttgccatcgccgtgggccttcgccgtcgcctccgagcccctttaaaaggatccccgtgctcttctctttccgccgccaccctcgccttcgcctctcgtcgtcggaagagctctagcgccgtgtgccctagcttcgccgtcgccgccgccgcttcagccgtgctccgccgtcgctccagctgtcgccgccgctcgggaagaccgccgtcgtgctcgccaagtcgccgccgtcctcgtccgccccttcgcagccgtcggaacccgccggagcatcgtcgccgtcgtcaacccgaaggtagccgccgcttccttctcgtcgccgtcgccgtccgttccttttccgccgccgttttggtcaccggtgtgttcgccgcgttgtcctctacgtgctggtgccctccgttggtgccgtggtgccgccgttcgccggcgagtgtccgccgcccgagccgtcttcttcgtcgagccgccgccgtcgtcggtgacgtcatcgctgacgtcatcgggatcctatcccgtgagccggtcgtagaccgatcgatcttggccgtccgatttggatcggatcaatctcggccgtccgttcgtgtgaaccgccgcccgtgcgccggtccacccaaaccctagttgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttatgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcattcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcatagtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgtttaattattactcaaccgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaagttggtatcagagcccctttgaccctaggttatgccaaatggttatccatagaagccctctaaaaatattggaaaagtagaactgttctcctccctttctcttttaattaaccaaactaatggcacatgcacttcataatctcttttaaatggttctcattcaaaatttattccagtgttattagtactgtacatctattactgtactaatggctcatttatcagcaaaaattttacaatattgttttatttaatcttgctgcaataaaataaatttaccatattgattttataattttctttcatttcttttgaaaccagttattcaaaattacaaaaattgcgacctcgtttccaactgttttaatttatttcgcaaagcttggtttactttatttacttacctttttattctgattttctaactttattcaaattaatccaaaaacttgtgctattaattggatagatgtcttaactccctcctttcacttgtctttagatgccgtgttacaagcctgagtacctgtttggagttgagggttttgtccaggagttgcgtacgatgtcctttgtcattggatttgggaatgctcctttttatgcccagattcgtcatgatcgtcatgaagaaaagtgccgagtcaaagtcaccttgaacagcaatagtgaagatatcccctcagtaatgtttgaagctggaggaagaaactacatccatgcatgtcaggaggtggcaaggatcgccataggagagctccgtgatcgctacagtgatcagttggtcgacactgagtatcgctatcatcctcgccaaccccagggaagtgaccgtggcagttaccttgagactgaaggaattgagaatgatgttaccacaagacatttggttgagatgttgtgggctatggatgaaagtcgtgcggagactgtgttagcagctcaagatcgtgaagatcggaatcgtggtaagatttgcaagttagaagacaaggtggatcgtttggagaaggaattagctgcattgaagggagaagcaccgccgcagaaggctaggattcgtcttaccgcaaggaagagagctttgtttgtccctcgttatcaattggcgccaaaggtccgcgtggtggagaaagaagttgccccagcaaatcctccggtcatcatcataagtagtgacgaagaagaagaacccaagcgcaacaattccaagtttgagtgggtagctatcaaagatgaggaagatgagccgaacgagccttcaatcgacctcctatgctcggaagaactagagtgacttgttaagtcgttgtcttagatcgttgtgttagtttgcttgttttaagtttgtttgtgtgtgtgggtctcgcatgtgatttacatcagtggtgggatgtaattgcatgtgtttgtttgcttttgagtgttaggaagttggagagtttagtggtgtgagagtcttcagtttgtaataatgaaactcagttaagatcaataaaagttaaagtaattctctgtcctaagtagtttcccccgttttctcttcttatcctgtccataccagatggtgaacactcgtagcaatgggaatggtcccaacaaccccaataataacaacaatggagagaatcccactctggcccaagttcttgctcaacagacacagcttatgaacatgatgatgcagcaatttcagaatcagcaaaaccaagggaataatcatgcacctccacagaacaagttagcagaatttcttcgtgtgaggccgcctgttttctctagtaccactaatcctgttgaatgtcacgaccggaaatcacccaacaggcgttcctgacgtgcgtgtattattccttgtcccaggaggcaaggtacaccaaaagttgatacaattcagagtttaacaagcggaagcgtatataaaattattacatgggcagcgaaggcccaacacacaaagacaaacgaagaagcagcggaagactagggcgaagaccacaggcgcttgacggcaggcacgagctagacaccgaagccttcatcttcaaggaactcctcaactgggcttgggaaaaattgagcaagactgagtacaaccaccgtactcaacaagacacacccacaaatgcaaaataaatgcaagggagtacaagggaattataatataaaggattagggttgcagtaaacagcatttaaagacatttagttgctcaaggccattttgtaaacacgatcctagaactatccagtattgttaatcaaggccgtgaacccacacgaacctgccttaacccaaggcctatgatgattcagaccgaactggcaacccgaccctgggtcccagctcgtcctaagccaacccaggccaaccattccatattttagttgttaagcaaattttaggaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacgaaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggctgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttaaacggccgaggtgctaccatcaaaaccatgcaccccgagcccagcctaaaaccattttaggggattttgaatagagggggcggtgtgaagccaattccacaataaaccaacaattccaaagtatccaggtgatatgagaatttcccaagtctagagttataaaaccacctaatgttgcctaattaacttgcgaagcatctacctaaaattatactagtggtactatgagtagagtgtccactagttgaggttttgtttgtctagggtgaacaaggtaataataataacaataacaataataatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggccttaacactaaataactccacataacagcagaaacaaagcacaaaaatgggttctttacatcttaaggaaaaattagagacttgaacggtccaattccgagttcaaatggccaagatatggccctttgaagtttatatgctctttaaatggatatttgcgaatttcttcatttaatttttaattaaaaatcggattattgcgtcagccgaggggcgggcgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcacggccgacgggagcggcgcgcccgcgccccgatggtcactgccggcgaccaacggcgcggcggagcggcacccgagagagaggagggaagggggaaacgaaggggacggtccacggctcaccccgagacagcgaaggcggcggaaacggcggacggagcggaagaaggcggcggcgcggttcgggatgacgatgacgacggcgctccggcagtcggcgagcgaaacggaggcgcggacgaggtcgacggcgatgcggcgatgccgagggaggggtcgccgagtcgggaggagaaccggagcgacgacggtggcgcaacggagctcggcggcgacggcggagagagaggagcacggcgcgagcacgattccgacggcgagagcgagcggcgagcggcggaaacgaaagagcggagctcgggcaacgtttaaatagcgccgggggaaggaaagagcggccggggagggaggaatcgcgcgcggaggattcggccgccattgattgcgccggcgatgaatgcgggattgattccgagcgaatccgagggagagagagaggggaaagagggggaaacgggggaggggattacggggagtaattcccccctcttgattgcacgcggggcggacgggagcggcgggattcgcggcggcggcggcgctagggcacgggcgcggcggcgggcgcggcgcgaggagggcgatgacaggtgggtcccacccgtcagcgagagcggcgggcgggcccgcctgtcagcggcgcgcgcgcgcggggaggccgatgggccgcgggagaggagagagagagagggagggagaagtgggccgagccggcccaagagggaaaaggggggggaaaagaacttcttttaggattttctttttataaaaccttttcaactttgtttatttcttttcacttattatttgtgctctgaaaattccactaaaatttttttaagcattttaggcttttcggaaatatacaaaaatcctccaagcctcatttgacttttatctttgcacattttaattgttggaggctttcacatgatttttaattattcttttgcacaatttcgaggatgaattttagagtcgatttgggacgcgacaaacctaccccccttaaacggaatctcgaccccgagattcggaagaactggcgaagagatcgggatgggctgccttcagctcgtcttcgcgctcccaagtggcttcttcttcggcgtggttgctccactggaccttgcagaaacggattactcggttcctggtcctgcgctccatggtgtccaggattttcactggcttctccacatacgtcaagtcttcgcgaacttcaattcgctctgagtcggcctgctcggatggcactcggagacatttcttgagttgcgacacatggaacacatcatgcacgttgcccaaggaggcgggcaactccagctggtaggcgacttctccgcgtcgagcagtgatacgaaagggacccacataccgaggtgcgagcttcccttttgtctgaaacctgtgtacacctcgcaatggcgtgacccgaaggtacacaaaatcatccactgcgaattccagatcacggcgacggttatctgcataacttttctgccgggactgtgccacctttagattatcccgaatgattctgactttagtttcagcttctctcaggatatcagtcccgaacacttggctttctccgacttggtcccacaggagcggtgtccggcatttgcgcccgtacaacgcttcatatggtgccatttgtatgctggcttgatagctgttattgtaggagaactcggcataggggagactcttatcccaggtcttcccgaaatctaggacacatgcgcggagcatatcttctaggatctgatttagacgctcggtctgtccatctgtctgcgggtgataggcggtgctgaaattcaaccgagtacccagctcttcttggagcttcttccaaaagtgagaggtgaattggcttcccctatcagatacgattttcttgggaataccatggagactcacgatcctagcgaagtagagctccgctagtttgtttcctccataggtggtcttcacaggaatgaatcgagctacctttgttagtcgatccacaattacccatatagaatcatatccaccttgggtttttggaaggccggtgatgaaatccatcccaatttcatcccatttccattccggcacttggagaggttggagaagtccggccggtcgttggtgttctgccttgacacgctggtacacatcacatagagccacaaactctgcaatttcccgcttcatgctaacccaccagtatttctccttcaagtctaagtacatcttggtactgcccgggtgaatggaataaggactttcgtgagcttcctgaagtatcagctgtttaagttctttgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttctaacgcagctaagaatccgcgaccaactatgcttaggttcagggcttccatctgttgattaagctcgggtggaatgcctcggacgttgagagtgttgcagtggctctttcgacttagagcgtcggcaaccacgttagccttaccaggatgatagtgaattcccacatcataatccttgatgagttctaaccatctcctttgccgaaggttcagatctgactgagtgaagatgtatttcaaacttttatgatcggtatatatttcacagcgattcccaatgagatagtgccgccaaatttttagagcatgaaccactgcggctaactccaagtcatgtgtagggtagttgccttcatgaggtcgtagctggcgtgaggcataggctaccacatgaccgtcctgcatgagcacgcaccccaatccttggcgcgaagcatcacaatacaccatgaagtccttgcgagtatccggcaagattaacactggcgaggaaaccagcttttccttgagagtttggaacgccttttcgcattgcgggctccacccaaacttctcttctttcttcaacaactgtgtcatgggtcgagcgattttggagaagttctcgatgaatctccggtagtatcctgccaaacccaagaaactgcgaatttgagtgactgtcttaggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatgatcttcttctgattgtgagtatatcagaatgtcatcaatgaaaaccacaacaaacttatccaagtattccatgaacactttattcattaagttcatgaagaaggcaggagcattggtcaagccgaacgacatcaccgtgaattcatacagtccatatcgcgtagtgaatgcggtcttcggaatatcttcttcacgaatacgtaattggtgatatccggaacgaagatcaatcttggagaatacagtggcacctttaagctgatcgaacagatcatcgatccgaggaagagggtacttgtttttgatggtgacttcattgagagctctgtagtcgacgcacatcctcttcgtcttgtctttcttctctacaaaaatcacaggagcaccccatggggaagtactcggacgtatgtaccccttttctttcaactcttccaactgtttcttaacttcggccagttcatttgctgccatacggtagggtcgcttgtgcagaggagtggttcctggagcaagatctatccggaactcaatctctcgcttgggcggcataccaggtagttcttccggaaacacgtctccgaactctctgactatggggatttctgacagacctatctgatgcagttctgaacttctgacagaggttggaggtgcaaagacaacaaccggctgttccggtcctcggtacagagtgacagtgcgtctagcgcaatccactactccttggaattgtgccaaccaattcatcccaagaatcacatccaagttctttgtgtctagcagaatcagatccgagggaaaaggaatcccctgaatttctataggaacggcagggctataatactttgctgtcataaccccgccaggggtggtgatgagcagagggtttctaagcctttctacccccaactgatttttccccacgaatggcacagatataaacgagtgggaagctccagagtcgaacaaaatagtagcagggatggaatgaacgaggaacgtaccaacgatgacgtctggagttgtcagcacgtcctcggccgtcacgtgattcacacgaccacggctgacgtccttgccaccgttgttggagcggggaggcgcttggccttgctgacgccttggctttgggcatttatccgcaaagtgtccgggctcgaagcagttgaagcacagccgctgcggacctgaagcgtccctgcggccttgaacgggctgcacagttggcgtaggaggacggggtgcacgggtcccttgctgattctgctgctgctgcggctgtgggacgcgcaccacgaattgaggtcggggcgctgggcgaggttgctgctgctgttgttgctgcgaggaggatccccctgggtagggattggtgtagcggaccctctggttagcaccctgttgattgcggaagttcgccaagcggcgcttgtgcaattccagctccttgtgcttggcttccaagcggatgctcttgtccaccagacgttggaagtccggatagtccccagagactaaacgaacggacagctcggggtccattcctgccaggaacttctcttgtttctcctcatcttcccgcacatcctccggagcgtaacgggctagattgttgaactcatgcaaatactccatcacagagcggttgccttgcttcaactctcggaattcctttttcttaagagccacgactccagcgggcacatgggttctccggaaagcggcggtgaagcgagcccaagtaatcggttgcccctcgggctgcgtggcctggaaatggtcccaccagagagatgcgggcccctgcagctgatgggcggcgaagatgactttctcttcatcactgcactgcacagtgtccagcttcttccccacggcatgcaaccaatccaaagcatccacggggttgttggagctagagaaggtaggtgggcggatgcggaggaattcggcgagtttagagtgttggggaggtggtggtggagcattctgttgtggtggattttggaggtggtggaggaaagcattcatcatgttggcttgctgggcgaggatctgggtgagaatggcgttggtgtctggtggtggtggtggaggtgggttgccttggtggttggggttgctgccttcgggttggttgccttcaccggtgttaacatttctcctggtcgtcaccatctgaaaaccccacacagaaccagcaaatagagaaggagagctgacgattaaaactaaccacccacgactactattattcttgaatttattactgatattaaattggttcattaaagttcaagttgcttaggcaaataaaataagacaggctccgacatagttacaccacacaccggtgtaaccatgccccacacaactcaaaaagacaaacgaggaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaagtccacgccagggactgacgaacaagctcaggcctggaggtgctcttgcgggcggtgatcttctggctgcggcagacgcggcgacgcttggggcggcagatctctccctaggcgatcttgagctggtgcagctgcgcctccaacgcgtcgaggtccttcttgagctgcaggttctcctgacgcagctccaggatcttcatgttgttctccaccatgccacgacgcaccatctggtggaagtcgatacgagccgcgtcgtacgcctccaccatacgtgccagatgcacgacggtagcgtcatcctccgagctggcgtctcggaaggtggcgtggtcgctggctcctccgcgacgagggtggtagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaagcagcgtgaggctctgcatcctcaccctcctgatccggaagcggccgggcctggtaatccactccatgtggataccccaagaccacgcacatgcctcgcagctccaagacgaagccagtcatgctcaaaccacgacgggtaacgctgccggccatctacaaacaaaaacaaaagaaaagcaacattttaaaagatcagattttgacgataaatgaagcagcaagacaaagagagaatagcgggttttcacaaataataaaggatttttatttttgaaaatattgctaaggcttgggatctacggctcgtcctagggtcaagggaggctctgataccaacttgtcacgaccggaaatcacccaacaggcgttcctgacgtgcgtgtattattccttgtcccaggaggcaaggtacaccaaaagttgatacaattcagagtttaacaagcggaagcgtatataaaattattacatgggcagcgaaggcccaacacacaaagacaaacgaagaagcagcggaagactagggcgaagaccacaggcgcttgacggcaggcacgagctagacaccgaagccttcatcttcaaggaactcctcaactgggcttgggaaaaattgagcaagactgagtacaaccaccgtactcaacaagacacacccacaaatgcaaaataaatgcaagggagtacaagggaattataatataaaggattagggttgcagtaaacagcatttaaagacatttagttgctcaaggccattttgtaaacacgatcctagaactatccagtattgttaatcaaggccgtgaacccacacgaacctgccttaacccaaggcctatgatgattcagaccgaactggcaacccgaccctgggtcccagctcgtcctaagccaacccaggccaaccattccatattttagttgttaagcaaattttaggaattaaaacactaacttgggtacattgctcggcttgcccataaccgagggctcggctatt

SEQ ID NO: 36550 - DNA, 836 bp, Oryza sativa
atagctcataatgatagatatcttgggttaccggtatttattggtagatccaaagcgaaaacctttgaatacttaaaggagaaaatctggagatgcatccagggatggaaggaaaaatttttatccaaggcaggaaaagaaattttaattaaagcagttgcacaagctattccaacatatgcaatgtcatgtttttatttaacaaaatctctttgtgatgagttaacttctatgattttgcgcttctggtgggctcaacatgataatgacaaaaaaattcattggttgggaaaggataaaatcatgaagccaaagagtcaaggaggtttggggtttagagacctacattccttcaatattgctatgttggctcggcaaggttggcgccttatccaaaatcctgattctctttgctcaaggctgctaaaggccaaatattttcctaactgtaatgttcttgatgcgcagtcaaggaaacaaatgtcatattcctggagaagtattctaaagggaatacaattactaagaaaaggcgtaatatggcgggtcggaaatggagagcatataaacatctggtcagacccatggctgccaagagatatgagattcgtcacaacaagaagaggggcatctttaattacaagggtgtgtgagctcattgatccaacaacaggccagtgggatattgaattaatccagcagattttcaatgagaacgatgcaaaaatcataacaagaataccactaagggaaggtcaggaagattttattgcttggcaaccagatactaaaggaattttctcggtaaaatcagcatacaagctacatgagaagat

SEQ ID NO: 36551 - DNA, 1103 bp, Oryza sativa
  unsure (1)..(1103): unsure at all n locations
agaaattttggtccgaactccgaaataaggcttcaatattcagatccagatatgaaaattccttctgaaaaatgtgaagcagaatggtgtgtacctgacagaacacactgaattgcatcgaacaggatggacacagcaagaataggcatcatcttagctatataatctgccacttcctcctcattgctgtacgcatatccccagagattgcgcacaataaccatcacgaggccttctgaagttcctaccaagaacgccaggagcatcacaacacgggtcgccaagcgtgccgcctgcggtcgcccagctccgagctcattcgacacgcgcgtactggtaaatcgaatcaatcaagcgatcaatgttctcgaaactgctggtatttctcatagtctatttgttgtttcagagttcacaggttttgtttctaaagaaatggactctgttttgtttctgaattatgacttcagactctgttcagagttcagagttcagagttcagacactgaccttatggcagcaccaagtccaagtggcaccatgaaggcgaaagagtttgtgttcaagctacaagcaatcgtagtagcagcagcaatgattaattagcggagacaacaaattgcactaaattttagccaaaaaaaataaaatgtaggatttgaatagatcaccatatggacagaacggccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 36552 - DNA, 2538 bp, Oryza sativa
aaatagatgatccaaagtcacattaaaagttaatggtgtgtagctagtactagaaaatgaaaaaccggttggtagctccttaaggatcgtaaaatttctattgtgatgatacatttgcctttttggtttctaggcactgaaggcgaaggatagagtttgcagttcttcacttcctaaagacttggcaacatgaggttacatcaacagaagagcaaatgcatgcagttttattggatgcgaagtattacaaataaattgtttttggtacccttggcagaatcaatgaatgcctgagttttgatagtttgagttagctagcctaggtatgatttttgtaacgcgcaaaaacctatcagatcttgtattacacattctagatataacaaatattagtgtttcctcttgaccattaattttcagaacgaaaattaaatataacggcaacagcattgttcttgtcaatgcagcaggccattgtcaagcatggatagtcacctatagccaatttatttaattcgtgggttgaaaattagttatgaccacatgctgcactgcttctgccgttctgcggggccgtcaattccttttagttttatactgccgcacacatttttgtaagttcaacgtacgctgccaagacaaactattttactgatatatccagctaaattgcggatcacataatatctggattcttactgacatggtgatatgcagcccggggcaacatataaattgtttagtacaatactactgcgcagcggcggttgtatagcacactagcgcagagggcagtaaacggaatagtcatataaaaatttaattgaattgtagtttgaggcaccttttgttgcaaaaatttcagtttggactacctttatgtaacctttccgcttctgatatacaaaaggtatgatctacacatatttggaagttcatcaacgtgaaactgctggtgtaatcaaaatcattgatgtagtagaaaagagagttcagctggtctaaagtacaacaatggtaaagtcacctaatccaaaataaaaacattagataaaggtggtccaaattagatctttggttatagaagtggtccaaactgtaatttactctcaacattttactacgtacattgaagtggtagggtggggtggagcaagctacgcacgcagagtaaaagatggaaacatctggtatacgtaaataagtgtgggtggttttcaatatttatgttttcgcatgtccattatatgtccttctactaccatggaactctaagtaggtggcacgcacttatggatgccaaaacaaaccgtgtctctaaaatgatatcaaagacaagttgaaagccaatttgcgtgtgataacttgcttggttgaggccagacgtctcctaactaatcatcatagatgcttccaaagaaagcacataaatgttgtggggataaaaattcatagatgcttgtaaagaaaacatgtatgtgagtgaggtacatcttcacatacgttattccataaaaagtgtccctgtaatgtatcataaatgtacgacatacatgtgtatctgattacttattcacatatacgagtatgtatcaaaattgtagatattgacgcgatgtacaagtttgtagtggacaaccttttcatttgacattatttacatgtaatatgcgttacaagttctcagatctatttaaagaaataatctttcaaaattttcaagtgacctcagatgtatatcaaagttgtaaagcttgatggttgacgcgatccacaactttatagttgacaatcttttcatttggcattgttagaatatgcggttcaaggtttcacaactattagaatttttttaaaaaaatttgtaatgacattagatggagacatgctctatatcaaagttgtacaaatcaagaagatctataactttgatgatgacctttccatttgaaatcatttaaaattttaataaatacgtattacaagttttggattggtgaacctagctaaaaagaataggatcccttattctatcaacaaatgcatcaaaagtgggaaggtaagcagacttggcatggagggcgaggtcccaggttcaaagacatatttcctagggtaactcattttttaatcaatccccattcttaaattgttttggaccttttctagctcaactagagttacctgttttattatggtctagcaaatgtttagccccaattttcctttctactacacgaggcattcagctttatgttgatcatttaatttcttgttaacaatgcattgccaaacttcagatttaagcctcatattcttaggttttgtttctgtacgttgtgaattagcaggtcattgggcagagtttgtagtagagtttggctagagcccatagcatagtgttaatgaagtctgaggctcccacttgtagcagctggattttacattctatcagaaaagagtgattaaaaaacatagatctaggccttaagcacatactccctccgtcccaaaaaaaagacaaaccctgtgtttccg

SEQ ID NO: 36553 - DNA, 12115 bp, Oryza sativa
taccaccaataaaaatcctaattataaaaaatttcatataagacggacagtcaaacgttggacacggaaacccagggtttgtccttttttttttaaggacggaggtgtgctgtactacttgttcctatgcttagagagatagatcaatagcatgttctagggcatcaatcaaatcaatttattttagtatggatccacattaattgagtaccaaatcatgttctttgacatcaaaataaatgcatgcagtaccaaacctgaatgcaagaagttgaggaaatcagggaaggagtgattgaggattgagcagttgagtactcttgaagaatacctttcttgcctcttgacagagctgagccgtagagatatgagtgaccatgacaaggggtaggtggcaatggtgcactggtacggggcaccagccatgggggatggactggcgataggagaacggcatgctgccacatcgttcatgcagcatggtggaagaggctgcgccgcctcctttgcatctgttgggggtgacagtgtgaagatctgtgggagctgtggatttacggagttagggttggtttatatatggttgcctccagtgacttggactggtaggtttggaatggctacctctagagagatcatacccgtggggtcttgtgggtcactttcagttcagcccttgctactagttgggcctccaaccaccacacccatgggacaaaaagtaaccctgccccctatggggatatcgccatccctactatgtgtgctcattaattagacatattcttctccaactatcaaacttgagcagacgactccaagctggacggttctttctctacatccatgatttagtatcgttgttgggacctgactttgaaaatctgatcatgagtttcattcttccatatgctcacgttgttacctgagctcatgcggattgaccatcttatgttatacaaaatattgtccaaactcaacttcgttcgtcagatataaaaataacatatatttctaactagtaagttgtcctaatgatagttatagattagttatttttatgtgtcggagacaaagtcaggttaagaaaagagtttttacatggttatataacatcatattatctactttttgatcgtttgtttgatgaatttaaacgacttcttgatcagggtttacaccaggttcacctggatattctatttaccaaccatatgatccatagctagttcattgtccagcgaacacttgtgatttagacaccgcctaaatccatgctcatcgattattcataaaaaatggagatatacttacaagtatcaaataataaccattttcgaaataacaaataataatagtgctcaaaggaaacaaattaataaggttccccaggaatagtggacaaccaggcaaaggaccagctatgcaaatcaacatgcatacataagaagggaaaattaacgtattctctccaggaaggaaaaaataatgatcttattacacaggaatggacatagccacaaggaggatgctgaagaagctcgaatataccatccactgggcaccatgaggagcggcactgctgtctgagtttggagctgaaatcattgaagcgagaaaggaaattatttagaaaggaaagttaaaaagtataaaacaacaaaagaaattatcggaaaataaatattaatttaatttttgagaagttaatactacctctgttttttaatagatgacgccgttgactttttttcacatgtttgaccattcgtcttattcaaaaaatttacgtaattataatttattttgttatgagttgttttatcactcatagtactttaagtatggattagtttttattccttttttttaaaattttaaattaaaacaatggatcaaacatgtgagaaaaagtcaacagcgtcatctattaaaaaacagagggagtacgtggaaacatgaaaaagaaaaacacgaagttgcacttacacgctgtgggaggactgctggctggagctgaaaaacaaaaaaagaaaagacagatgtatcagtaatacggtaatcatatttaagtattacgggtttgaaattttcaaattttcgggagtttcggacccccggtacacaaccatttgctccaaaaatttcggattcttttacatttttgaaattttggtcaaaatttatttaaattttaactaatttcgtaccagcactttcccaaatttcagtgacccgaaacttcggtattttacgaaattgtaaaccctgactgattatacaatatcacactaacaagagcctgtttagatcccctgacaaaatttttcacctgtcacattgaatgtttggacacatgcatggagtattaaatataaacgaaaaaaaaactaattacacaatttgcgtgtaaattgcgagacgaatcttttaagcctaattgctccatgatttgacaatatggtgctacagtaaatatttgctaatgatagattaatcaggcttaataaattcgtctcgcagtttacatgcggaatctgtaatttgttttgttattagtctatatttaatacttcaaatatgcgtcattatatccgatgtgacacgccgaaacttttcagccaccgagtctaaacacagcctaagttggcaaatactcttatcaagaaagacgaacattctgtcaacatcatgttattactacgcatatacgtaccaggagcaggcgcatggctgctgcacacgtcggcgggaaccttgacgtcgcagcgcccgaacagatccaaccccttcttcgtgtcgacgccgacggtggcggccatcgccgggttcgtcagcacggagcacaggcatcccagctcgctctcgtacgccttcttcagcggcgcgcagcacgcgcccgtgggcttcgccgtcgcgttccggtagaactcggagcacggcgccagctccgccacgcacggcaggttcgcctctggcgtcggcggcagggaaggaggaacgatggccgggatcggcggcagggcaggaggaacagcaatggcaggcgtcggcggcagagccggtggaacgacgatggccggcagcggcggcggcggcggtagagcaggggggacaatggccggcggcggcgtcagcggcggcagaggaggagaaggggcaacgacggccggcggcggcgtcgttggcagaggaggagcgacgacggtcggcgcgggcggcgtcgtcgtcggcagagaaggaggaacaacggccggcggcatccctggcctctgtgccatggcggcctggacgacgacgacggctgcaaaagcaacgaccaagacaattcgcgccattgctcgaattctctatctctcaaaatctctctacacgtgtgtgctgctcatatcatgtttattctagtctctctctaacatatatatacgcagaactaagcaagggattatgtcgtgatagccactaatttttccgtccatgctgtaaacagcagctacctatactcgcttcactatttattttatactcactctcagtgcatatatattttgttcctatttttctatttataagaatattgccaaattaaataaattttcaatagaaatctactcgtatcttttttatgtgtcgattcttgatgttttttttaacttatattaataactgatgaagatttcaatgtttgacccgtatcgcagggtatccaaaatccatacattttcgggattcgggaacacacatggggtacatatttaatcatatttgaagatttgaacataaaagtagctggttgcatatgcatacgttgcatttaagttggcatgttcttcccccgtttcacaatataaggtacttcctccgtttcacaatataagacttcactggtggagaaattctttttagtcccggttcgtaaccccactttagtcccggtttccaaagatcgatctttaggctgagccatctttagtctcggttggtgagctgactttttttttttttgcatggccctgttgctgcatggtttatatatatgtttcaatacatatatatgcatatataatatatgcatatatatatattatattatatttatatatgtttcaatacatatgtacatgcataatatatatgtatttatacatatatatatatatatatatataaccaaaatatatttacattatagaaaatgtgtacacatgcatatagaaacatatgtagtcatgtataaattacaatccattatatgtcctagctagctacgatttcgacgtagtagtagtcgctagctcagaagctaaggacctatgaattgtgtttccgtcgtagtagaatttacccttgggatcaaggatttgttcgttgatgaatcccatgagttgttcttgaaccgccgcgataaattccttgtgtgtggtcaggttatccctcatgctaataaactatatgaatatatgaaattgattagtaattaaacaagaaatcgatacgtaatgaaattttgaatttatttgtacgtacatcgagctctcttgtggtgatgatttggtctgcaaagcagtggcaatactcgcacacgtagtagccacacaagttagttccttgctttggctttgcgcactacaaataaatgacaaattaacggcgtgagatctaattaatatacacttgtttgtattaatttgaatcggagaaatataaatgtagagcatgtgtactcacaggaaatttgaacctccgcctaagtctctctccgcggaccaaatgacggaaccgataccaagccctacatggagtttaaagatatgattcgtagtagcaattaacataacaagaatttcttaattaacagaggaacttatgacagtacctgtctataagttcgaaaaccttgtcaaacctaggctctttttaatccattgagtcatatacgttgacggtgcaggccgataggtcgaagagtaaaagcacccagtggaatctgcaatgtgcgtgggatgcattacatatgaaacacttagcaagttcgtacgggaatgaaatttgatataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccaatatcgaaaaccccccgccgtcgggccctttgaatctccattctacaacgataaaagggagtattttattttatatagtctacttatatacaaggacctaattaattaaaggagacgtagtaattaagaaatataactgaacgatatacttacaaaatccagcaactcataatagagacgtcgagggcgtccagctggtatacttcgtagattcccttgaaattgatccagagaatgtcatctccttgcaagaagtccgggtccctgatcctcgctccgatcatctctctaccggtggcgctcatctccatgtacagctgatggaacttgtacatttgtgtgggtagggactgcaccagctcaggcttgacaagcggtttaccgagttcgtacatgtatttcacttccgccttttctattggtgcgactcctagcaattgatccgtagttagaccggtgtcagtaataaattcttctatcatcatgtcttcaccggtcaccaacggctcaatctcctggtttggttgctctccaagctgagggactggtttggacttcccagaagatgctttcttctgcgttcgctcatagtccgatagcttgatggcctcttgacaggtgcagacatacccctgaagaagttcttgacactcgggtctataggaatcttcttttccggacttcgaggcttgaattgtctcttgacttctgatgccacgtaagcgtcaagctcctcttgcgtgcaatcgtaccccgggtccttgttcttggcggcgtcaactttcgccttcttcgttgcccttgtgtgggcaggcggtggagctggggtggcccttgactttgaaggtgccggaagaggagcttgcggaggagtcggtgcaggagcctgaggaggagtcggtgctggagcctgaggtggagacggtgctggcggtgcatgaggaggagacggtgcaggatcctgaggaggagatggcggagccggaggagatggtgcacgagacgccgcttgtcgcccaggaaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatgaccatgcccgacgccgccttcatgtggtgagagattatttattagtaatcaacatatataagcagcaactagcggaatggccaaatctaaaatatataaactacgagcttacctttattgataagttcttgaaaggaatatgcagctcacatggtgtccgctgagtgatgtcatcaacgggacaggtcgattcgtcctgggtttgcatggcgtccatgctctgtgatcctacctgccccattgaggcgcagctgctacggtttcctgacgggctcaccattgcaggaggaatggtcggctggggataatgggaccgatgtgcggccatgcgttcatcaaccttccttgccacctcctcttgcatgctgagctcgtagctcgatacccggaactctagatctgcaatcttcgccttggtatctgtcttgctcctcatccaactcctgtacgtgtggatgtcctccttgaaaccaatcttccaaggaatcacccctttccctcgtgttcgtcctggatgctctggagtctgcagggcgagtgtcaacttcggcatcgcgacgctatagcctcctgaccccaagtggtgatggtacgtcttcttggcggctttttctttgtttctttccatcatcgcctgcccttgttcacctgtcttatatgcagcgaactcgtcccagtgatcccttagctttgggtatgtgtcgaagttcggtgtctgccccttcaggatatacttctggtacagatctcccttgaagctctgaaactgctctgccattttcttcagagtctaccttttcactttgtcctctgtacccgcaggaagggtgaatgtctcgagcattgtggtccacagcatctctttctccgaatctgggacaaagctctcatgatctccgcgtgtccttgttcttcgccagtacaccgtactgacaggcacgttatcccgcacaacccaaccgctgtgacgtacatagttcttggcggcttcggccggggcactaggtcgtccatcttcttccacctccgttatgatgtgccgaccctcaagcttctttgctgcacctcgttgcccgcgtgccctcttctgtccaacggagggttgacttccactagcctcctcctcctgattcccctccacttccctttccacgtgcgcctgctggttcccctccgcatccctctccacgttcccttcctcgttcaagtactggtttggatcctcgttcccctcttcttcattccagtactggctgcttccctccacgattgtatcgtacaatatctgttcctcatcgcgatcagccatctgttgatacaagaaacatctgctaagtcatgagacatttatattttaacaatctaagtcatgtatgctaagtgtaagtgtcgtacattagaaccctacacaaccttacgtgctaagtctaattacaaatctaataatctcatactaaaattcaaatcgtgatatatgctaagtctaggtgacgtatattatacgaccctagctagtcaataatctcatactaaaactcaaatcgtgatataagttaagtcatgagacatttatgttttaacaatctaagtcatgtatgctaagtgtaactgtcgtacattagaaccctacacaaccttacgtgctaagtctaattacaaatctaataatctcatactaattaaaactcaaatcgtgatatatatatgctaagtctaggtgacgtatattatacgaccctagctagtcaataatctcatactaaaactcaaatcgtgatataagctaagtctaggtgacgtatattatacgaccctagctagtcaataattatatactaaaactcaaatcgtgatataagctaagtctaggtgacgtatattatacgaccctagctagtcaataattatatactaagtctaattacaaataaaataatcttatattaaaactcaaataatcttacatgctaagactaaaatagtcatgtatgctaagtgtaactgtcgtatatgctaagtctaattaagactaaaatagtcaattgttaggagtcgcaccaattccgtagttagaccggagtcgcaccaatagtaataaatgactaaaatagtcatgtatgctaagtgtaactgtcgtatatgcaattaagactattattagaacactacacaatcttatatgctaagtctaattacaaatctaataatcttaattgcattacaaatataacaatcatatatattattacgtcacttgcctgagcgaattgcttctagggctagctcttccactccggcttgagggacgactccgacaacacgtcttttctgcaagatacaaaaaaatgtattaggataaacgcgaagtaacatacatatatatattgcatttcacgttcacgttcgttcacgttcattcgctcgttcacgttccctcgttcacgttcgttcgctcgttcacgttccctcgttcgctcgttcacgtttgttcgctcgttctcgttcgttcgctcgttctcgttcgtttgctcattgatcacgttccctccttcacgttcgttccctcgttctcgtttgtcttcgttcgaccgttctcattcacgttcgttccctcgttctggttcacgttcacgttcgttccctcgttctcgttcgctcgttcgcgttcacgttcgttcactcgttcacgttctcgttcacgttcgttctcattcacgttcgttcgctcgttctcgttcacgttcattcgctcgttctcgttctcgttcatgttcgttcgatcgttctcgttctcggtcacgttcgttccctcgttcacgttctcggtcacgttcgttcgctcgttcacgttctcggtcacgttgacgtgttcgttctctttcacgtgttcgttcacggcggtgtggcagcatcgggccggcgcgtggcgcggcggcgtggcgtggcggcggcgtggcgacggcgtggcgccgcggcggcgtggcggtgccgcgacggtggcatgccgcggcggtgtcgtggcttctcgtggcgcggcgtcgtcgtggcgcgacgtcgtggcgggcggcgagatacggagagagagagagatcgagattggagagagagagagatcgagggaggcggcggcggctctcaccccagagatgcggcagcggcggaggaggcggaggcggcggcgacgacgacgagctcgagacgacggcgagatacggcggcgtcggcgcggggatgccctaggcagtggcggcgaaggtctggccgagagagatcgatcggccgaaaacgtctaagtgttggtggagaagacgatggcgcaccgggaatatatataccccccggatctttagtcccggttgttctcatcaaccgggactaaagatcttatcccgctattttcaaattctttttaaacccggttagggttaagaaccgggactactgattatagcactgaatattattttcccttacatatgtgtttctaaaatagaagataatgcattacaattatttaaagtacaaagattaatgacaattacttcgaaaaattattgttgtctgtaataaattaagtggataaatcataataagcaaatatatgacttaaaattaataaaaattccaataatcatatatacttagcatatgaatgctattattaaattggtaaaaactctaattaacatatgtatgtacatatggcatgatttaaaattaataaaaattgtaatcatcatatatacttagcataggaattatattaaattaaatgttaaaaactctaattaacatatgtaaatgccacatgcatgatttaaaacttttaaaaattcgaatagtcatatataattagcatatgaatgatagtaatataaattgtgaaaaactctaattaacatatgtaaatgccacatgcatgatttaaaacttttaaaaattctctagtcaattataattagcatatgaatgatagtaaattaaatgttaaaaactctaattaacatatgaaattgccacctgcgtgatttaaaacttttaaaaattgtaagtatcacatataactagcatatacatgatttaaacttgttaaaacctgtaataatcgtgcgtaattaacatatgccatacatcaattgatttacatggataatcaatacatccaaaatagtttacatagtgtacacaattgttggcaactttttgtgacaagtcgacaagcacgatcgcagcacctaaatgccttgcggtgatcctagagtcgccgaccacctcgatctcgccaaagggccaaatcaagatgggttttgtagaaaaacagctaaaccggctagcggagccaatttagagatcaaaatcagcctctaggccgatttagatcaatatgaggataactacccgtctcgtgggcaaaacggaaggttttcagaacaaacctacaaagaggtgtcgcactctcgcagcggcggcggacggtttacggcgcaaaccgacaaagatggactaaactagggtaaaatagaaaacatagtaaaagaacgattcaagtagattgtattcgggggttttacaatgaaccggccttgtcccttaaataggggttggtcttgccccctacaggcccttctccgcgtccaactcgggatagaaaccaaaggaaacacgaaacatgccttcccgagcaaggaaacccgagacccgacgaaaacatactcggacttggaccctgctggtctgaccgcccatatacctgcggtcagaccggccctactagccggtcagaccgcccatatacctgaggtctgaccggccctaagaaagaaacccggcactttccaaactttggcaattttcctctatttcgtccataggtgtcaaatttgggtgtaaacacatgcccccctgcctttttgatgaacactgtgaatctaaaagcatggaacatgttgtcttagggcgataatccaattaccggccataggacttcctaagcaccttgccaaatgctcgggaagtatttcttcaagtattttccattaattgctctccgaaaacaccgtcttgaagtgtcttcatctccttcaaagtcttcaaacgcttgtcgatgacatcttcaaaattgcttcccatcaaggtcttgtaatcttcaaccgacaagtcatcttgcttgaaataccgaagaaagccaagatttacctcaactggcaaaacgccaatttcaacaatgttttattactcgactcggcttatccattagcccgagcgtagtagagagaagaactcaacaacttaatatcataaaattcggcaaaacttctcacctccttagacataaaagaagctcctcgatcaaagtttaaggaatactgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatact

SEQ ID NO: 36554 - DNA, 6272 bp, Oryza sativa
tacagtaactcatcaattgaggtcatcttattctagtgcaaaatctacacatcatgcaagtgaaacacatgcttatgaggcaagggttgaggatggtcaattggataaaggttttacctctatccatgtagatgaactagataacagtggcatcagtccagtgtgtgctgtagaatctggaacagtgtgcacaaatttggtggatccacattgtgaagaatccatagatatgactcataatcatgcagatggaaaaagtaatcaagttgatatgaaaaatgttgacgagcctcaagatctggacactagtagactttctaacaagggtatcaaggaaagtgttcagttggaaggtttcatcggttctacttctgttaaggaaaattccaatcatgtacaacctgaagtaagcaccactgttcctgttaaagatgaatcagaagcttttgacagtgcaatagttgcacagaaagatattgtctgttcgtctcctgtccacagtatgaataaagaggaaagtccaggttcaaagggaagaaacagttgtcttgggaattctaactctatccatccaattgttgtacgccctgtcttgcctaaaaattctctacctgaaaaatacagctctgatatggaaactgaaattaaaacatctggagagaaatctggaccaaatggcacaaaaggaacatgaagattctatccttaaaaaggctcatcttatagaggtatgctggtttatgtatttttctactatgatgttaatcttgttctgaaaagaaaggaaattgtgtttaataggtgaatcttaagagggctggtgaacgatctctctataatatgtctctagagaagaggacaaggggtcactgggattttgtccttgaggagatggcttgcatggcaaatgatttcatgcaggtattttctgaattggtctctgattttgtttttccttgtgctattcttagctaaagttcatccttgccaaaattcttgcgccattcttttaagagttgcttacataaactgtatactgtttgtttgtttgtatttaataggagcgcttgtggaaaaatatggctgcagctcgggtatgccattgggttgtgtctaaaggaagggcaaaatttgaggaagcaatcattcagagaaagcagaaagctgttacaagaagccttgtaaaaggtatcatgagtttttggcgttcagcagaggctttgcgaactattggtaggacagctgttattcaagaacacaactcagatatgctggatacgacaaatcatactggtttgaaagctgaaaaatctgaggtaaacaaattgtttcacataaccttttctgaagggtgatagtgtatttgtgctcatgacatcacatgtgttcacattttagtgccatatattgaaggatgttgggtacttagatgttacaaaaaaaaaatcaggagttgagtacactagtcttatctttgccattttacctgctaaaatcatgttttggcagtttaattggtatatactttgttatagcaagggcagatgattatgctgttgtctgtgaggttgacacaatcttggatttgaacagggtaacaaatcctcggaagcagaagagcctaactatcctcgccaatctcgaattcaggattatgcagttaaatttcttgaatataacagtcagacatctggttctcttgtgttggctgaagcaccaccaactcctgacaggctaaatgactttggtaccttgaaagtgtctgatctttcagaagtaaactactgtaactttgtgcagtctttttatgattgattttttttcatcacttttacttcaagatatctcgtactaacgccctgataaacactcaatagacacacttacctttgttttgacaactagaaacatgcatgaatagtgttcaacagcggttgtttctgatccttttgttgaatttcagggaagtctcttttatacagtagcacctagtgcaatgaaggtatacagggagtctgtggaatctctttctgtgcatcataaggtgaagagagttttttctaatgaacatattatgcatattatatttctggtatgcagatagtgtgttaaaatgctggatcacaagatagactggcattatatgtgtaaacaaacagaaatgataaggtcgcctgtattttcacataggactcataagaatattgttggcaatagaagtttgaaatgttcccactgctgtattaaaatatttctgggctgctggcatatgctgcatttaattatcctgttgcttttgttctgtttggatgtactgtactgcatgaacgccaaaaggaacatatgccattttatttgctttttttgccatttctttcatcattactggcgcactttgctttttccatgttcacagtgttggcactttctgttgtcaaatactatattgatagtgttggtaattgcaaaagactggttacattggtctcaaggatgactatgaggcatctgggtgtgactttgctgcaggtgatacttacctgtgccctatgttattaattcctattattatgtctttactcctcctaatgctttacattttgttctcagatttgcctcaggagaatgcttatgaggatgaaggggagacatgcacttatttaccggaagcatatgatggtggtttgttatcacagatgggccataggaaacaactagggcagcagaggattaacggtgcaagatcatatggaataagtactcatgtgccttttgaaccatatttggaaagcaaattatggaatggaaaaaggccttcatctttccttgcagttcctacgaaacgcatccgtacagctgctagacaacgaatcgtaagcccataccctgctggcattggtggaaccacccaagtcacaagtaaaactgatgtttcaagtggggacacaagctcctaccaagatgatcaaagttcgttgcatggggggtccttgccatggaaaaatacagacttcgaatcaacagttgattttgacagacaattgccatatgatggtagggaagtggtcactaaagctaacaagaagaaaaagcttaagaacccaggatataagacttctcaaaatgcagccaattcctgtgccttggcttctgcaaaggttaattctttaagcatgctttcaattattgttgttttcaatgtttgtccaagtaaatttattctcctattgcttcagggccgtatatgtgatcaacgatcccaagctgatttctttactcagtatgaccaggtttttttttctctttgttttcattttcaggttcatttaatgatgctatttagattattttgcaattttaatttgattttaataccatttatgaacattctattcagaaggactttctgaagaagaaatcagactctgaacaatttgattcaaaatggaacattggtaccttcaccccctctaattattgtgcttgtaccctgtgtcatacagcaatcgaactatttgctctatattttatttgagagaaaacattaagtagctcttaacatctcatgtattgatttttattcgtagcttcccatggtggtcaacatgctttgaagaagcttaaattgatgaggcaagggatagatatttcacaggaagcttctcctgttgcatcacagatgagtaacatggcaaattctgctaaaattataaagataatcaccaatagggatcgtgggagaaaaggcaaagcactgaaggtactatgatttctctaactactaccatgcacctttctctttatttgcataagcatcatagttttgtcagtggtcgaagatgggacctttgatctgctgtgttgcacatttttctgctctgtatacctataatcaagttagaaattaagatgattcttttgtcatgtcatgttcctctttccgtgagcaatagaccagtaagctaatttcacctagggcctgtgttgctggttggtcaagatagagagacagactcagctcaggtcaagcaagcaggtggaagtagtaaggttatagttatttcagttgtatggctggaatacagtgaataatgttgaaaagggttgctgatatccaaggaaaagctgtccataagtccagaaccttctcatttctcatccatgatctaaaagactactatctgtagtcacaaatgcatgtcgttttggacattggttcactattcagaatacaaactgtccccaccaatatggcaatattttctgcagaatatttataaccactgatctaattaaagtttggctgcacatatgttgttcttatggtcttgctttgttcctttccatttggtccttttcagtcagttgttttgctactgaatcttaacatgataaacatttcccttttaagttgagctgtcataaatcataatcatgaacatacaagcataatgttgtggacaacacatgctgtacaaacaggatatctttcctacaatttgcttattgaagttctatgcttttggtagatggcttccagcggtggatggtcaaacttcgaggatcaggtttgcatgtgcacatattttttatgcttttggtagatggctttgattgattatgtgttctttaatacgatttgtggtaatgacttaaatatcataaatttcaggctcttgttgtccttgtccacgacttgggtcaaaactgggaattagtaagcgacgcaattaatagcattgagcaattcaaggtaatttaaaatctgggatagcaactttttctatgtttgtatattcttcaaacatgtcctgcaagctctgattttatttccgttcttggttctaggcattttattttagtggtagatgccattaggagtaagttttgggttctgttgtaaactctagttgcagtgaaaaaaaatacattttatcataatctcatgggctgctgttagtgatctttccctgattaacttgagttttgcataccttgtcatgcagtctgtatataggcaacctaaagggtgcaaggagcgttataaggttctcgtggataaaaattctggtgatggtgccgatagtgcagaggactctggttcatctcaacactatcattttacgttgccaggcattccaaaggcatgttataactactcttttgatttatatatttaattgcttgccacatatgcgggtacatctcacaaaaatgtgatgttggacctatttactgtctgatactttctttctgaattcaggtgttgctttcatcagcaatattgctataagtgaagacatgttgagcatttcactgagttcctaacatgttttattcatatgaacatcagggaagtgctaggcagttattccaacgacttcaaggaccaatagaggaagaaaatctcaaggcacattttgaaaaaatgattctactcatgcggcaactgcacgccagacgtagaaaggttcatgtctctccttatgattattctggtcgctttaatttgttggtggtttataatgtataatcatgcaacttattttgttacatttataacagaggttaggtaactcttgcttttttttttgtcttgcaagaattttaggttgtaatggtgaaaccaagtattcattttctagtcttgaacttgtattagttctatacctgtgcttgtctatgtacctctttatttcaatttatgcatgtacctatgctatatttgataatatgatgtggtagcaaactcttccgttgaactatctcacttccatctgtctcaatcatctttctgaactagtaatgctgaactgataatgtattattcacattatgccagagtgctttttttactacccttcttgttgttactgggaagtatttcttatggtatgttttttcttgtgtcttgtctatagggtaatagccaggaactcaagtcgatcatacagccacatagttctcatgttgccgctctaacacaagcatgcccaaataacttatccggaggcgctttgacgtatgtaatgcttttgaatgttctttttgatatttagtttaatatttttttggtgaaaatactaagatatttcatcttcctatatgttctctagttattattattattttatggccctaacagcatccagtggtcaccttcatgttgatgtgtaatgtgtaacaggccacttgatctttgggacgctgtccgttcaaacctagatgcaagtacgccttgtagtggttaccagagttcttatacaattggg

SEQ ID NO: 36555 - DNA, 3923 bp, Oryza sativa
  unsure (1)..(3923): unsure at all n locations
aagttctcgtctgtgcaatttcttctatagggatgctcagaaatatggtgttcctagatgtacctctttacaaagtgatgagcaacagaagattcactataaccagattcttagtggtagaaatcttcagcagactggaggttctgttccaggagcatttcctcctggggttgatcgtggtgcacgtgtgatgcctggtacccatggtatgggcatggtgtcaggactaaatcgaggtatgcctgctgcaactgtaggctttcctaggcatagttcccctggaaagccaaatgtggtttcacctggaaatgtattagccaacagtgggcaaggagcgccaaacgcagtaaatgtccatcctggagcccgtctgcccctggaaatccaaccttacggccacataatcctatgcaggcgcttcatgtgagttaaccttttatttattatctagttaaatcttggtgctcacacagagtcagacttgagttaactgcatgttttaacttttaagctcttctccattggttatcatctctcctataaagaaaagaatgggagattnttactggtgtctttgcttgtctttccagttgcaccctccaagcaatccatgcattatttgttattgcataagtgatgccagcatacttatgtcttatataaacaaattcatgagtactgctcccacttagttgctttctatattttttattgaaccaatgttgccagcaaacttatgtaaatgagaagttgcctttatcgaaggatatcagaggcttgtgtaggatgctatgcagcttctctagtgatttgctgctcgaattttttgctgtgtcacattttctttgttttctatggacggattttatatgcttagatgtcatttgccagttaactgattacgcaaatttcaatgttccttcaggacagttaactgattggacatccacatgtttgttccttgggaaattagaaaaatatgaaatttatttttatctgaccaatctaaatagttctgtgtaactgaagcttaaaaagtttgactcaacacattctaaagcttagttgctttagactcggagggattacatttacatctgttatttatgtgacttgaattttatgaaggttaaagtacctcactgaatttataaactgttaaaaactagggatagctaatttatatttcctttcctttagcctggtcaaaatatggaagagcataggcagattgtgatgccagagttctgcatgcaggtttcacagggaaatactcaagccatcagcagcatgaatcattcactctccaatgcggcatcttcttcacctgttcagtcttttcctattcagcaacatcaacagaaacatcaaatttcaccgccatcacacatgtttggaaatccgcagcatcctcagatccaagggatgagccattcgaatccacagcagcaaacatatgctatgcgcttggctaaagaaaggaacatccaacaacgtatggtgcctcagcaacagaatgatcttcctggagcaagtgcagtacccagtgtacagaatggttcgcatggtcagcagcagaagcaatcacctgcagccttgtcagccccatcttcacaaccacagcatcagcggcagcaagctgcacaaaatccaccagatagctgtgcacatcccaatcaaccaaccaatgctacacaacataagccaaagaagagtcaacagcagcctagacagaatcagcaacaaaggaatcaaggtagtcaacaggctaagcttatgaagagcttaggacgagggaacatgctgatacctcagactacagttgacaccactccaaccaatgctgtttctgcgtcttccaaaaagcaaattactgagaacaaactgattccaccatggccaaggaactttacccggaaataaagcatcaaatccgtcaatccctcatcctggaaatcaacataaactatacagttctccattgcctcaatcaccaaaacagttgccagatattggtaaccaaggcgtattgcagggttctcctagtcaggccctcttaacttcacaacagcttccactccatcctaaatcttcactgaccacacaacagcaacaacagcatgtccattcatcgcagaatagcatccaaagaatgatatgcaccaaaacctccaaagtaattctgattgtaggccagactcacaggtcgttcaagtccaaaacaatcagatagttccaacaccacctattcctcagagtacagagaaaggcagcgctggactttcatccataagccagcagaagcacgaggtgtcgaatgattcaaatgcagttaattcaacatctatgatgcttagctctcctcaagatacatttgctgggggtgagagactattgccatcatctagccatatgtgctggaaaggcagatgccaggtggtttgcctatgtatggtggccagtggcaccaggagcaatctaagcagcaactgcagtccccaaaccagcagagaccagttgttcaaggcagtgtatatgctccattaaatcctgggcctggctgatgataaattaatctgggttggtcacttttacagagcaacccttttttgaaatctaaagttattgtacaggtatgcacttttaacttccttactttttgacttggtaacggatactgtctttgaattttgttatgtcaatgcagagattaagtaaacttatggaaccatttgcttttccttctgattattctaggacatcaagttgctcgtattcatcattcttgaagtagaggtagggtgatagaattgatattcgagtcgagcagtttaaatgatccatgtctaaaagcagatgggcttttgcagtaatttaaagcttgtgctactatattctttgtagggagtatttttctgatatttttttaccttatctcacttgctaggtgtcagtgactccgtaacatggaagctgcggatgatagtgatgttaattcaacttggagctaatcgtaatcaccttagtgtcaggtagatagttgtttccgtgccattttaagtccacctttagaaggtgaaatatgttttatgcagtctagataactggatggaggtggctgttgcagcggcaaacttcgtttctttttggtggattctgacccaaatcctgggcccggctgtatattttcgatgcgaggtccatgctttctagaatcaggaggataaagtgtaaccctgtaattgcttcaactacaacttggtgaatgcaaaagtgcttatttgcattttgtaatgcgcagtttgtttgtcatttgaaacacctcgctagtgctgttttgcagcatcagtgtggaaggaggcagaggcaaaggtggattgcttcatttgggttttggtttatgtgggatgttatgattaatttgggtttgggtttgaatcatttttgtgggattttgtggtctgcactgcaagttcagctacgccagcgaaagatgtggagtacttgcattttccatatgaattgttgtgatcttgcaacagagaatgacgggcgttccctgtgttgtactagttacccagatgtaggagtatgtgccgatgtgcgtagtgctcggaaacttgcaagattgaacctgatcatcacagtcacagcagaaagaaaggagtactgtattttattgtcctaaccacccaaaggaaagaagtcaaattagtaggatttctcaacaataaagaaaaaaatcaaagtatgatactctttaacttcattcataatagttactacttaattcgtttacactctcgaataattattacaaaatcattaggttatttagctgttcactgttcaaggggaaaaaagccactcaagccattgttgtagtttttcccccattgcttgcattttattccttgtgcttg

SEQ ID NO: 36556 - DNA, 20029 bp, Oryza sativa
  unsure (1)..(20029): unsure at all n locations
ttcctttgcttcttcttcttttctaggtttgtgtgggatgagggcaaatacccaacgatgtcaccgctcaaggagattgtcggcagcatccaatcacaggtctccaagattgaagatgacatgaaggtgatgacctttttcccttgcgaccacataatcactagtcaagacccaacctacatatagtgctgttaatatgtttcgaccctaatgctgtctctagtcattaattaacgacacttggtgtattcttattcttcttgtacataagacataaagttttgccgttcagcgggaattgtttgcttgctttgcaacaagtaggcaagttttgacattatctccataacgtgcaaagttcaagctagtgagctttgttctcctgccaagtgtgtttttacagggtctagcttggtttctgttttggtatgttctgttgttctagccagctatcaacacaaccatattcttgtgattaggcatccacgtctccttttttagcattgagttatcacgcacaacactacagcgtgacctgttgaatttacaacagctgagctgaatgtgttttttaccttcaggttcgaggagcggaatacaataatgtaaggagccagcttagtgcgatcaacagaaagcaaactggaaggtagattgcatgccactgagtttttggctttaagccaattctttcttgttttatttcaaaggactcagaaatgcgagggtatggtttcatcttttgttagtcaactctaattagtttgttttccttctgtatagcttagcagttcgtgatctttccaatctggtaaaaccagaggatatggtcacatcagaacatctagtgacactccttgcagttgttcctaagtactctcaaaaggattggttgtcaagctatgagtcccttgacacatttgtggtaagtatatgctcttttatagtgacatggttagtaatagactgtcatttcaactatttatatgattttcgtcctttcagcaagttgcttattttacttttgtagtttttgttcaatccaacaatgtttagtttgttaccacttgtggcgttaatagttctactagcaggagatgttacccctgtagaaaccacttaaagtaaagatctgtttgacctgtaaattctttactcagattgttttatttagcccttataaggaccttgtttttttttccagcactacatgttgatgtgattagtattcgtaattggttgttatatttgagtgcttttttccttgaactaattattgatttataggtaccgagatcgtctaaaaaactttatgaggacaatgagtatgctctctacacggtaacattgtttgctaaggttgttgacaactttaaggtccgtgcacgtgaaaaaggtttccaggtaaatttgccgtcctaactttttcatcaaaaacctttgtttacacttcacatttagcttttatccctagagccttaggagttccaaataacttgggacagaaattcagtcttgtttttctgtccccatcaatctggcaattctctgtcacccattaacttgtattacgttgaaatacaggttcgcgattttgagtatagttctgaagcacaggaaagtaggaaggaagagctggaaaagctaatgcaagaccaggaagcaatgagggcatcacttctgcaatggtgctatgccagctacagtgaggtgcatgtctttttaggcttatttaataatcctgtcaacaatgacatttctttagagaagaacttttttattcttatgaatgtcatttttgtttcatgtaagttctattaaaattactaccaattaatgtttgatgttcatttcatcattttgcaccagaatagagataaatatgttttcatctcctttagtagcctgacggtcttaattgtccttaaaagcatccaattatgcggaatctgaaccagtaagaagatattgtctggtctcagttgccacttgccagcaatagatagatgccacgctgtgttttatgtttaaattttacataaggattttagtaagttataacttcatggcatactgcaagttcttcctactgctgttattatctcactagaaccttattattcagggataaatccttgtttctgggatgtattaataagcttgtgtttattatccataattgtctattttaatttgtgcagaataccatttatgtacgtcatgctaaagtgcaaaactttgtgcttctctatgtgcgtaaaagaaaataattctgctgttgtttatctctgcttatgcagtgaattgccgtcatgaaggatttgtttactgaactgagttagttagagcctagctctataggctatagacatacttattacatattcactatgtcccaaaaaaaaaaaccaacctagtcaaggatgggatacaacctagtcatgtccagattcgttgtactaggttgtctcatcatgtcctagtcattgacggagggagtagcacatatgtttcttgattgttgggttttgtggtttgctttttctttgattcattcctcgtgaacttgtgttttcatggtgctcagttgtaattgcttacataaaactattctgcaggtattcagttcctggatgcacttctgtgctgtgcgtgtctttgtagagagcattcttagatatggtcttcccccatcattcctggtaatctattctactgttacgtagtatatgatagtcaaatttgtactttgatgcctgatctaatatcatatgctgtttatgttttcatcagtctgctgttctagcaccttctcaaaagggtgaaaagaaagtaaggagcatcctggaggaactctgtggcaatgtccataggtaattcagcgtttgagtttgtgttcattgcattgttagtcacaacatgcacctgcttttgtcattaattgagcctctgaattgcagtatttactggaaatctgaagacgatgttggtgtagctggtctgggaggtgaaaccgaggctcacccctatgtttccttcacaataaattttatctgagcacagtatgttccttgctacctgtggccaggcaaggcagtgttttggagtaattactactttggcaaacaaaaaaccagcgaatggttcggtgtatattataattgtgatacgtcaattctttcttgatttatttacccagcttatatgatcctgtagtttgaaccgatcaataatgtagctttttgggggaacctggactattttcctggcacaatagggtatctgtttggactattttatccccggcaactacaatattccaactgtttcctttagtatatctattgtgctttgagagcaccgtgtaagatgttgtggatattatgtttttgtaactttgagcagccaggttcgtaataaaagatcaatataaataattcaggtcgccgagcctgattgtaaacagtttgttgttgaattcgagctgtctccttttttctttgacgattacgactgttgcactcatatataaatagaaaggtggttgtgttttcacattcagtagggtggtgcaccgtaccccgtacatgataatactgatggtgttgtgacagaaggacaagttgggggttatgtatagaacgtcaatccttggtgacccagttcccactgatgatagtggagtagacaagacacaagaggagatgatggtcaaggtgagaggtgagggtgggtgaaattggatcagcatcaaagtctcatgatgttatcattaacatatgtgagtctgatgaattattgattcactgaagaggatcccaatggaggtgatcgcctcattttgatttgagtaggaccgcgttatgagagcggggtgaggtcggcaaggagaaggatggatcagaatagtcatagatggaaaaaaaaatgcaaggagtaattaagattaataggagtaatgtggatgaagaagaaacagctaggctaggcacataagaagatgattaatgggcaaaatcaatccaatccccctcatcgcgtcgcgtgagaagagaggaggaaatggcatcctcgagattgcattttgtcgtcgatgatccggtccattccggcgccggcgttcacattacacacccaaccaatatcctcaccagtactactattccattctgctactagtatactccttcagtagtgcagtatttttcttgtataaataatactctaggagtgtactaatactcctagagtagtcttgtttcacctacccccgttccgttccttgtatgaatccattgccttgcttctgcttgcccatttgatgatttgatttgatttgattcaatctccaaatcgatcgatttctcctcctccataggagaaggagatacacgtgatgtccaaccggcgtcgcaagcgcggcgaatccaagccccaagccctcgacgccggcgacaccacgcccatcgacaacatattcacttccttagaggacgcccggccaccgccacctccaccgcgccacgagctccccctcctccagctcaacgaccaccaagaggcagatgacgctgacgcctcgtcgtcgtcgtcgccgcaccagcagcggcggctgtgggtgaaggaccggtcgcgcgcgtggtgggagctgtgcagcagcgccgactacccggaggccgacttccgccgcgccttccgcatgtcccgccccaccttccacttcctctgcgacgcgctcgccgccgccgtcgccaaggaggacaccgccctccgcgccgccatccccgtccgccagcgcgtcgccgtctgcgtctggcgcctcgccacgggggagccactccgcgtcgtctccaagcgcttcggcctcggcatctccacctgccacaagctcatcctcgaggtctgcgccgccatccgcaacctcctcatgccgcgcttcctccactggcccgaccaccccacctccaccgcctacaagacgcgcttcgaggccacctcgggtgtcccgggggtggtgggcgccatgtacaccacgcacatccccatcatcgccccaaaggtctccgtcgccgactacttgaaccgccgccacacggagcgcaaccacaagacctcctactccatcaccttccagggcgtcgtcggccccgacggcaccttcaccgacgtctgcatcgggtggccggggtccatgagcgacgagcaggtgctccgcaagtcggcgctgcaccagcgggcgtcggcggcggctgggtcgatgtcgtgggtggtgggcggcgcgagctacccgctgacggagtggatgctggtcccctacgcgcagcgcaacctgacgtggacgcagcacgccttcaacgagaaggtgggcgaggtccggcgcgtggccacggaggcgttcgtccgcctcaaggggcggtgggcgtgcctgcagaagcgcacggaggtgaagctgcaggacctccccgcggtgctcgccgcctgctgcgtcctccacaacatctgcgagaccaggggggaggacatggaccccgacctccgctgcgacctcccccccgacgaggaggaggacgacaccgtgcttgtgcagtcggagtccgccaacaaggtgagggacgacatcgcgcacaacctcctccaccgcggattggccggcaccgccttcttctgatcatttcgatttccgtcccaatctgcactacaaacactgtattgaggtttccctcctcccctcctgtttgttcttgttattgctatagattagtttaggtgctccactcaacaacaacaataacacaagattgaaatgtgatgctttgccctcctcgttaataaatcactggaatacatcgcttcgtttcaaaatttgctttgctttttggactattctttatcctggtactggtaaattacacatacaagctgaatatttactcctataagtaagcacgacctacagtatttgggtaggatactagaattctgcgctttgttctattgtctgacctgaaaattttacccctcgtacaaatctcctctacatgtcaacttatcagccacatccagaattcaaactttgaatttagtggcttttattttcagcattagctttgctttaaatgaataagaataaaagttctaacgacaaattgtttttttaatttgtttcgtttatttttctatagcttatccttcattgcacgaacgattagtgtggccttgaaactttaattgtaggggatgacattgaatccaatcctaggttgagagatgccactgtaggaccatgaggcttgccgaaatttttgttctggatcttttgatatgcttgttggccaaatgtgcattgctcccccaacggtgtgctgtcaatgctaaagtagcaaaacatatacagtagcattacaacagtatacgtgctgagctttagttcctctggtgaccaaccactctgggaatactattgcttaataaatcattctgtagtctgtacctttggttagtgtttttgttacagtggggttgtgtgtcttgacttttgacatttcaaaggaaacatgttacttcttctgtcccataatataaaggattttgacattttgcttacactgtttgactattcgtctcattcaaaactttttttgaaattattattattatttttactttattatccaaattactttagtcacagcttttcgttttttatatttgcacaatttttttgaataaggccatgtttagttgttttggcaaaaaaaaaattttgacgtatacgaaaacacatttaaagtattaaatgtagactaataaaaaaattacagattccgcctgtaaactgtgagacgaatctattaagtcttattaatccgtcattagcaaatatttactgtagcatcatattatcaaatcatagcgtaattaggcttaaaagatttgtctcacattttacatgcgaactgtgcatttagtttttttcgtccacatttaatgctatatgcatgtgtccaaatatttgatgtgacgaaaaagttaaaagtttgaagggagctaaacacagtataagacgagtggtcaaacaatccaagcaaaatgtcaacgtcccagtattatggtacagagggaatagaactagacgatactactagaaactagactagtgaaaaagaaaatggaagtctgtgacatgaatggcaccagtggtctagtggtagaatagtaccctgccacggtacagacccgggttcgattcccggctggtgcattttttcttttctctctcactctctctctctctctctctctctctttttttgccttccttccatctatgtgctgatgttaaatacgttttttttcccggttttacttcagcatgaagcaccaacaaaatggccattacaggtttgcagggactttactgttagcgcaaaatgccgttgttgacttgttgtaaagagcggcttgtcagatgtttttcatttttcacaccgtgctgtaacttggaagcatgacgcggacggactgattattgttacgctgaccaattctagctctagctccgtcagggtcatcaaatgagtggttgctccatccgagaattctgcagcctcatcggttggcatatttcaaatagcatatttataagagataatccaagaaatgtgagttctaagaaatatcatcgacaagtgtaaattctaagaaatatcatcatacaaacgattttgtcctaaaaataccatcgtcattagggttctatccattttgcgccgttaaatacactgttcatcctatagaattttaatatcgtggaatgaatggaaccctaacggcgatggcatttttgggacaaagtcatttgtaagatggcatttcttggaacttatacttgtcgatggtatttctgggatttggatgcttgtcaatagcattttttgaattatctctatttataaataaacattaatttgtgaataaaacttctatacacatgttcttagcgatccaaaagtaaatgctgaaaaataaacttctatgaaaaaaaatcccataatcaagttgaaaattttaatggctgaaaccgcaatgatacaatccgtatattgttatctgagtgagccatcctaaccgtcaacgtgaaactacctctgcctcacactgtcgcacacacaaaaccttagcccacatttaacctgtttcaatcagttttatttaagaaacatgatggttcactggcacttaaagggccaaggcctcatatgttggtccagacccccacattgtcattctcacacaaaaaaaaatatgcttgtgatagtattttatttaaaaatttatccattgtaaacgtgtgtttggattggctttggtgaatgaaatggtatttggtcctcacctcatccccaaaagcatatactaccaaataggagggggaaaaaaggtaaaaatgcagtttctaaacacaccccaaataaaaaggaataatatgaattgacttctcaaaccgagctagaaattaaccgagctggtgtgtttagttcacgctaaaattgaaagtttggttgaaattgaaacgatgtgacggaaaaattggaagattgtgtgtagagaagttttgatgtgataaaaaagttagaattttaaagaaaaaatttagaataaattcggtagaggtgaaaccgagagaaccgagtagttgtacttacacatgagatgagatgagatgagatgagatgggatgggagtgcagtgtacagtaaaatatgtttggtgatgagggggtagagtggtggcagcacaccactggctgagcgcgtcgccacgtgtccacgccatttccaaggcaggcccccatcaacggcccagacgtcagcacgtggtgatgtcaacacccctacccactgtgtcactgacaggccggggcccatcctcctcttcgtcctccacccgccagccagccagcgcctcctcccctctcctccccacgcaacccgatccattcccaaatccctcctctcatcaactcgactctcggtcggcgtcaccggcgtcggaggcggaggcggaggcggcggccgcgtcggcaaggtagtgctgtgctggatcgagtcgagcagctggctgcgcgcgcggtttgtggctctctgtgtgagtccggcgctgctgcttcaattccttcttccccagggcacctcccgtgagccgccatctccctccctcacctacctctggattcgctccagatccgcccatgagtaggcccccacgcccaccgcctgctcgccatcgcgcctccactccaccacaccatgccgatccccaccacctctgacactactccgcccctccccctctctcattcccatggaggacctcgccctgcccgccgctcctcctgcccccacgcttagcttcacgctcttagccgccgccgccgccgtcgccgaggccatggaagaggctctgggcgccgcgctgccgcccctcaccgcccccgtccccgcccccggagacgactccgcctgcgggagcccgtgctccgtcgccagcgactgcagcagcgtcgccagcgccgacttcgagggcttcgccgagctaggcacttcgctcctcgcggggcccgccgtcttgttcgacgacctcaccgccgcctccgtcgccgtcgcggaggctgccgagccgagggctgtgggggccactgcgaggagcgtgttcgccatggactgcgttccgctctgggggctggagtccatttgcggccgccgcccggagatggaggacgactatgccgtggtcccgcgatttttcgaccttcctctgtggatggttgccggcgacgcggcagtcgacggcctcgaccgggcctccttccgccttccagcccatttcttcgccgtctacgatggccacggtggcgttcaggttccctttgcttttgtttttgcctcatcacagtcacagcacattaaacgaatccaacacaccgatgataaccttttctccatgctctcatctgttgcaggttgccaattactgcaggaagaggatccacgccgtactgacagaggagctgcgtagagcggaggacgacgcgtgtggctctgacttatctggccttgagtccaagaagctgtgggagaaggcgttcgtggattgcttcagtcgtgttgacgctgaggtgggaggaaatgctgcgtctggagcaccgcctgttgctccagacaccgtggggtcaactgctgtcgtcgcagtcgtttgctcgtcacatgtcatcgtagccaactgcggtgactcgcgtgctgttctctgccggggcaagcagcccctgcccctgtcactagatcataaagtaagccatggactcccattgattccatgtatgagtaattgactcgagtcctgaggataattggatacgaattgccttgttcttcttcgtgcttcagccaaatagggaagacgagtacgcgaggattgaggcgctgggtggcaaggttatccaatggaatggttatcgagttctcggtgttcttgccatgtcgcgatcaatcggtatgcattctcacccttttgacataattgaaccagtgtttgtttgtgcttcattgtttatgcttctccaactttactgatgtgactgtgctgatgatagctgattgggtaattgatgtgtcaaaggaaaagtctcttgactggttcattttgttattttgttctgaattgtgatgatatatggtgctctagggtttgtgacttttctaagtgaaaaatcactggctgattgttgctccctggtgtaatgacattgtacccccaagtttatttacaaataccttgcatcaatgcgattgtttgcaactggtagtgagtttgtacctatggtggcagagagagctcctcggctaattactttgttagtttgttcctagtcatactgttaagtgatttgcgatgctatgattcaggcatatatttctatatttgttagctatgttgccatatgcgatactggtataggcgtttggtgagtatacatgcagttcacaataggaaaatataagagaatatgagagacttagacattgagatcaccttgatggaaaaatattaagagtaatactaaatggcagaatacttcaaagtagtgatttctgtcataccaaacactaggatgagtcactaactacacgacagctgtataagccattgtttgcattcattgtgatcaaggaacagctgtactatatcgaggattgtaaggactgatgtaataatgtgccattgtgcatcaattgagctttggatgttagcttcacaccttcacccatgttgctgcacagcagtcaatcatatttgttaatttactgttgcagtcagatgaggtttcttcccattgaatcttaagggagaaagcctggcccaatatatatcacaagacttgaataactctttcatcagcatttactctgattcgcttttgctgtattgatgcttcaaactagagagagaatcataacatcatgctattcttctgttgtaccccggtttattagttccagtgttcatgtatcctgtcagtttttgttgctcttaacatgttattctgtgactggtaatttgatttcaatgtctttaatatatggcttttgttgatacttcaaagttcaaagtagataaattatgtttgatttattggtgcgcttgccaatacttctggtctgtgcattgatgtatttgcaggggacaaatacctgaagccatatataatcccggtccctgaggtcacagttgtcgctcgtgcaaaagacgatgattgccttattcttgcaagtgatggcctttgggatgtaatgtcgaacgaagaggtctgtgatgctgctcgcaagaggatattactatggcacaagaagaatgcggccaccgcatcaacgtcatcggcccaaataagcggtgattcttcagatccggctgctcaagcagctgccgactacttgtccaagcttgccctacagaaggggagcaaggacaacatcactgtcgttgtaattgacctcaaggcacataggaagttcaagagcaaagcatgacattgcctccatgaacaataacaatagtttataggaagctagaaatgtgggaaatccaagacaatttatttagctgctgcaccggtacaatttgtttagctgctgttcagtactggtgctgctgcagctgcagctgcttctttgccctcgccatttatttctgccgagggatgtactactagtatactgtatttttctacacggtacagactcccaaatctgattcagggtcgaggacataaggtggatctgggaattttggggtctctcaagacaagacagaaaacataacaaaatctgtagatgtaggtaggagtcctaggacagattgggtttctgcctctggcattaatcgtttttgttaaccggtaaagatactgctacttgcaattgctgtttcatatatactcctatatctttcttgtgccttcccttgtgatcaatacctggtgtttctcccttgttcaagacggtcaatgtacttgccgattttggagtacttgaaatacagagaaaataatgtctgaacctgaacttgtacactggtgagctgaagagaaaccggactctagttaactttagtttgcagaagtgtaggagaccaagaccagtgacgaaactaggatctgagtattaggggagtcaacttatcaaatgattatgataaaaaaatagtagtataaaaatatacgaaaatttaaaggtttttcatagataatatatcatatcaatgtaaagaaaatgataatacttaataggtatatgatacagctacaatgtatatatttatttatttcaatcatgagctgcaattaggagtccaatcacctcaagttagcatgtaagtttttagagagatatcttatacgattgctcatgcatttccaaaaaacgaacttaaaacctgactcaaatacatatctgtatttccaaaaacgaacaaacttaaaaaccgactcatacacggatacacggatgacgtaccaaagtaccggaaaaaacatcttcaatttttataatagtagatattttaaagagtaaattgcagtttgggtcatgtatttttacccttgttgcagcttggacaaggtcttagccatgatttccactttgcaccacataaccttgccatttgtttcactctgcaccacccctcatcttctccgagtcaggcagccttattatctctctcccaacctgttcttgttatgctatcaccgatcaggaggaggtagaagtacgacagttttccaaactccaatcaccctatccaatctggagggaagagtagcaaatcatcacaggttcagcaccggtacaggtgctcaagctgagatgaagtgcatggtgataatgctgaagtcattgctggtgcctgagctcgagcgtgggagcagtactacaacacttcgtcagggactagaataggcaaagtaattggggtcgagtatgcaggttgctttcaccagagagctcaatcccaaccacacatggggaagatgaagactttagtatgctaatgactaaattaaagggtgaatagccaaagtggtccttcaagttttatctgaggctcaatttagtccttgatgtttcaatctatccttattagtccttcaagtttttattttagttcaaacttatccttgaaccaacaactctcttgataaatgacacttatatccccatcattcacatatataaaacaaaaattacatgcttgattttatttatagataatgcatagtaaattatgtaaaacgaaaataaattatgtactatacgatagcaattgcttaagtttcatgtgcacatgttgaaataatgggaagtacatctgcaatgttgtttattcatcttggtttcctcttttctagtatatagtatacaaattaagggcaaaagggatattttctaatagaaatattgactagaaatagccatatggcatattaagtgggcccaaggatgatttcaagccaaaataaatatttagaggagctatgtggacaaaatgaaacgtgaaggaccaaattgagccttcggtaaaacttgagggactaaattagctattcaccctaaattaaactaatcgtatcaccttacctaacatgctagttttagtatcaataaagggaggacatggtagtgctcaagctcacgtacagtggcttcagctcaatgaagaagagaagagaggggagatggaggaaacaccggcccaatctgaaacttgtgtaaaattatttagtccaaagtgaaaatattactttgtccctagtccaatgtgtaactatggtaataaaaggtagtgcaatgtgcgattcactctattttaaattatgatacagaaagatatatggttattagagatttttattttagataacacttttgccggtcaaaatttattaagaaagaaggcatcagtttataaagccacaccaacaaagctgttgctattgttgtgtgcgtgtttttttttgggggggggggatgggggaggcctcccctatccatagtccatgctagtttgctagagctctaaatttgatacaatgtcagaattttagaggtgggaaatatatctttatcctttgtatgtattttgtatagcaaatccacccatcctgttcttaaaacaatcaaaatcaagtagttcttgatttggctccaactctatggataaagatctagagcaagtaagctgtagacaagtcatgattatctaacctgatgcaagtgagattggttatggttgggcctgttcggctgtctatttgcggtggttgcagctgcggctgcgccgtgtgtgtgcggcactgttagtgccggctgcgccacaaccacagcacaggcagccaaacaggtccattattgcgtgatacgaactctaaagtctctaatacactcaaacaaagctttttttaaaaaaaagtgagttaaaaattgatgggtgaagtttatattagtatgattcatattgaaaaaaaaaattataaaaacgaagaggaagcggaggcgtagtaagaaacgtaggggtgaaaacggagcggatattatccgatccgatccgctctgaatctgtccgatgtgaggatatggtaaggatttttagatatctggccggatgcggatgcggtatgaacgatatccgacggatgcggattatccgatattttaatcggattatccgatgtactgtttggcggataatccgcaaatttcagaccacacaacaactttcaggcccacctagctagcccaatagcccaacccggcctaatctaatcctctcctcatcccccagatccgtctctggctctctctgtgtgccgtccctcagttgtcagtcgaggagtcggagagagtagcgcggcggcacggcacgacggcgaccctgcgcggtggccgctccttcccaacacgcgccaggccgatcctcctccccaacacgcgccagccgttcctcctcggctagcgccaccgccggctgcaggaggctgctagcgccgccgctcactgttgtgtgttttgtgctgtacacctgtactactactgctgtattcctgtatgcagtatgctgcgtgtagcactgcataggggtgctctactgctctatgcttgctgttgttgtatgcttgtatggcttgcctcatgccgatgacttttatttttacattttaagctatgcagtaaccggtgaactattgaactgaacacttatattatgtttttgatggatcgtggatatatcttggattattttgactagtgaactattgaaccgaacacttattacttatagttatactattgctattgaactgaacgcaatgaactaatgatgttttgccatcgtattggggcaaattgtattgccgccctcttgatgtatggattgaatacaaacttgacatccgataactttttgtccgtttctgaaccgagttcgcaccgaatccgacgtccgaaataatccgctccgcatccgcatccatacgtcatccgcatccgcttaaaaaatatggtttaggatatagtatagctattattcatccgaatccgttccgttttcaccaataaagaaacgcatcctgttttggttttggttgtattgtggagcagtacagcagtatcccgtttcgtttgggcttttggtgggggttgggtgggtttcccgtctccttccgattgctgagtagcattagcaaaggagcaaaggaaaggaacctcgatctccatctccatctccgcccccaaaccctaacacacacacgccgactctccaaaccctacacccccccaacccccaaccccgccgatccccccgctcgccgccgatgggtcgcaagaagaacgtcgccatcgatgacgatgagtactccttcccgcaggaggacgccgcccccgcccccgccgccgacaaggacaagcccatcaagaagggcggcggcaagaagggcaagaagggcgccaaggccgccctgcccgacgacgacgactacgagccccccgcgcccccgcccccgcccggggacgacgacgacgacgaggagcccatcaacctcgtcttgaccggtaagaagaagaagaagaagggcggcggcggcgccgtgagctccttcagcgccttcgacgccctcgcggccgacgaggaccagggagaagacgacgacgaggcccccgcccctgcccccgcccccgtcgagcccgatgccgccgccaaatcagacgccgaggacgacgacctcgatttcgacttcagcaaagccaagaagaagaaaaagaagaaggacaagggagctcgcccagtccctctggaacacgacgacctcgacctagataagcctgccccgccgcccccagccgccgctgctgatgaggcagacgacgacgaggctgctgcagctgcagcttccaaaaagcctcagaagaagaagaaaaagaagggcggctttactgtggacaatgaggacattgacaagctcctcgccgagatcgacgatacttctcctcccaccgaagaggctgagccggtggaagaggtgcctgcccctgatgcagatgatgccttaggaaagaaatcaaagaagaagaaaaagaagggaggctttaccgtcgatgatgaggacgtagacaagatcctcgcagagtttgaggaccagccacctcctgtcgacgatcctgagcctgagcctgaggcggtgaaagatgtgggtaatgtggccgcctcaaccagtgtggatgatgcggaaggcaagaaatcgaagaagaaaaaaaagaagagtggaaggacagctcaggaagaggaggatttggataagcttctcgctgagcttggtgagggcccaacgccagcagaaaaggagaaggaggttctgccccaggcgccacctgctgcggcaatggtgaaggaagatactgaaaccgcagaggatggtaaggctggggaaggagaggtggaatctgctgcagccaagaagaagaagaagaagaaggaaaaggagaaggagaagaaggcagcagctaaggaggcagatgctaagaaagaagaggaaaaggctgtagaagctcctaaagggaaggttgacatgaagaagctcccgaagcacgtgcgggagatgcaggaggcacttgccaggaggcaggaagctgaggaacggaagaagcgtgaggaggaagaacgattgaggaaagaggaggaggagcgattgaagaaagaggaggaggagaggaaagctgaggaagcaaagaggaggaagaaggagagagaaaaggagaagttgctgaagaagaagcaggagggtaagctcttgactgggaagcagaaggaggaagcaaagaggttagaagcaatgaggagacaattccttgagcagagtgaacttcaagtagccgatggtgctgtccctgagacaaagaagaggcctatatatgattccaagaagaaaaaaggtcaacagaagactctggagactgcaaaggtagttgaagaacaaccacaagaagttaacgaaactatcaatgacgaggaagaatatgtgttagtggatcaggattctcagttgcaagtgaaggaatctgagaaaaccgaacctgatcaggatgtcgaagaattgaaccagaagaggaggaagatgaagatgaatgggatgcaaagagctgggatgatatagatgtcaatttgcctaagacaagtgcctttgaggaggaagaggcaaaccctgtcgccaagaaggttgctgaacctgttcagaagcaggaaaattctaaagcacaatctacagtggctactgtaaaaaaggttgcaaactccaataaaggtgaaacggaagatggcgaatccagtagtgcaaatgctaggaggaatagaggcgcttcaaagaaaggacctattaaagaggatgagactaagaatggcagtgaccttcgttcaccaatttgttgcatccttggtcatgtcgatactggtaagacaaaactgctagactgtattagacggaccaatgtacaagaaggagaagctggaggtattacccaacagattggggctacgtacttcccaactgaaaatattagagagagaacaaaagagcttaaagctgatgccacacttaaggttccaggattgcttgttattgacactcctggtcacgagtcgttcagtaatctgcgttctagaggttcaagtttgtgtgacattgctattttggttgttgacattatgcacggtcttgaacctcaaacaattgaatccctgaatctcttgaagagccgtgatgcagtttttatcgttgccttaaataaggtatattgctttggagtttttttttgccctttgacctcatcttttcttacagtctattaatgtctcaattgttttttggcttaatctctatgaaggttgatcgtctttatggctggaaaaagtgtacaaatgcccctattgggaaggctttgaggcagcaaaatgaagatgttaagagggagttcaatatgaggcttactgatgtgcgtaaatttccatcttgatttttctttaaagaaatgacttagcactagcagttgtatttatacaatcacacatatatgcagattgtgacacaattcaagatgcaaggtgtgaatactgctttgtactacaagaacaaggagatggaagatacatataacatagtgcctaccagtgcaataaggtatgatctacagctgaattaattgattcttcattcaactatgatattattggcatctttgcctcaacacatagttcacttctctcaacagtggtgaaggcattcctgatctgcttcttctgttggtgcaatgggcacaaaagacgatggaagaaagacttactttcgttgatgaagtccaggtacggtgcataaatttacttgtcattataaaagcatgcattcttatctcgtttctgtttcagtgtaccgtgctggaagtcaaggttgttgaaggtcatggtactacagttgatgttgtgttggtcaacggtatactccatgaaggagatcaaatagttgtgtgtgggatgcaggtaagagacgtttttctttataaatgcagtttttcaacaaacacagcttattgaagttgccgcctgctcttgttctatgtttatgtagggacccattgtgacaacagttagagctttgttgacaccacacccaatgagggagcttcgagttaaggtgcgtgcccataatagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36557 - DNA, 1134 bp, Oryza sativa
gcaggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 36558 - DNA, 489 bp, Oryza sativa
ggttgtgataggtaggtaatctgtggtatatgtccctgtgttccccagcaatgcaaaaaggcataaggtatatcctgtgacccccagcaatgcaaagaagagccacgccagccaaccaataaagccagcaagaggcacgcatatacatataggcaaagcaaaacaatgggagaaaaataaatgaaatggtgcgggggctgtaccttggtgcagccatgtgcggccatgacctgcaggagagtgatggtgccgatgaggttgttgtcgtagtaaagcaggggcttctgcacgctctcgccaacagctttcggcccggcaaaatggatgacagcctcaaacctgcagccaagcagaccagcgtccgtccgtctcaaatcttcgccaaaacagataataatacctactactactcttcatttcattcatcatagtattgcttattagtactccagtatactacgcggttgggtacaaaagggatggactgtc

SEQ ID NO: 36559 - DNA, 415 bp, Oryza sativa
ccaaaaaaaaaaaacaaaaaaaaaaaaaaaaaaaaaaacaaaaaaaaaaaaaaaaccaaaaaaaaaaaaaacacaaaaaaaaaaacaaaaaaaaaaaaaaaaaaaaaaaaaaaaaaaaaaaaaaaaaaaaaccaaaaaaaaaaacaaaaaaaaaaaaaaaaaaaaaaaaaaaaaaaaaaaaaaaaaaaaaaaaaaaaaaaacaaaaaaaaaaaaaacaaaaaacaacaaaaaaaaaaaaaaaaaaaaaacaaaaaaaaaaaaaaaaaaaaaaaaaaaaaaaaaaaaaaaaaaaaaaaaaaaacacaaaaaaaaaaaaaaaaaaaaaaaaaaacaaaaaaaaaaaacaaaaaaaaaaaaaaaacaaaaaaaaaacaaaaaaaaaaaaaaaaaaaaaaaaaaaaaaaaaaaaaaaaa

SEQ ID NO: 36560 - DNA, 3672 bp, Oryza sativa
gcggaggagggcggggaggtgggcggtggaggggggcgggggtccccggaagaagaggaggcgggaaggagagctgcgtgcctgtatgtatgtatagcgcgaaccaacaagaggagaagagaagagaggcgaggcgagaggaggggggagaggagagggcggccggccggcctgtgtctcgctcgactcggttcgggtcgggtcggactcacactcaggacattttggcagggctccagctcccagattcaacttatttggagctgaagtccaaccaaacggttcagatctgttcaaatctggagcggagcgcatggaatcgctaactggtgggttggagcggcattttggtcgctccttaactccaactccaaccgcgttatagaattgcccacatattttcgatgaaattacccgcaaatgccatcgccctacccctcatccctctctcccgtaccgcttcaccccgtcttccccaacctccatctcgcgggagcgaggaggcgaagcagcagacggcgcacggtggaggaggaagcagccggcggcaacgacgcaccggctggaaatagccggcgcatgggcttcccctttcagtgtcgctcccctccttcccatcccggcgcacagcggttgagggcgagcatggcggcgcatggcggttaatggggaccacaggggcgcacggtggctgagggcaagcacggtagcacaaggtggatggagacggcgcaagacgaccccaaatggcggcacggtattttctcccaaaccctaaaaatttccctcacctcttcccttcagatttggttgagtagttgttatcatgtaatgagcaaatggggaagtttcagatctgaggacttgtctagtgatgaatggtaaaaatgcaatgagcgattgggatgtgtgaaatttcagagcagtgatgaactatctagtaacttttttttgtttagtgttgtaccttgtgtttacaattatatacacacttggttggaattgagcatatcagcaaatggttatatacacacttggtttagaattctttagtataaaacctggcagtggaaagaatgtccttttatgggaggataattggattgggggcatacccctggctgagcaattgggagaaaaagaatagggaggaagctatgactttcaattctgtgatagatttgaagctatacaatatctttttatatattgtccttaattgattcatggggtgttttgcagacctcgacggaaagacaagtcacaagtgagattttcaaatcaagatttggttagagggcacctctacaaaggattcaagattgaactgccagaagtccctttttttttgccgtcatcactgttgtccttgctttcacttgttagtttttcaaatatgtgataccgagatgtttcgcaaaggttctgttggatgtaaagtagcagcacaaaacttcagtgggttatgagatgtcggtatgactgagagactaaaactattgttggtttttttgcttggagctgacctggactcttgcttgcaagcaaggccttgaacttattcatggatggatgcattttaccttgtatacggagcacggcaacagcggcggggtcggagcacggcaacgacagtggtgtgcaaggtttccagatctgtgtggaaggtatctgcatggcaacgatgggttatagcatttcattttgcaggttagcagctggtgaactgcaatctatcaagatttcacgcctgccttcagttttatctgttagctaatgacagctagtgcacctttgtgttttttctgctctgtgtattctgctggtttgtgaatagattactatgaatctcttggaaagtcattgaaaattgtctggacctttattaaaaattgtttgaacctttatcaaaaattgttgtaaattcggttcatcaatcatgttttccaagtgattatctgtgttgtgattctgcatgtagcagctgcacaaattgtgatttggtttgatatcttgcaagagagaggccaatactttcaggatgggataacacaaagcattcatgatgatctagctggtcatactgcacgatgatagaccatattatatgttattttgtggtcttttgctctatcttttgatgataatgatgctacaagttgttaaacatttatattactaaggaaaaatagcatattaatccttcatgaagtaaacgacaagaattacaagggtagtattgtccatctcctccctatcctctctttcagaaatttaggagctgaccaaatgagccaaacacttttacatcatctctagctcctacaagagctagctccagctggagttagagtttggagttaggatctgagagttggagctctaccaaacaggccctcactcttgtgactctgctcctccgtccaatcggatcgatcgcctctcgtttctgccccccaatacgaccatcagtattgggccgaaacggtattcgcttggatcgaaagagtccactttcggtcctcaccaactatgactcgggttttattaattttctgaaatcgggtacagagtatccctcactatcaaaaccctctacagtttatcctacatggcacgttgacttactctttgtccgacataacatttacgtatcagtgaaaaaatataatgggacccacatgttaacggtaactatactacaaatatttaacctacatatcagtcatattgaggggaaaaatcatctctctccctatctatctccatccaagcgagaggaattatatgcatgggaggtagaggtggatctgactatagtgatggtgggcggagacgctcgtcatcgaggttgatgaggtggtgggccctgcggagatcctggttgataaggccaatagcaatgcaagctacgccaaggatgtctctagcccaattgaaaataagaaaccggtcagaggtccccgacgccacagtgcaagtgacctttttgcattggggtgaggtgatgacgagacggagacacgaccccacagtgcaagcgcgactgctttgcaggctgcgcgtggactcgtgacggcgaaagcacttgttgctctgtgtgggggcgagatgctatgtaggggcacacagaaactcgccatgtaggcattcatctgagctggccacacgaagaaattcgccacacaagcgcaccgtgaaaggactaatgtgctcaacgtagatgaagtggttgatgcagtagggggatgacaatggcgcctaactgctggaagccgtattggcgctataagacaatcaatcttatattgaaactaatttagaaagcatatttttaatagtcttacgatttaatgtgcaccatttctttcgctattaaattaagccttccagaatcggaattctaaaagtataataaaatcttattcgttaaaaccaaatatgtatgatcagagagagggagtaattgagaaagacttgattctcatcagattgaacaacgatttcggggaatttaactatttgccacttttagattgggcaattatccaaatgccccttttaagtttgcactttttttttgcccctctttatgagatgtcatcttaactatttgccgcttttgcccacgtggcatgtcaacatggcaaggaggggagaaaccgatgtggg

SEQ ID NO: 36561 - DNA, 8749 bp, Oryza sativa
gacattaccagcggaggagtaagcttagcgccggcggcgctagcggaggagccagcggcggcggacaggcccctcatggcagcggtgttggcaaaggaggcgtagcggcaccggacaccggacgggcccctcgcagtggcgtcgccggcggaatagtggcgccggaggaggcgtagcggtggcagcgggcgtggcaccggatcggagggagagaaggagagagaggagaggctgactagtgggtcccacactggtttcacccctccattgctatgttgacctgccacgtgggcaaaagtggcaaatagttaagatggcatctcataagaggagaaaaatatgtgcaatcctaaaaggggtatttggataattgcccaatctaaaagtagcaaatagttaaatttcccgatgatttcgtcacatcatgtagttgtatattcacatgctgacatgcgttctattgatctgcccaacgatgagaaataaaaaaggaagggggagaaacttgatggacgatcagtatctgaatattcggtaaagccatgagctagtattcctaaatcaggaggaatgtctgagagagaatccatccaggttttgacatgacatgtattttcttttcttttcttctactaccacaaagaacagacaaacctggaatatcatttgcacgtgcagggcaagtcagacacacgttctatttccttctttttctttatagagcagagcagaacagaccatatgcgttcgtagtatcatttgcaagcatcagtcgagtcctattgccggctggcaactgttactgctctcacaaggaccaggccacaacagttattaaaccttcacttgtacattgacattcatccatgaagattattagcaacagaatcagtttaaaatccacccaagctatgctctactttctgctacgaacagaggaacatcatcaccagtaactaacatactcacgtctgtgacaaacagcatacataacccttcttctcatagcagttttccttgtccataagttacaagaggctggacacctctccctaatattcaaactttaaaaaagcatcccccaacttcccccaccggtcatccaattccagtttccaaagaagcacatggcatgagagccctgcatgcagaaatctctccaaatacaacaagattcaaggggcacatgtccgcgcaatgaaaacaaatgggaacctgtacaaacagcctaagcattgccatgagtccaccaaacagttgctaagggccaaagccccttagaaccaaccaaacctcttattttccggtctttagtactccacttcagcaggcgtgacccatggagtaggggctctgatgatatgcacaccgccaagattgagacatactagtactgaatcctatcatcgccatcgaaatttaggccctggatgccccgtatggtcgactcgtagttcttagcattcgatggatgcctgccagaaggcgtgcgcctgttgtcagaggagtcaaccatctgtggactccaccgcggggcccctgatctttggaatgcccccggacttgcatctgttgtacgactacgtgactggtcagcttcagtgcttggttctcggctactagagacagcaggtcgccttgaggatccgcttgaccgtcccaaaaaagtcgaactggagaactacacgccacttaaaggtcagatattacatagcaattgtgtataaagtagcacttcaggggcacacttttttgtcatggcactagcaacacaggcatcatgagaactctaagaactcaccactgcatctttagaagttgattgctcatgtccgataggggacttctgcttggctaggctgcctgcatttatagctggaggtggaacctgacgccgcatcgcatccatatctgaccagccgcttctccttccctcttcggtggctacatcatatcagtagacagttaaccaccaaacaactagcaagctttgttaattggcaagactctacatgaatcaagcagtctcaagggttgaccaaacagtagaatattagaatggacgccatctatattttatttgattaaaatataatgatctctacaaatgcaattccttctaacggtttgacccaaccaaaggctccattcctactttactgtcttactaacagatttggtaatgatcgacccgtttgtaactcactaacactaacattacccctttttccatatcttatttggggtggtaggtgatagtaacatcattttattgaatatttccatgattatgagttgatagaaactgaaaaacacctgctgtttatctaggtgaaaataacttaggagctgcagtacaattacaatccactaaagaatagatttatacctgacagcctgttattatttgctataggagccatcgccgagctttgtcctgttgcaggggcctaaaataagatacatcagcaaaagaagagtttgaacataaacccccaacgtgcacacacagtgaggaaaagaggagtggtagttgttttcaactgacaatggcacgtggtggagcactggtcatctgtgactgttgatacttcaggattgtccagtcaaaaacataatcaaactgaaatcctacatgtagaaaaaaaaatcccatcaggtgctttcaaaaggtagcattttgcagtatatacaagtcataaacactgtttagtcactgaaataaatatcgagcatgtttaaagaaaatcaaaacaataaaccaaccctctcgaataaaaaggtctctgaacaatctcttcaaatattggtagtctggcgaatcttcaaagcgcagcgagcggcaataatggaagtaagatgcaaattcagtaggatatccacgacagagggcctatagttgagaaatcacaataagaaatagttcaggaaaggtggtggatgcaatttatagaataatatttacctcagttgaagtagcaattttcctttcgctgattttctcatatttttgtttcttgttcccagcttttagaccctgccacggaaggctggcagcaataaactataagttaatacagaggacgcagttgacgcagagatacaaaagaagaaattacttgaggttatgttgaacaaccttcctctcaagaagtacatcagtacatatccaagagattccatgtcatccctccggctttgttctatggagaagcataaaaccgtattatgatgctaggaagacatacaaaaaggtcatataagcttactaggaacaaataacatcaatgtcaatcttgacactgctactggataaaggaatacatatacagtaatcagataacttaccaattccaagatgagtgtttacacttgcatatcttgctgttcccgtcaagttcttgttctccctatgattaaaagaaaaattggtgtgtttaatttggaagtaatatacagcaactgccatttcaactttcaagtagattaaaggtatccttacctatatgggatgtgctggtgtgttgatgtatccctgtacttctttgcaagtccaaaatctatgacatagacctacacagagaatgaaagcaagggttaagtacacctataattaattcatgaatacgaacagatcaattgaacataactatacctgatttgcccttttacctaggcccatgagaaaattatctggcttaatatctctatgcaagaaagacttggagtgaacaaattcgacgcgattgatctgagagatagaagatggttttggcaaaacaaatgaactgaaatcagttgagaaatgctagctttgggtaaaacaaaaactagaaaataaccaaatgaatagcaaatgggtttaaattgactgctaatagtaccatttgatcagcaagcatcaaaacagtttttagagacagcttcctgttacaaaaactgaaaagatcttcaaggcttggtcctagtaagtccattaccaaaacattgtaatcaccctcgacaccaaaccacttaacatttggaattccagctgcagaacaaaagggtcattagttgatgtgtcagtttaaggaaaacccactggataaagtaacaagcaagcatcaagcatgcattacttcctccctggagtattctgtacagcttcgactcatacagcagttgtggatgcttggtcttcacattttcctagacaaaacattggagattaacaagggtgttatctattaagacaggaagaggactggtggaaacagcagaaacaataaattattctcacaaaatacgcgcagcattacgtcagatcaagtccatgcttgcgatggacgtcaaacaaatttaatcctaatcaaccgcaactggacaagaggcatttgtcagggtataacagtagtatacccagtggtacatctatatagctcttgaaaaaaaaatcatgttttggcagagaactattaacagaacaaaaacttaagtagtaaaagttatgtttcaatagttttcctagcaacagaacacattaaaaactttaacacatactccagacaaccttttatattagaggtgccatatactatcaccaattcaactgcattaaaatatattgttaacaacaaactacattcgcatagcaaccagttgacagatttccaactcagaattcctccaatcaagtatagaacatgtcctctgcatctgagatccccacatctgaagcaatcgaatcataaatcgagtaacacaaagcaatactaggaaactcacgagcttaatagcgacctcctcgttggtctgaacattggtacctgcgagaacacacgcaaagaaaacaaaatagaagtcaccagaggctgatgggtaaagatgagaacttttgaatcaaaacgaggactttgggtagaattgcgcacgaaccaaggtagatctccccgaaggagccactccccagcttgcggccaacacggaacttgttgccgatgcgtggctccatcactgtgtgcaccaagctccccgggacaatcccttaatcacaaggagtgggccctgccagacaaggatcgaaccaattcgatcagctgctccaggggaatttggagctaggacgcataacatagcggtgaggtaaatggggatttatttcttgctctctctcctcatccatttacgtgctgctgcaggtgttgagcacgacacacacaggtgttgttggtctcagaatagaaaaatattaagaaatcgatgcatcaacggaattgggcacggcggcgcggtcggaatggttttccctctctacctgatttttccttctccaagtgatctggatctcctccatcttccctacacagtttcgatcggatccaacttgtttggggctacaaacaaactgttactacttgcttgtattaagagaggttaaggctctggaattaaggaggagaagagcttcatccagatctactccaagagaagctagggttaacgcaagcaaattccagctcccggtgggagagagatgaatcagaaagaggatgggaggtgctcaccaggtccaggataccctgctctgctctgctctgctcgcgcagatggagatcggcagccgcgactcgtcttggcgcaaggagcggagcggaggagacgacgagacgcccccgggagatttctctttcttttacgccgcgagggaatgaagggtactccacttctttttttttttccccttttactttaaaactgcatttgagatggacaacttctcttctatgctaatatttcgaaattttcatcccaaagatatttcggacattaggacaaatttataagtcctaaccaaaactaattagacaccgatggtatattatcgaagttaagcaaaatacgatgacatattgtagaacttaacaaactcaatgacatatatagaacgggaacaaagccagtgacctacatctttttcacttgataattgatatacactttattataaattctataaataaattattggatgattttaaatatttgaaaaatcagggtgtggcactcctcaaccaatggagacgcacaaagtcgctggtttgctccccaatcgaggctgatccgttgccaccatgggagagaggttgccattgtcgaggaagcgattcctcagacggtagggaatggagacccccccccccccccgagtgtgaagatccgaccagggggtttgattgtgagaggcacgaacgaactgcaaatcagaaaggattcgcggggtccgaccaccccgcgcagcaagagacacacaagaatttatacaggttcaggccactcggaggtgtaatactctactcctatgttggtttttattgtcttccctagatcagtgaagtacaaagaagcctttttaggctacaagcgagaatattgatataaagagtccaccccccattccgtatatggtccccttccttttatagttcaagaaggggctcacattattacaaatctcctcttagtcttgtcttatcagccgtcttgtccttgctggctggttcccagacacaatcttcaagaaacccattgagatttgtgtcatgtaatgccccgagctctgtctgagatagttgggttgcgccagtgtgcccaccacgtggtgagtagtgggcctggtgagacccgagctgctcgaaacagtgccacggttgcttttctgcccatctggctaaattaggtggcgcgggacatgcacaatgcgtgtccaaggcagcatcggccctcaatgactcaacattggtgtcttgtccatgtcttttcgactccaaactggctagagatcccccataaacatgtttcatttatggcggggcacaccacatcacagttggctgtggagtgcgcctaacttcctagtaggttatgaggtcgcgtcctctcgcatttaaagtagtttagttattttagtcgagcttctcggagatgtcgttgatgaatggatatttcaagatattgtatcttgtatatttcgatgctcctcgagacaaaggtacctgaaccctacaaggaccgaggtgagcccgggtcccaggataaggccggggccgaggcagacctcggttcataatcttgttggtatagcttcttatgtctccatcctccacaccttgcgaagagagtgacttatgaagactaaggtgagcccggggcccagaacaaggccgggctcgaggcataccttagttcaatctcttaagatgtagatcttatagatctctacgatcttcccgctaaaggacgtaggacttataagaactggggtgagccaggggcccagaataaggctgggccgaaggcagacctcagcttacatccttaagatatgtgttttgtacgtctcaacactcctcttttctgagtagtgtgtgacttctgcaaactaaggtgagcccggggcctagaagaaggtcgagcccaagacagacctcagctttacatccttaagatatgtgttttgtccgtcttgacactcctcttttctgagtagtgtgcgacttgtgcagactaaggtgagcccggggcctagaagaaggccgggcccgaggcagaccttggctcaatcttcttaagatatatatcttgtagggatctacgctcctcttgctgagaaccgtagagcctacaaggactaaagtgagcccgggactcaggacaagaccgtgtccgaggcagaccttaggctatattcttaagatgtatttgggtatgtttggcaccgaagccaggtcccaagatgcccttatattcaaagctttgagtcattgtacatctcatatattgcattcctccttagccaggcagagttccatatatgagaacacatgtgggcccgggactcaccagagtgggccctagctacgccaccctagggttgcctttttatttttaaagatactctaagcatgatatttatctgataatgatcattttgccaggtaaatgggtacctcgattcccatttcaccgacagccatcgccgttagcaagaggttgccattgtcgccagcgggagagggtgaggaggaaaccaccctagctcgtcctcgtcaagttccagttgactgctccccggctcgagggagaggataaggttggtgaaaaagaagatatgggctgagggtattttcgtccatacaaaaatatggtatgcagaaaacaactagcgtaagaacgtcctagacgcatatatagtaacacgattcgaattttacaaaataccagtgacattgagtcacaccgagttttcattataacatattcttaacggcatggatttaattaattgaaccaccatcttacaacatattccaggaagaaatatatattatctgcaatgggtcatccatcgttgtactttttttttcaattaagggtaaactcgatgtgagtgatcgatatatggttatagatcgatcacaaccggtatgcgctaggtgataaattttccatggcttccccggcccactctctggctctttgtcccctggatggagtagctgatggagatagataaataaataaagtagtcttaattaaaatgaagaagtttgtttgtaattaagcgatgggatacaattaataggacatatatgtacccctaatctgtatgctcaccgtgcaggacgcttatcatgtgcagattactggtggcaacgctggaataataatctgtatttagccggccgttgacagtggcagctaggcagta

SEQ ID NO: 36562 - DNA, 1720 bp, Oryza sativa
gtcgcgctgattcacagacacagtgtaggagtggcagcctttggcgccagcaacagctaatttgtggtcgttcgccgtcgcaggtgatgtatccatgtagtagaggtccaggctctgcggtgcgagcgccatgtcgccgtactgcatgacgtgggagccgagcgtgtaggtgccctcgtcggacgtccggttcttcaccgtcctgtactgctgccgcagcgtctcggcgaggcgcccctcctggtgcgcctccgcgtcctccatccacgccacgctgtagaggtccccgaggcaggtgtcgaactccgccgccggggcgtcgtggtcgtcgccggggcagtaggtgccccagctgctctcctccgcgttggaggccgtggtggcgtacacggagatgtcggaaggcaggaggccctcgaagatgctgccggactcgcacgcctccacgtacacgaccaggctcttgtacccgccgccggcgtgcttcttcttgagcgccttgaccaggtcgtcggcgtacaggtactcgccgtcggctggcatgctcaggacgccggggccgccgtggtcggcgtagtagacgaagacgtggtcgttggggccgctggcgacgaccttgccgctgccggagccggtgagggcggagcggttgccgaggaggacggcgaggaagttgttgacgttgacgtcgtcgccggtgtaatccttggggacgccggcgtagacgtcggggccggaagggtggttgaacatgagcccaggcctggggttgtcggggttgtgggcgatgtcgtcgtacatcatcaccacgatgttttgctcctccacgcctcccttcctcatgatctggtacgcgtggcacacgtccgcctggtgccggtagttatagaacccattcgaccccgcgatcagcaccgcccacctcgtcgtctcatccgacgacggcagccggaggaactcctcctgccaccgccaccgcccaccgccggcgacgacgaggccgacgagctgcagcagcagcaggcagaggagaccgcgccccatgattgacaagttgtgcttgatgatcgatcctgcaatcaagatgcttgttatatcgacattctccgatcctcctcgttccgtgcgtgacgtacgtgctacagcatactcctgataatagtataaaacaaaatcctactactacaagagggacagattgattactccatcagctcagctggcaccaaagctaagaatcctagcattcctactactattaacaactatttcctggggccgttgatttgattaaataaaactagaaaaagatactcctctagtacaacttattgttgcgttgcgtggtgtaggtgcgtgggtcgcctggcgtgtaatcttgagtgacagtgccatcctatatacggcttggcttattagtgtgcctgcctgcctatcatgcttagacgcaacagggatcgacttgcaaactaaactagccagtggcttatgcagcaccagagactcgccatctaatttggaactcgatcgacccggaattaataaacaagtcgtcatctcctacgctacgctctctgcatgcttcctatcatatatacggctgcatatatacgggatttgaaggattttgcatcacgtaagtcgctcaagccctgctgcacgtaactattgtaatttcaagagtaaatttcacaaaactacatgttttatggtccaagtt

SEQ ID NO: 36563 - DNA, 26830 bp, Oryza sativa
gtggttttgtgaaactacaacaccaaaatatatgtacttaaacgccaagtgtcaaagtgtgggtggttttctgcaacttggactataaaatgtgtaattttgtgaaatttactctaatttctaagcccgtttggtacggctacaactccctaatttaactctagaagttagatctcaagtaaagttagggagctgcttaagcccagtttccaactctctaattttagtcctcagatcgatatcgatcttctctcgcttatctggtgacattagctgctttgctctccagtaaaaaatagccacaaggcattctctccattaattagcatagcagccagtgctctccctccatttacagtttttaaatttcttctacaagaatacgggctcaaacacgcgtaaacatcaccagcagatcacaaactcaagtctccaggcggcagatgcagcactgaagcagcaacatcaacacctgctcaaattatggcagcagggaagggccattgaccacacgcacaaaccagacaagattgatgatatccccttcctagatttcactgttagttagattccaaaaaaaaaaaaaacccaacctagaatgggatgggacatgttctaggacaacgtatttggactgtctagatacgttgtactagaatatgtccaatcacatcctagattaggttttttttttttggacggagagagtagatcatgcttcacaaaaatccaaggtgggccatccaacactccatccaacctaccctagccccaatccccaattgtgaatcacaatcattactgtcatcatgccagtatcaacatcttctggaaaatttatataacgcagcagctaccggaactgaagtaccctgcctagacatccttcaccaaatgcaaagctacggctgccccaccttgtagcctacggtacatccggagcataacctcatccccatttatcctcgtttcatttgaaagctcaacgtacgcttcattgatcctactgaaaacaactcgaagcgggatgcatgcaatgcccagagatttaacctattactgacttcttgtttccggcacctctgtgatttatgtcgaaagatgaaaggctccgcatctttcttgaggaaggcacatgatttttttgtgtgcggtcgccatgatttctctgtttcgagttcggacatcttcctgtggcttttgggctctgttccacctgtgtgtgattccagacatcccaggcttgaagcttaatccttcttcactggtccatcaacagtgcttgtggcagggcggtgatcacttacacctgatgtaggaagaaaacatacaccatccgagactggataacccacaacgggtcttcggttccatatactcattagggaaacaagaggaccagttggcttgtttaatgaactcttgcccaccttttcttccaaaaggataaccttattgattgatatccaaccctgtctttgtgatatctaggctccaatgcatttcgttccatgttgttggccccatgatcagcggagctcatgatttgcttagtaaaatttccgcgttcgcatcgggaagatatgctagctttgctgcagttggtaggtcgccttttgcgtttgcagataggatcctttttttttaaaaaaaaaaaaactaaaatcgacaagagaattgtcgggttggcactgccataaccaaattattttttgaaaaaacactatgatgtagtatgcaatcaaaggacataaaaacagaatcctctcagaaaatagaatataacaatgatcacggtttgtcttgatcttgtaatcgtcaagaaatcgaatcaggggaagagaaaaggactagatgaagagaaacagtgtgtggggggggggggagaagaacaactaaatagattaggtcatggaattgattgttctgaatttgatagatcttcatgaattatggatcacatttggatagtattttgaaaaatctgatcaaaatctgccaaaattcttccataagaattgggtgttttctttaaaaaaatatatatggtgaagtgatcactagaataggcacacccagtataatttttctgggtccgccactgccgagagaaagaaaagattacggcggtttgaaagcaaactctctatcgttgatgtcctctaggatgacagctacattgtgggcaatatttgggagttctcctttaaagacttttgcatttctcatgaaccaaatatgccaccatgtcgttattaaagctccaatatttattcttgcttgcaccctatttccagaggaggaaatatttagaatctagtcttatatgttatcctacatatgatggtttgggattccttttatcgttgagattgattgccagatctgatttgtgagatcacatcctctgaatagatgatcagagtcttcaaaagcgcccctgcaaagtggacaaatccaatcacaaggccaatgcctaattagtaaattctctactgttaaggtcttctggtgaaggattagtcagcccaggaatctttgcttagattgagcttctgctgtccatatcatcttgaaggctgggtttgtctctgatccaatgaattgggcttggtaagaactctttgctttgtagatacctgcagcatttcttgtccacacaatattatcttccccagtttcaatgagagtgatttgtgtgagtaaacttccaagttgtactagctcatgaagagtttcaacatctgttatctgtctaaaggatgacagccaggtgttgtcgttaagctctgttttgactcttctatttttcctgattgccatgttgaataggttgggtgaaatatcttggagcatagaccatggagccagttatctttccaaaacatagttttctgtccatttccaagagtgatctttgtgcaagcttgaaaaagttgatgatctgaatcattacatgggagatacatcagttcccatggtttcgaagagtctttccatttcagccagagccacctttattaccaaggcagaaggttcacactctttcaaatgatctgggggaaattcaggtgataagcaggagtcaatcaaaaatataggaagataagctctttttccttgccgaagcgttaccgtgatatatatattcattttttgctgctcgtcatatcgctgctatgcatatggttagttgcgtgttcttcagttaggttcctctgctgtttggtgttgataaatgtacggttatatatacttgaatgatcccgataataactcgttcttgctggtgatggtaaatatatatacataaaatctgtttgtgtatcagtatcagcagccaaagcaaacattgatgaatcatttgaacaaaagccatattatttttcctcgcctatattatgtaacttgttcttacagccataggagcgtactatgcgtaagaaacagcaataagcttctgttccgtcctctattagctactccatatagcagtaagtaagttgtaagtagtactccagttactagtactataaatttaacaagggcgatggatggatggtgtgttacagtagtataattgagatggaagaggtaggatggatggtcaggcgaagagcttctcggcgaagatgtcaagaagggatagggcctcggcgacggtgagctcgaggcggaacttggggccgtcgtagtggtgcagcacgggcctgaaggcgtcctcctccagcggctcacagatcttgcgcgtggccacccgaacctgcgctgggaacctggactcgccgccggggcacttgctgtcctcccaagcgccgggatcgatgttggatccgccgaagctggtggcctcgaagatgccgtgaagctggtgggtggagtagttgtagaggaagagcgggaggccgggcctgatggccctcaccgagtccctgtacctggatggcaggccgaacagctgcctcttgagattctcctccatcgtctcgttgttgcacacgaatatgtatcccccgatcgcctcctcctttggcaccgactccgacgccggcagctggctcttcttcaacctgctgctcatcttgttgtcgttgctgctgctgttcttcttgttgttgttcctgcctcctcctcctcctccagcaggagcgtcgacagcggccttcttcttcccgttgaacgcatctacgacgacgctgttgctgttgtagttgaagttgaagttgttgttggccggcctgccgacggacttgttgaagtaggtcttggcggtggcgttgttgttgctgttgttggcgagggcgagcttgttgctgctatgatcgacggcggcaggcgagggggaggaccagatggagtcggcgatggagaggctggagaagttgtggaggcggagctggtcgctgaactgccagaactcacgctcgtcgtacccctccatcttctgaattaacagaaagatcgggtctgctgccaccgccgatgggagatgatcgattgatcggaggaggaagaagcagcaacaccaatttactcaattaacagaaagagagaggaaattaaggtggagaggagggagttaatttggcggtgcacgcgggtggatggcacttcctagatatgcttgggttggatggggagatggaatcaaagtgaacacttgctttgcagctaagcaactaggcggacgactgaggactaattatatgaatcggacgcgtagaaacaaagaaataaatggacgaaaagaaattatggttggacgtgcaatcagtcaataatctgatttttaaatttcattgcatccatagacacgatgacacgtacacatagagtggtgaagcaaagtctgcctttttgaacgcgtcaacggcccggacttcttcttctagatggacctgctactatacattcatccatccaccacctgaccgcctaaaatttccttttaccaaacaccgtagagacatcttcaaagatgttactttgcccaataatatctactccctatgtccggatttctagtttttcttacaacgtttgaccattcgtcttatttaatttttttttgcaaatataaaaaacaaaaagttgtgcttaaaatactgtagataataaagtaagttacaaataaaatacttaataattttaaatttttttaataagatgagtggtcaaacgttgcaagcaaaaactcaaaatcctttatattatagcatggagggagtataaaactaagatgttttaaataaaaaaagttgcatattatgatagtatgtttaatgataaatctagtaacttcaattttacacgattgattctttttttttctattagtggttaaaattaaaaatgtttgacttgttactgtactaaaagtgcttatattttgggacagaggaaatacatttttttcacctgttttacgtataggaatatacatgtttcgaaagtacacaagtggggatggaaacttgcaccgaatctgcacagtgagtgtgcgaactaatgatatcgcgcaggccaatagcagagtcggacccgcctcgagttcgtgcagaacggcaccaagtcgcggcttcgcgcaaagaaaatgtgactcgtttcattagctagttaggaattaggattccacaggaagtcgtcgcgacttcttgatgttccggtgagtatactcgaggatggggtccgagttcgcgcacccactatgcgagctcgttgtgagttcgtgtataattctaccaattctttcgaaacatgtataaacctcgaaaactggttaaaatagtttttttaaagtcatctttaactttatcccaaaagactatatttttacttgccacgaattaagaaaatttatctctttaaaattcaaaatatacctcttacatgccgcttcagaatactacttaaggataccttttgatcgaaatgaaggatatttaatttgatttttatcctcatcactattttattaactttgttaaagaaaatgcgaaaataatacaatctttgtgcggcgagagagatcgagtaaatattgtactatgcagattactagtttttgtttataatatgtatgctatgaataactacagtatcagcatgatatgaaagtatttttaagtatacgactctaatgtatggcatgcatgacactaagtatatatattagtactagtttcgaggcgcctacaaatcggacgtccgatttttttagcaaaaatcggctgctgttttaccacatagattagaattgtttcactaaatatatcgaaaatgtttcaatattaaaaaaactgaaacacaaccaaatcatgaataaaacattttgctacaacgtatgaaaacaatgattttcaaaaaatcaggcgttgtttcaccctatataaaaacaatgctttagcaaatagcaaaagaatgtttcaattcactgcactatttgattcatatataatgaaacatcatgagtacacttattgaaatattgttggtggaaaaaaaagaaacatattcccttaatagaacattttcgtaatatacggatgatttgttgcaacggcgcatgtggtgggatagcgcggaggcgcgggagacgacgggcgcctgatttttctactgctgatggggcgctcgatcgtggtcattttcctactagtttaattacatgtgtgcgaagagatgaacaaatatatactggattggagtttctagtagtaggctactagctaatactacctccgttttttaacagatgacgccgttgattttttctgacatgtttgaccattcgtcttatttaaaaattttatgcaaatgtataagatataaatcacacttaaagtactatgagtgataaaagaactcataacaaaataaattataattacgtaaattttttgaataagacgaatggtcaaatatgtgagaaaaagtcaatggcgttatctattaaaaaatagagggagtatatataagatggtggtaacatacatacatacatagaagaaattaaagtggtgtgcatgcttttggttaattagtggcgtaatgagtggtgtgcgtacgtcgagcaagcgcgatgatggcgactcatcacctatctttgaatcttgctgaccgtgacgccgtaccgcgtttaacatttcctccctcaatttaattttcttcggtcagtatcaaagttatgtcatactatatatctttattttaaaatgtaataatcttaagatggatgtatattctagtagttcgataaacctaaacaaactcctttgaaaaagataaatataaacaaaccattccaaaacgacctaaactaaagcaacccattaaaacccaattgtgattccctatttgaatgaccaaaccagccaattgcagggacggatggttgggtcgtggtatcatcctctatcgtccgtcagtctaaacaaactggatccatgcatcgatctccgcccagtccggcttcgatcggctgcctcctcaagcaagcagatcgtctcgtctccgccgcctgtgctagctacggtactcgatcctcttctcttgtgcaagcagtagtacagtagtgtacaggagtactccgtagctagcacgtactgtacggactccatatatatgttaggcgcatgtacgtacgtttctgcttctgcggtctgcctgttagtaatttgctacacaatcacatccagatggtgaacaccgtccgtccctcctacacacacacacacacgcacacgtatatatatgatcagtcggccggcgatcgaccacactatcaaatgccaaattactactctactctactgtctagtagtgcttcctacatactgtagtagaaagtacataacataacatatacctgcagaacgccgtcttataacgaaaaagcacacgctgatgacagcgtagcacaggacaagaatcaatcccttcagataatgtgattctccctcctgaaacatatatatacttctaataaaataccgacaatcttaagagttttactgtactactgtatttcactttgattctgaacaagatcgaaccaataatttcagcttttactagctagtacttacctggagggtgaaggctgtcactaatattgctagaaacagagagccagtctccagcaggttgaaatcaagatccattgggattcccatagtccaggctacaatcacactcactggaacctgccgcacagttcatcacttccatcacaacaacatactaacacgcatgtctacatacatactccactaataactattccctccattccaaaatataagacacaaccacccttaacccaaagaccaagaaatagttattatcaccttgtagtttggatcatcctaataaatgtaatgcatgtatccaatagagttagagaatgtgagagtgaaggattttaaaaaaaatagtaatttaatggagaattgtcatagttaatggcatgcatgtgtatgtatgtcttacattatggaacatgtaaaaaaaagtggttgtgtcttatattatggaatggagagagtatcaatgtatagagcgaggttagtaaattactagtactacgtactagctactcctacataccacaaacatggagatctgtgtggcagagcccaaagacactccgagagtaatatcctgtcgtcacaagtcacaacaaattaatgataagaaagaccaatactctgctgcatatatatatatatatactgtatgtgtgtgctgcttaattatatggagtaccatcttgttcttgagagcaaatatgacggcaccggcatgctctgctgcgttcccaacgatgggaagcaagatgatgctaatgaagctcactgatagttcccatgattctgaggccgcctgtacattcacaagatacgtacaaaaggtggtttagctagcttcattatgcatgcatcttgccaattcactgaagattaatacagtacagtacagcagcatatatgtaaatggtactaggatgatatatatatatactgtacctcaattgtgctcacaacataccctgacaagagcgcagtcaggagagtcatgagagccagccaaatcatggcactcgagaatcccagtactggctcatcatcttgagcgatcactaaatcatcgtcgtcatcatcctcaacctaattagaaaaatataataattaccatttggtgttggtgggatcgaacgtagtacaggacatgcatcgatcaatcacagacgggacgtacctgttggggctcaaacagctggcgatgcgtgttgagttggaagaagaggtaggccaggtaggcgatgagcatgaggatgctgcaggcacgcgacaggtggagggcggcgtcgccggagacgatggcgtggtcgccggaggtgacggcgtacctgagcatgagcggcagggagtggcagaggacggcgagcatgaggagggcggtgttgacgtgagcttgcttggtgtcgtacggctggtgggcgcggaggttggcgatgccggcgaggaagagggaggtgccgaggacaagcagcaggttggagaggatggatcccagcagggagcatttcaccacctcaatctttccttctcgcagcgccaacagcgcgattatcacctccgtcacgttcccaaatgtcgcgttcagtagtcctcccactgcaaccatgcatgcacttcacttgatgcatttccacttgatcctgatcgaaacgaatagctagcatgcatggaattcacttaccagtaggaccggtgtaaaatgcaatctgcctgcatgcatacacgcaaccaattaattgtcacaaaattcaagatcactattataattactctcccccatttatacttataagtcactttgacttttctaaaagttcgatcaagtttataaaaaaatatattaatatttacagcattaaattaattttattaaaactaacattcaatatattttatattttttcttgttttatgttaaaaatattattataaagttaattaaaactaaagaagattaatttagaaaaaaatcagaacgacttatgatcagaagagtatatggttgcatgcatgcatgatgtacattatctgagcatggtaggaattagttaagggagcttactcggtgaggaagctgagtcgctcagcaagaggaacgaggccgattaagctaagcacaaacacccacacctgcaattaatactgtaagaaagctggttgatcatttagttttttttttgaatggttgattatttagtttgtacttaggttgtgtttagatctagaggtgaaaagttttggcgtatcggatatacgaacacatatttgaagtattaaacgtagactaataacaaaacaacaaatgacagattccgcatgtaaactgtgagataaatttattagcctaattaatctatcattagtaaatgtttactgtagcatcacattgtcaaatcatgaaataattaggcttaaaagatttgtctcgtaatttacacacaatctgtgtaattagttattttttttatattaatacttcatgtatatgtccaaacatttgatgtgacagggtgaaaaatttcacagggatctaaacaggcctttagcttagggatgttacagtagtttttggttagtacagtactagtggagtgtatctaggacgcaccgttgccatatggctgagatgcgacgacgaaaaatccgtgaccgtgaggagggggattaatattagcctggccatgcatgtgatgggtgtgtcaagtgtcaacttgcttaattgttgcaattccatgattccatctgtttgtattttaatagggtttcacaggctgcaggcaacttcaccacatgcgcgagcacatgcactcagctagtacaaattaatctaatcgccatcatccggctcgatcttgtattcgtcatgtgttgttggtggagtgttttttttttttggaaaattataaaaaaaaacctgttatgctaagtttaaaataccctcctaatttactttggtttgacgtaatttagtgcatctcttgatgaacatggccccaaacatatttctcagcgacacagtacgcactactcacatctttcttatctcgaatctaacgaacaaaccaaacatcgttgaaacccatgagacaaatgcagtttatcttgcggtaacataaatgttcaagagctaagactcacgaccttcactgcctaacgatacgatgggcgccatgggtagggattatagggcttggccaacaattggagtttttttgtgtttagccccgtagtttttttaagctttagctttttattttgttttttctctcttactctagtataagccggtctggctgattgtgttgtgtaattatacttttttcttctaatatattgacgtgtaattcttttgcgcatccgtaaaaaaaaaaaagggctgggattatcgaccacagttccttgcctagtactagtattgatatgagcatgcttgtggcttgtcataagaatggacgagcaacgtaaattggagagagatggatgaggagggtacctgtccgaagtggaggtaagtggcggcgatggcgaggaggacggcggggaagaggaggaagagcctggtggtgaggaggacgtcgttgagattggcgaggagggagcggagggcggcgcagggaaccttgtggaggagggaggcgtcggagcttttgcggagggaggaagatgagaggttgtgtgcggtgcggcggcgaggagaccccggaaggaggtggtgccgcacggccatctccttggccatcgtattcgactccatcatcatccgcgacactggcatcaagctctagttgttcctcgctcgctgagtcgctgtgcgtggttggttggatgagagagagagagagacgatctatcgatttcatacaaatgcggccgccgtcgtggtgctaggattttgctgtatgtatgtagtgaatgactaattgaggaggaatagtatattaatggagcagctcagctcatcggggtggatgcaaatgtcaaatgctccatgaccagagtactccagcatgcagtagtagaatatggagtacagatattaataatgaggaggcacaagcacaacacaagaagaagcagagagagagagagagtggactgatggtctggtcgaatcccgggttctctaaacttaaacgtacaaaatatcacgcgaataattagtatgcattcttggtagtactcctcctgttaattatgcagttactagtaactaggcaaatgcaaaacctccgtccaaaaggtacctaccatagacaacggagctgcaacagagcagaaagaaaccaatccaatccaaatccagtgaggactgaagaggaggtgagagactgacaaaaatggaggaagctccggtggtctattccgctccttccaggggcgtcgccgtcgatcgctgcttctcttgtcttctattgtgctcccctccctaatccaatccgtacccacccaagggatgacaatcccaatcatattaaacccttttcttcttttggattttttgtctccggtgcaacgcagccaaggcccacacgcttacaaataaagtccatacaaatcacggcccaacccaccacaccaacctatccttttaggcccatttgatggataatagtttggaggaaaacgttcacattatgtcctccaatttatgggttgagtttcatttgcatccctcaaccgtaaaatcaggtatatagcgcccttcaattatcaaaactagatcaaattgggtcccctctcagtggggcatgcatgtcagtggggcccatctctcttccttccttctctctctctctcaccatcctctcctgctgtagggcggtgatgacatgtgcacacatgatggaggcttgcaacatcgggtagaccagcagaggcccactgggcaggggagctcgatgtcagctgctgctctgctcgtccttccattgaggctcggcttcttcccaatcaacatcaacgtgcagaggggatccccattcccccgtcgaaagcagagcgcctcccaccttgatggaagaggcagtcaacggcaacgaccttgcatggctgttccaggaggccgtcctcaacctcaagcgcaacgccaatgaggtcctagctaggcttctccttgccattcatcatcgacacctctgcgcccatcgctattctgcagcgctcgccgtctttggccacatagggaattgtcgtcaaggcgatagtggcggcttggtgtcctcttcatcctcaagggcttgatggtggtcatgggacaacaagcaaacccctttccttggacacgacagcgacagtagtgctggctacaccaggtacttcgaggcctgctaccccgtcatcagtagcaaagccggtgaaggaagggacctgttgagcgtgcatatgttgtgaccacggcgatgattggaggagatattgaactatatgccacttttagatgtggcaattaactgtttgccactagactcacatgtcatagacacatgtggacccacatgtcattgagatatgtgtggcaaatagttaattgccaaatcgaaaagtggtaaatagttaaatgccccttattggagatagagaaaaatggaatcgtaaggggaaagagtgaaaggtcccacatatattttttgtttctattttttcaactataattccacatgaaccccagagcatattagagaccatgacacattatgaaaccaccaaccaaaccgtgagggatgtaaatttaccccgctttaatagttgggggtatccttcatatctagttttaccgttctagtacatgaatcaaactggggctatcgttgagggatttaaagtgaactttttcctagtgtggaccagcgttattgggctggggtacagttaaaaaatgaattgctcctactatagttgaactaacatttttcactctgcattatactccatatgttttgcatatattttgcattatactcccctgtttcttgtctgaggctgagcagattcgagcagggaggccatgcatagggcagaatagatgaaggtgaagttgtgcactctggttgctctgtagtggacagggaagaagagggacatcaccagcttcatcgctggattgatcgtcttgcatacattgaatgattgattgctatactagtacatatacatacacgaagaacatagtatatattgtagctgctgccgtacccatctgctacctgttggagaagatggcctcaagatccttgtagagtcccttggacttggagctccactgcgaatgcgagttctcgggtcccttcgccttggagtccgacgacgacgccaccgacgacatgctccggctcccaccctttgctctgctccccgacgcctccgcctcccctccctgtccctccttgctgaagctcgccttggccatctccctcagctgccccagccacgacctctccgtgccaccaccaccaccacccagtgccactgcctccggctgctcctgctgcttcttcatcttctccagctgctctccaagcgccgacgacggcagcaccagcagcagcagccccacccacgccgccttcgcgccctccacgaacgacctcctgtccgagctcagcagccgcacctgccggtacagcgcgttccactcgttgcacacctgcgccgccaacgccaccgcgaacaccgtcagcatggccagccctaccccgctcccctccgccacggcgctgcccccgctgtccaccagccgaaggcatgcggcgaacaccaacacctcgcttgccaccgccacgatctccaccagctgcacccgcttcttgatgaagggcttcttgagcaccatgaagaagagctggaaggaggcgatggcgagcaccaccacggcgtgcgcccgcgacgagtggtccgacgacgcgtgcgcgcccgccacgatccccagcgccacccgcttcaccgactccaggaacgtgtagtagatccgcagtatgccgaacagcttctgcaggaacggcgcctcggcgtcctcgttctcgtcgtcggacacgatgatccgctccgccgcgcgcttgccgccgctgccgccggcgatctgcgagagcatgtacttgggcgggccgcgcaggtcctcgaagagcgggccgagcttgacgaggcaggcggtgcgggcggggtccttccacgtccactgtccacgcttgccgggtcccagcgtccggcgaacaatctcctggtaccagtggtactcccgcccctcctggtgcacctccttgtactgcagcagcctccccgtggtgacgcccagcgacaggaacagcagcagcgctaccaggaacgccgttagcacccccgtcagcacgatcccgacggccagccccgccgttgtgccgcctcggatcagcgccgccgacgcctgggacacgcagggcatggcgaggatgacgagcatcagctccagcctggggaacacgagcgcaccgacgtgtgtgtggctgtgcctgtggcgcagcttgaggtagaggaggagggtggcgtgcagcagcaggaaggcggcagcgatgacggccagccagaagatgttcctgaagaagtacttccatccgtccagatcctgcagcttcatgatgatctgcgcctcgggcttcatgtcctggttctcgaacagataccggtactccatggcggtgagaggcttgccgtccaatggcgacgtcgacggcatggccattgcaactcctggagctgcaggagggcggcggaggacgtcggcggcgagagcggtgcggtcgagcatctcggagtaggcgatggcgggcatggtggagtagccgacgaaaggatcggcagaggggccttcccatgggaggcgcatgtaagggatgctccactccagccccttgctcagctcgtagtactccaccggcagatttatcgacagccatcgcgacagcgcgaatacctgaatgtggcacgccattctctgaaaccaacatcgccatcgattactgctctacctgctagttactccatatgattctatggaattcgattgtagtgtaccaaccaagagatttcgtgatggctcggatacgaggtaagaaggcggcctctggatgacacctgatgccagtagcgacgatgttgaaacagtcagcagcgtggcgaatgctgcggttgctgtaaaaattaccgtcgtcacgatcgcgatcgatgatgatgatgcaggaacagaatctgcactcaacacagtaaaaatgcacacaattagttcgtgcgtgcatctgtctgctattgctacctaataattcaggttttgacgagcatgcatatatggactctgcttatgctagctgacaattactactacattacgtatccagactcatgttactaagatttactccctccgtcacaaaaaaagacaaaccctggtttccgtgcccaatgtttaaccatccgtcttattcaaaaaaattatgaaaaaaattaaaaagacaagtcacgcacaaagtattaatcatgttttatcatctaacaataataaaaatacgaattataaaaaaaattcatataagacggacagtcaaagttggacacgtaaacctagggtttgcctttttttgggacaaagggagtatgtattttggaacgaagagagcaagtagtaatgatgcccttacaatgcctcacttccagacgatctgacggtaagttggtatttcctgcaacgtcctgagcagagttctcggcgacgtggaccgaaaccagattatcaaccgcctgtatctgcgctgtgtatatgctcttactagcttcatggaagctgaaaaccacgacgaattcgtttaattattaggaagctgcatgcatgcatatggatggatggatagatgggtttgttcttgcctgaggagattgcccccggaaacctgcaccgcagaggaagtgaagttgaagacaggctttgcaaactttatcaaaaccgggatgttgcgtgaacttgttctgacagtggatgtcgccagcttaacagaaggcctttgattatctgaacaaacattctcttgtacacgtgttatcgtattgaaaactgaaagtaacgtatggattgagtggaagtggagcagagtagtactgtatatatgattggcttactaaccgtaaagaaaagtgtatggctctgaagaagaaacaggagttccttgtctgctgattatggaattcccgtcacaggaaacagtgacaacggcggtgttggatgtcctcttaacctggaaatggtatggaatgaaggttgttaacccagcaagcaattaagcagtgggattagctaggacatgacagtgagagtggattagagtaacgtacgaggtatccaaagcggcgattcccgagcgtgcttcggttggttggcgtgagaatggcatcggtggcggtgagacggcgaggatttgggaggaagaattcatgacgggttcagcgaaggagaggtataccctgaggtccttgtcgtcgttggtggcttccaccaccctggtggcgccctcgatctgaagcagcttctcagggatgctgctgccgatgttcatcgagtcgctccgtctgtctgcagtacatccaatctcgatcgatcatgaataatactagtactagcaagcaagcaaagcaaatgaaagtgtatctagtgtaggtatacgtaccgaagcgcagggtgaaggtagagttggcggttctgatgaagtggtggccggcagcatcggtgcagaagcccttggccatgacgagaatgaggcggccatagagcaactccggcgggatggtgacgtggacggagtattgcagggcagggcggaggacctgaagactcgacggatccacgcgcccgggaccgtacacgctcagctgcaaatgcaaaattccaattaataccgtattacattccattccattcagtaacaaaatgatactactccatgtggtagtgtactagtggctcgtagtacatggcagtaggtggcgttgcaggtgaatccgcctccgccggggcagggctcggagaaggagacgagcaccgacacgttggatccgctcgtgaaccccgcctccgccttcacggacgccgtcggagcaaccgtgtctgcatccaaaccattttcatttctactactataaggttcccgcctgttaaccacattactggagttgtacgtacgagtactgtactagtaacggcaacaatcaaatcaaatactagtacaagtaaaaaggatgggaattaattaaaatgctactactgtactgtctagcaatagtaatagggtgttgttactgaaccaaccaacatcccaggcgtaggtggcgcaggttgttgttgttgttgttgttggtggtcgtcccgcacccgcgcacacagccaaggtgtggttgccgtctttcagccgcgagtacctcaccaccgctgtcccgttgctgctgctgctgtttcttccgcactcccacgccctctccccgtccacctgcattcacgcatgcacccaaataccaacttacattcgcatcttcttcaatactcctaccttttttctcacttaattaacctccttcctacaaaaaaaaaaaccttgatactactactacaatgctgtaccacaacttgttggcttgttgcaaatcaaatggtctaatccgccaagacatttccacctacctatatagtaatctgaccaacatctatgatctatccttgtcatggtagtactatactagtagtatcaccggagaaattgatgcatcgatgaatgcatctactatgaggctattattaactgactaattgctctttcaggggaccaggcacccaaatccacaaaaaggcacggcatatgctaactgaaaccacatttttacacttgattctctctatgcattccactggagtaggagtactccactaccactacctagggagataactcgaggcaacacatgacattagcaactgtaaaaaaaaaagagatttcatttcagacagaagctactcttaggtagcaccgcacgcacacatttggaaaataaaaatgatggatgtcgaaattaatgccgagacatggaatatatgcaatgcgagtgcgtgatgaagcagatgagctagaaaagcatggaatggaagcaggcaggtggaaagtgaggagtgaccttgcaggtgatgaggcaatcctggcacgggcctgatccattggtgtgcaggacctggaaggtgaagacggccgacgccgacctggagacgcggggaggggtcttggagaagctgacggagaccacgtcatcggcagcatcggaggagcacaggagcgccgccgccgccgccgcaaccgcaaacacgacgccgccccagctcttccacaccatcctacgcgcgcctactattatctactcctactccctagctactcagcagcagcagcttgctatgctactccagtactgttgcaagagaaaagctcaagaagttacacctggtgtgtgtcgacctactgagctactcctactgaattcattcatgcaggcacccagccaacagtgttatggactggagtactggacagggagggaagtgaatgcacgccacgctgctgcctctgcctttgggaaaggaaagctagagctccctcttgacaatggcagtattactgacttgagttcagtgtggtgaggtcgcagtgcagtaagtatggtggtagattggaacagacaaaaaatgaagggagggagggagggaataatggtgggggacagacaggaggggagagggggccaaatgcacactggcaggcatcgcatcgcccgccatgtgaaggacgagacggaccatggttgaaatgcatggttggctgcaatgcaagcagaggactgaagaagaggaaatggattggatgatgcacatgaggactagagcgcccaaactgtcttttgtgcatttctaccttttatcctattttccctaatcctttcaataatcaatcaatcctccttcctactcactagctcggatgtaatccatgtcattcgatcggcctagcttgcttccatccatagacaggaagaaaacaacaaccagcgcgagatgcacagattgctacagtacgcgacgatccaaatttgcgagcaatactgatcaactgtggcagcaaggacaaacatgcagctatcaccgatcgaggcactgaaatttcagtcatacggtggcgacatgacgatgttacgtaatcaaaattaaggatgggcctcgctcgcgaaccactgaatcaggatatgatgcctgggattagctcaccatgggtggctgctgtccgtcatttagaccatgcatcaacaacaacacctagtaactcttcactagttacatcgatcaaagatggagtactacatacatgtaagagtagttaatactagtttatttatctcagcgcgctcagttatcatcgaaaaataagggttttctgacagcaaggcatactgctagttgccaaaatgcaatcggtgacatgcaggtcccaaaatatgatggtaggagtatatattggaccagcaagccacaaaccctcttaaacttcttctttcaccctcaccctcaacaacaacatgcatggtcctcatcacagacagattcacggtgctgtgtgaaacatacgagtaactagtacataatctcaaataagcatatgattgtagcacaaaaataggggaatcctctctgaatcttggaggagactccagatctgtacgtgcacatgcagcagctgcctgccccccgcaataaccaccatgcacattgtaggtcagctaacttcatatatactccagtttctagtattcttctattgtgttgtgtcaccttttctacactggtctccaagattcatatcgtacttcgtacataccacagtgatttagtaaagaaattcttaccacaacttgtgttttttccaaaaaaaaaatgcaagtcggaagaacaagaacatgtccattctatttcgtggtgagcgttagtagtagtagacgacaaacaagctaggtgtggtaaggcctgattcatagtgcgcagcggttataaaagaaattgtcatgcatccatgggcagctctgaattaacgtcgtgtcgccagggagaagggggcactatttcagagggtcggtctgtaacatgtagtattgccaatataattcatctgagcatttacacatgtgtacaactgtattgactgcagatcgacgacgagggaatccagtcagagacgtcgttggacggatcaaaccttttctccattgtaaatcaggcagatcactgcagctgtagtactactagtgctggagtcatgtgattatcactgaagattactgcagtccatccggttgcctccgactgatgaatgaagaatcaatcagtagcaagagcatcccaggttagttgatttttcaaattatttatattttaaaagatttaaaaaataaacattccaaagttcttaaaaaaacatactccttctgcccaactgtagggcgaggcatataaatcccctacagtacggcaatctatataacgtggcacctggcgagagaggcgtgccatggcaatttttgcaagcagccccttctcagcaataaatcgcattcccctatagcgatttatcgccaggagggaatggtatggaaaattatcacagcgcaaagttgggtgatggatggagtgtgccatgtcaattttgcaggcggcctcctcctggcgataaatcgcccttccctaaagcggtttatgaccgggagggggtcgtctgtaaaatttggcaggcattgaggaatatatttatgtaaaactttaaaattgtaatttatttttttaatattttaaaaaataaataaaaaatcaggttagttcccggctaatatatgatgaagtcaaattggaccttttccacttgtatcatcattgttgggttctcgaagccaacccatcctgctctaaatagtactccgtagggctgggcctgtttagttcgtgaaaagaaaaattttgggtgtcacattggacgtttgaccggatgttggaaggggttttttggtatgaatgaaaaaactaatttcataactcgcctggaaaccgcgagacgaatcttttgagcctaattaagccgttactagcacatatgggttagtgtagcacttatggctaatcattggactaattaggctaaaagatccgtttcgcgatttacatgtaaattgtgcaattagttttttatctatatttaatgctccatacatatgtcaaaaattagatgtgatgtttttttaactaaacaaccccgtagtattaggaaaaagtacaccgaaggtctctcaacttgttatcgagttagaaaattgtctcccaaccgcaaaactagatatatgacatctctcaactcacaaaacctttgactttaggtccttcgatggttttgatctgatgtgacggttgagtcagcgtgggacccatatgtcaggatgccacgtcatccctttcccattcctcctatttctctcgcttctttgcgcagggccggcgggtggggaggatgccgtcatcgttgaagaagccgcacgcgtccggcgagtcgcgtggccccgacaacccccacagcgggtcaccagcctccgccgcgtgccgcctcagctgctgcagcatgtacttgtgtcgtagcactggaactcgcccacctcccgtcgctcccgacgggtatcggagctcgccgttcggtcccaaccccactgtcacatcctgcgagaggaagaagagatcctggaatgataatgcacacatgcgtccatggtagatggtcggccggcacaggactgcggcgacaacggtgaacggcggcgcgacggtgaaaacggatcggagggcaccggaaggaagagcatgacgcggggaactcaccgaggggcagctcgacgacgacggacggcaaagggagcttcaaacagcgacgaggtcgggtccaaggcgacggcggcgttcgacgctctttggcggcaacgaacgggtggacggtcttcaccttggtcctgcgaatccaacggaggcgacatctaatcttggcgtcgatgggaatgccggtgaggcttggccggaggcggagtagatcgatcgagttcacacttgacagtgacagcggtgttccggtggcttgtggcttcgaggagatggttgccggcggtcttcgtttggcgagatgcggctggagcagcagccggcggcgttatgtaaatcagtgattcagtaaatttaatttgggtatatatgtgcgccatgtccgtcccgctcctccgtctcgctcgccgtagcacttgtgatttccaccgccgtcctcccactcgtcggagcggaggtgcgtccgccgccggattgtcaaacgacccccacctgcaagaccgcgggtttgtcagcgaggtcaattgcatacatgcccatgcgtgcaagctaaaactcacaggatttattttcatggcgggttgctgccaccagaggtaggactaggagttgaagacgaggatacgtcggcgtgggcggcgtgcttgttgatggaggcggcgcggacgatccggtcagcgatgcggtggcgcagcgggtgataggagttggattccaccagcaccttgccgcgcgcgttaacaacaccttcatggcgcaccaccactccaacagaggagagggaaggaggaagggagagagttagaggaaaaaggaaaggtgctaacgtggacaccttgacatgtgggatccacgtgggtcctatgctgactaagccgtcacgtcggataaaattgggtcaaaaccacccaaggacctaaagtgaacagttttgtaagttgagggatgacaatatctatttttacgattggaggatgattttgtaactcgatgacaagttgagggaccttcggtgtactttctccgtagtattatgggcttatggccacatccccgcgtataggtcgagaaatctaggcgcatacatatacgaggcctgggatttgggccccctcaacctcaagggccgaatgtgatctcgctcgctcaacttcttttcggtcccccatccccatccccatgtaagataccatagagttttaatctttgaatgaattcttggcacagcaaacaaggaatgaaatgtctaaaatcatcggataagtggctgaattaggcttggttcgatagtagtacttctagctgtagctttgcgatggtataatgtataacgatatgagttactagggtacgagttgtaattaactattcactgttaataaactcaaaaggtaagtttactttttaaaaaaaacttacataaagtttccttttagaaaaaccacaccgtataacagtttaaaatttgctcacagtaaatgagctagttgaaaaagcaaaacgtggaaacataacccttagggctcctttgaatcaaaggatttatataagtatttcatacgattcaaatcatataggaaattttcctatttggccctttgattcaaaggattgaagctttccaaatcctatgaaatttttatggaatggcacattgcatgtggattttggagaaaatttagcaagagctccaacctcttggaaaatttcctttgagtctatctctctcatccgattcctgtgtttttcatgcgctccagtcaaacgacaattcctgtgtttttcttgtgttttgtaatcctctgttttacacttcaattcctgtcagaatcctgtgttttttctattcttttgttttttctaccctgcgattcaaagggacctttagagtgtgttttttgcatggctgtagaggaaaatttgtagcgcacgtgaaacgagaaaacccattaaattaaaaaataaatacatttgatttttttaaaaaaacaaaatttatataaaaatttattgtaaaatacgtatcatttaaccgtttaaaaaatatattaagaaattgaaatgtggagttaaaagaaaagagctgagcttagtcccactaggccactactacagtcaaaataattgaaaatttgcagctacactattagttttcaaaataattgaaaagtgagtagtttagtggtttcgtgcagtgtgcggagcattgttgtacgcaagcatgcatgtgtgcacgtgggcagccacgtggcaatataaaaaccaactcgtctacatctttgagatgcagacaagagtcaatgccgttctaagaaaaccatgagatatcgtacgagtagaaaatagaattgagtaaattacataaattttctaaatattgactaagaaacagcacactaggagtaggggatatgcttcccagcggtctaaacatgtataaactgttcgttccttacttttttatgtgcccgtgatttagatcccgcgtacctcctaagaggccaaatctaaaaaagcggtttgttctgctccccgctgaaagagctcgggctccgatagatatataatcgtagttactttcttcgggttaatagtatttatcatcttgatcaaagctgatgttaaactttaaaatatttgattatatcatagaaatatgaacgatatgtatagagtagtattagaaaatactacaacaaaattgttgatatttctagttacattataataaaaaataatagttaatgctatttatttgaaacgataaatactgtcaaacctgaagggaatatggtactagtgctacacaaaagcacacagttttgataaattctacttataaatcagacctgacattttagatggtaattttatataatctgacagaaactctaaagtggataaaagaacttgtggatcttacatgtttgttttgggtttttatgattttagttttgtgaagcacggatactgtaatacctaggattatgtatcacgtgtaaagataaacttgtgattttatataacttgaacaacaacgctataagattagtgcaatttactgaataaaataaaatgcaggacaaaacatatagtagcacaagtagtggtagggggaggagcagcgtacgtgtggtttgcgacgtggtgtgcgtgggcggtgcggtgggcatgtatctgcatctgcatgatactagtgtccaccacatattacgggactattttcatctgctttttatttattcattgattgattggtactactactgctagaagaaaaggcggtttaggctgtgtttagttctttttttaattttttttaacatatacgaacatacatttaaaatattaaacgtagattaataacaaaataaattatagattccgtccataaactgcgagacgaatctattaaacataattaattcgttattagcaaatgtttactgtagcaccatattggcaaatcatgacgcaattaagtttaaaagatttgtctcataatttacatataaactgtgcaattgatttatttttatctacatttaatgctttatatatctaaatatttcgcaaccttagtttaggctggtggcagcaaggtgaccgttgcgcgtccccatccaaacccaaccccccgtaccataccatagatatccccaatctccccctctcttagctttctctctctcgagacttccttccttccttcccttggtggtggtggtggagactggagagtggaggcgaaaaaagaaacgaatagaatctctcgtccctcctcctcctcgatctc

SEQ ID NO: 36564 - DNA, 12584 bp, Oryza sativa
gccgccgctgcccaccgtcgccttagtttccgccgcccggtactgtctctgcttgtaactaaccatatactccactcgatcagatgcttcaatctccataattcctcctcttttcgcctttacatcataatatatgtgtttgttgcattccattagattggattggaaaaccattccattcgacttgtatttcttttgctgcttcattacatcaatcgatcgatcgatcgtcggttgggaattaggccatccactccatatatctatcaccatctcttctccacttgttcatccatttatgctgtctccacttcccttctcttgtacccatgcaattcaaatcatacttcattttcaagcacttctctctctctctccctctctctcttttccaaattattattattattattattattattattattattattattattattattattattttcattcattcttacctgttaagcacgcctccttaataattaaaagaggtcttgaggtacccatgtaaacttttccctttttttttaaaaaaaaaggatccttgctagcttgttatgtcggcaacgcaaagctatttcgtgtcacctcagctgcttcaaacttcaatttgcattcataccctccagtccgaccggaatatatgcaaaagcaagctgcttttcattatactgcagctgcagcattgcctttcacataatcacattgcttgcttcattgattgtattcatgcgtccaatacgcgtctaataatccaatgcggtcactacctttctcgctacagctagctagctgtcacaccaccaccaaagtctctttccgtgcgctctggcttcataccattggagtccacgtttcctgctcgcacttgataatgtgtcactgtcagatttactagtataatactggtctacatttggggtgctggcactgccaactcccattttttaaagctcaaaaaatccattcttttttctgaaataagattttcttttttttcttggtttgcattagcagtatatatgcacacacactcattcctacactaacaatcttactacatcatatcattaacacttgcaggcctgtctagagggcagccatggccactgtttctgacatcagcctctccgcggttatcaacgtttcgatggccgttgcattcttgctggtctttgctattctacgattacagcccatcaacgatagggtttactttccaaaatggtacctcagaggaatgagagacagccctgtttcctctggtgctgcagtgcaaaaggttgtcaatttaaacatgagatcatacttgaattttttaagttggatgccggctgctctcaagatgccagaggatgagttgatcaatcatgcaggccttgattcggctgtctatctacggatatacctaacagggtctgttcctttccatcttttatgtttctgctcttctcaattgttccttgttgccatctcattttttgttccaagtcatacttgtggaaataatgccaattagttaatgatacagtgagcatttaatccaatgggtaaaggcctgcggcttcactttgttattgtttctaaacaataagagatgctaatgaagaaatgatgagcaaatttatcactctgcatttttcccatgttaatttaaacctgagaatatgaatcgtatcattgttgtcaaaatctatttgtgcctaacttcaattatgcctgtgtattgatatacctgtattgaccttttacaggatcaagatattcgttccaatatcaattttagcttcgcttgttctgttccctgtgaactggacaaatgacaccctagacagcatgaaggtagtccacagtaaaattgacaaactttcaatatcaaacataccttatgggtcaaacaggtaagcctccataaatcatttgatatctggatgcggtgtattttgatgagttgtgtagagataaatgtttctttttttggtctggttcaatataaattgtacgtaaaacatcaataagattgcccattggtccaccaattacacaaacaaaatctgtatagtgattcattttacatgcagattcaacctttttaagttttgggcggcacctgaaatccaaccacttttacttatcttcatgctgattatgcacatgtacttggtacaatttttaggagcattatcatcttatggttttgggtgatttgataaatatgccacttgcctgtgtgactgtctaatttagtaaggtacaagcactctattttggcctgtgtgcttgggacttagcagctgccctgccaagttcaatattgggtggcagttgctctggttgaaaataaattcatccacactgaacttctaggtttcatttattaatttctgttgatgctagcacatgtctttgctgttcatgatgaacattccatctgttttacaggtttgttactcacttggttatggcttatgctgtcacgttttggacctgctatgtactgttccgagagtatgagataattacaacgatgagattgcggtttcttgcttcagagaaacggcgaccagaccagtttacagtatgatcttgtcaactttgcaaatcccctctctatttagtaccaacatgtttacattggatccacaagaagggtaaaaaattgtaatattaatggactgaaactattcaccactggaaatagtctaagagattgtggctaagcattttgtctctgagcaccctgatactcactttgcactgacttggtttatattatctaaagcaatgttgtagacgggaatggtttcatatctcaattgaataaacacgatgagttaatttccttctggttggtttgttgaatgcacctcaaatgatttattttaggttcttgtgcggaatatacctccagatcctgatgaatcaattagtgagctcgtggagcatttcttccttgttaatcatcctgatcattatctaagacaccaggtaatctttggtaaaaatttgtggataactaagtcagatgtagttctgttgcttttctcttctgggggtttcaacaggtcatcatctgcttaggtaggagctgtgtttctagttatgctgattggcctaatgcaaatagattttttttctactcaacagaacccccttcatatattatccttttcccacaaattattgatggtttcaaatgaacctaatattaatgtttgctagtttcatgttgagattttttcccccagattctgagaatagtccacataatagcctacccacagattatttggatattaatacataaatattttggttttgccaagtaacaggaaagttatgatctcttggttatctagattttcatttaaataatcatattcatatgttaaagggtctaaaaactgtctctctgtgctaacacttcacagtgctaattgctgaatgagatttagaagggtcatatccaaatttgtgtatcatatgcacttgggttttctaccctgacttcattgatttttttattcttccttatactaattactgtatttattccgtcctttttctggccgattgtctatatctataggtggtttacaatgcaaataaacttgctgatctggttgagaagaagaagaaactgcaaaattggcttgattactaccagctcaagtatgaaagaaatccatcaaaaaggcccaccactaaggttagtctgccatatggaccttgatcaatttatttttcatttcaattataatattacattaggatcttttttctttttaattctctgtccccctgttggatttttgttccagactggctttcttggctgttttggttccgaggtggatgccattgaatactacaaagcagagattgagaagattgggaaagaagtaagttgtactccctccgtaccgtaatataagggattttgactttttgcttgcactgtttgaccactcgtcttattcaaaaaatttgtgcaaatataaaaaacgaaaagttgtgcttaaagtactttggataataaagcaagtcacaaataaaataaataataattccaatttttttttaataagacgagtggcatttttgtctattaattccaaataaataataatcccttatattacgggacggagggagtagtatttttgtctatataatcattggaccattcggcattgtccattttttctgattgagttgtatcattctatgaacatgggtttgcacaatcgattcttttttaggattagtattatgtctaagcatcacacattcacaccttgtgggagtttaatttgtttacagctaacagtcagataacaataaattcatgtgtaacaacatgcaggaagctgatgagcgtcaaaagatcatgaaggatccccagtcagctgttccagcagcctttgtttcatttcgttcacggtggggggctgctgtttgtgctcagacacagcaaaccagtaatccaacagtctggataactgaatgggctccagaacctcgtgatgtctactggaataatctatccattccatttgtgtccctcacagttaggaggctgatagttgctgtggcattcttcttcctcaactttttttatgtcattccaatagcattcgtgcaatctcttgcaagccttgaaggaatagaaaaggcgcttccatttctgaaacccttaatcaaaatgtaagtgtttcttcatgtgttgattatttatactattattgcatttccatgatttattcagcgtgtaattaatttgggtacattagacatatggttatcttctgctattcttttgaaatgccctgataaatcttgttgactattgtgcagtgatgtcatcaaatcattcatccaaggttttcttccaggaattgctttgaaggtcttccttatattgcttccaactatactgatgtttatgtctaagtttgaaggattaatatcacagtcatcactggagcgaagatctgcatctaaatattatatcttcttgttcttcaatgtatttttgggaagcatcgttacaggatctgctttagatcagcttaaggcatacattcatcagtcggcaaatgagtaagtactcctatgccgccaactctaccgacttgaaagtttagagattatatacatgcttggttgttcatttgagtcttcccatcttttaataggatgcagtttatttttcctgcttcgcggatctctgtttgttgacaattgtatttttagcaattaattatgggagaacacagaaaaatctggttcttgtcggagatcactttgttcatgccggctgtcaaatagataccaagttcttaattctgttttgattagtactgtggattatatattcaggagctacactttgtttgaatatttagacacataggctaaatcaaatatgaaaaaatgggaccaatctaggaaggactagattgattttgaattaaggagggggtgaggctcgaacccggaccggctagctcgcagcttgcgttgctagccgggaaggccccgggcctttctccttaatcaaatatgtcaagcagtgaattatgatatacattcttattaaataaaacatgtgctggtggttcaaataacatcatgaactcgtgatatattggttcttaagctatcttagaaatagataaattcttttggttacagtgagttagacataaatagcaacataatgatgcttaataggcaaaaggggggccatttgttgataggctaactctgtagatgcagagattttggcatcaaggcaaacgccaaagcatgggcctcagatacttacctcgtggaaactcagatcgtatttatgctttcacgtaccgatatttatgtcctgctatttgtctgtttattttacaactcattcttcacattctctgattgaaaccaaatgatcattacaatttgcagcaagtctaaattagttcttttgcagaataccgagaaccatcggtgtagccattccaatgagggcgacttttttcataacatatgtaatggttgacggttggactggtgtagctggtgaaatattgagattgagggcacttataatcttccatttgaaaaactttttcttggtgaagactgaaaaggacagagaagaggcaatggatcctggtagtatctgttttgattggtgtgaaccacgtatacagctatatttcttacttggccttgtctatgctgtggtgacaccgttattgcttcctttcatattggtattcttcgggctggcatatgttgtctaccgccaccaggtaaggaccactgcagctacttgcgagaattttattgtgttaagttttaagtgattatgatgaactactaaattagcttgctttgtatgactatttagaccatttttccctggtttattggaaataaacttcattactgatcggcacaaacagtttccactcatgatcagtgttgctatgctgttgtgcatgtgttaagggtatgtaataatggctaagatttactaagaatatgtgcttggatatattgttttgagttcgccaacacaagggagtatgctattgtgatagatggacagttatgctagctaaaagttacatgcaataaatctatcagaatggtcatgcaactaaggggctgttcagctgcctgggatgtgcaagaacagttccccaagcacgaaaatagcagcgggcagcagcttggcctgccgaacagcccgctaagatacttccattatcatcaactgcaaagcaatttatatgaaactgcagtgatgcaattaatctacatatgattcctaattttgcgatattaattttatgatttagttgtgtatatagtgttttggtatgcttacttggttgcacatttctttgaagataataaatgtctacaatcaacaatacgagagtggtgcacagttttggccgagtgtgcacgggcgcataatcattgcattgatcgtatcacagctacttcttattggactgttgagtacaaaaggtttcgaggagacgacaccagttcttgttgttcttcctgtgttgacgttttggttttacaagtactgcaagaaccggtttgagcctgcatttgtgaggaacccactacaggtaatgtgtgacaggaagttttgtatactgaaatgtttgttttggtttggtggtaagagtgaaatttgttggatgtgcaggaagcgatgaggaaagacaccctggaacgggcaagggagccaaccttcgatctgaaagcgtacctggccaatgcgtacctgcacccggtgttcaaaggcagggaggaggaggacaatatgtcaatatccgaggatgtcgggatggaggaggtgatcgtgccgaccaagcgtcaatctcgccggaacactcccgcccagagcaagtacgaaggctccgacacgctctctcttcctgaaactgtacacgaacgatagagctacgggaatatcagggtgactactagcttgttgaattctttatagtctgtacagatagattgatacatacctactcctacggggatgttggcagatagctttgctgtacactttacagcacgagaggtatatggagggattgttcaacacccacagactgatgattggattgccaatattatgatttctttgttggtttccaactgcaactagctgtagtagtaaattagtactaccactgtaataatataaaccagctagctagtagcaagtttttgtcagtgcaagtgtgcaaccgcgcaaggttgttaacagtaaaaggagtcaagccggggaagggacgggagatgcatgaacggctttgctttgcaagccaagaatattcattccccactgactgcctgctttgttgggaacatcatgcatctctcattattatatcttcatatctcctctgctatcttctaaattctaaattccgaagtgcgtgtgcgctcatatctggtgtcatttcgagagctctcctctcctctcctctccagaaaagcacaaccaaaacccttcatatgtaggactgctacctgcactgcatttcatcctgctgctgcttgcaatggcggtacaaaagcgatggtgatgcatgtcaccatctccgagtcatcaccacactactgtcgtgcaagtaaccatcaatctccatatcttcctcagtagccgcaaatatatatactccaaaaatacataaattatgtccttggccccaaaacaacatagattcccaattttcattagcattaactttgggtcattggcattatactccttccaaagttttaggtccaataaatgctgagtcttatagttttcagtccaatcacacaagtattgttttcggcccaaaatcacatgtatattgatcttggtatcaaattttcatgcttattaaacatgagccccccaaaagtatctgattgtatttttcagctcgtaatttcagtagtgtcaacctcgagccaaaaaattcataaaacaatagcctttgcttcaaattttcatgaataacttgagcccaaaacgcttgaatatttgcatttcggctagaaaatgaacggcgtttagcttttagccaaaaatttcatgagtggtaacattgaggaaaaaacacatgaatattagcctcctacccaaaattttcatgataattaaccctgggcccaaaaaattgtgtgaattttagcctccggcctaattttttttttgagtattaaacttggggggtttgaaaacacatgaatactagccttcttccgaaaatgcaatggaattcaaattctagtggctatgaacattatgcacacacacggatgcaatttttatggggtttcatgaagctagtgatttgccatggtcttcgtctctttgagaatctattaggggcaaatttgtgagtgtgtgtgcatgtgtagtagtgcatgtatcttccgtgtaatccaaaaaaattctccattattaaccttggcaccaagatacacttgactggcaagggtatgtggtttcaacctcaacaggtaacatgctcatattattttcttaaaaggtaattggagaaacgtctctctaaatctcgttttttaaatcttggcaccaacagtgcataaattctctcttttggcccgaaacacatgaatattagattttgattcaagatttcaggagtactaacttctgaccaaaattgaatgaattttagcctttgccccaaagcacatgagtattgtccttaggcttaacattgcatgagtattatccttggataaaaaaggaatgaaggaattttagctttcggtcctaaatttcataaatacttaccttggcacgaaaatgcatgaatattagtaaatacttttgccccaaatcttatgagtactaatgtgggccgaaacacatgaacaacggcgtccaacaacgacaacgacaggatcgaagcttttcccgtcaacgatgacgagggcgagcatcttcttcatcagtacagatgctaccaacgatgctttggacgacgaaaaagaagcagcaagaggcaaagctgtttgggaatcgccaacttccgcgagcatcttgctcaggattctaccatcatacatgcagagcagagaagaatgagatcgatcatctgtacttgaactgggaggagcagtgcgcagacgtacgcccaacccagctgatcgatcagccgatccatccatccattatatgacgacgacgcccaagtacacttaacaatggtccagtacctttaatactctactgagcatacaccagtgcaaaataggctagaccaccgtatcctccctgtatacacataacagcacaggcagtgcagaataaagccagcttcaaaatgtctatgccacctatcaagcatctataatcagatcaaatgactagaaataggcctgtgcgtgccaacataagtccagtcccgctttgtgtttcatcaagttttcaaaccaaaccattttgacattaactctcatccatgggatcatttccaccgcctctctgggactctgaatccttgtctccagctcctgaagcttttgccacggagtcttcaagagcctccaggaacgaagctactgtgaatttatctgtgccacaaagacacccatcaaataagttttccgaaaacatctcactccatctccagattttacaaatactaaataaatcattttcagacttgaccaactagcatcaaggatgtttgtcgtctagcagaaaaacaacgctcatattttgggcaggggtcacctccataagccattgaaagtaaaagctagactagcaaggtaaatatcatggtcattgaggtatcagttgcagaatttgtgttttttcaatacataaataaaagtttcagccacatgcacaaattatctaccgtgtatttgcgaatgaaaaaaaaaaggagcctgctacatgctgcatttaactttactgttcagtgcaaataaacgagaaatttggttgtcaatataagtgaagatgagaaggattacatttactagggtcaactccaaattgtgctagatctatttgcccagtccgcagcacctgccatacatgcaaatatcagaataaaaataacatttgaagcattgtgtcacgattcaccaagatgttcaatagaaagatgaattactaacatgggtaaacgcttctacttgctgccgcaaaggaggactttgcaatagttcaagaatatcaccagcagtccatgggccctggaattaagcaagcacaataaaatgagtggaagagtcaattgaagtaagaaccaggatgacaaatacaaagttacaaacctctggaagatatgatgccaactgttcaatgggcaaagtttccatgagtggtaacaccaaatcaggcttcaagatgtctcctaatcctaatcctgttacagcggttaaaagtactgatacatacagcaaatcattgaagaaaagtgaatcaatagagtattgtactgtaattaccagcatcagggtctgccacagcatctgaaattacaaggcgaatgcaagtaaaataaaatgagaaggtggtcaaatggaagaacatttcaaaagtgacatgatttttcagctgatacctgatggctgtatagcactcagtattctctgcaggtcttccaaccgtactggcccagcagcagatgtcacctcaccagctaaatcagcagtcatgctctgatcaactaaattcccagctctgatgagaagaaagaaggaaacaaaggggttagaattattaaatggtcattaattcattatacccaaaactcaacacgcatgcatgaatgccatatcaggaacaaattgaggccacactttcatatatatttagcaggaaaaatatcagtgtgaaaataggaagaatgaaaggcagtgcacaataaactcagctagacatagatagtgttaacttatgcatgaaattggagtgaatatacttgtggtttataatgaacgtgcatccatctgttactctgacggccccattgaaaaataaagattgcaatgcaaacgtctaggtttttctgtgctgcacattgcatcttgcagttcgttaaaattacctggaggagatgtcatcatcagctgtgtcttcatgtgacatttcagcttcaatagaaactgcctcaccatctgcacgcccatacaacttaagacacaagaaaaatgagcgcataattaagagttgagatcccaacgttcagcatacctaatggtcggtttatgtaggcattaacttggcgacatatttgtgagtcgtcatcagcacttggctcctgcacagtaaagagcaaaacacaagtaaattttagctggtggaaggacttctgtggttttcaaacagatacacacacacacactcaactgacctgcatccagaagaagaatttcctgctatcgtgcctgaacttcaagatgtaaacccttccagaagattgtgttacctgattaagttgaattacaatcatcaatgaagcccaagaggttcactaagatggtcttgcagaagaaaataaacttgaacctatattcaataccttctcaaagacagcctcctcagggaagacaatttgatcctgtgaaaagggaatcaaggatatacaaaagtacgataatttcctaggatatacacaatggaaatcaggagaaacagacacagccaagttcaaagttcaaacatacgagtcatacaagtacagtatttgcagattaaaaaatgagtgcacgatgactactaactactatctatgctcgagaggatacaacttcaactagattctgtccacgatcaagccattgaaaatgaaccaagccttcttcaccctacaaacaagtggatatgttaactgcactgcaaatccccataaaatatgagaatgcaaatggcttataagttatactggacaaatagaagtacagaacttcaattcaagataagtatgacttttagcatgcatacccttcctatgcgaacaagaccctgcgtgtgtctgggatcgctcgtgttccat

SEQ ID NO: 36565 - DNA, 1046 bp, Oryza sativa
cacatgatatcctgacaaacacatgagagattgtttttaaatagaagctcaacaccttgttatatcatagcagagataaatgagatggcaaaaataaatatataggtcattaagattctgaataagcacaagatcttaatttgagatagatcaataagcaccatgcactgcaacagaaaattaactcagttcactgaactactgaaagctcactatacacaacctacatttcttatcagaagattttcttgctacaaattgctagctaaatattttggccttttagagtgcaggcaaagattaacagaagttctatcccagttttctgaaaagaactaaaacataaagaaacaaactgcctagtatacaaaagagacatctatgtttttttttctttttttgtatcatgtacgatgaaaaactggtccaaacatggttcaggcctttgtacatattacacacaaaacagcccattaacatggtactaccaatgccattttctgtcaggctttctttaaccagctggctcacttgtcatacactcaattacttggcaagatttgcgaatagttgagaatttgtccaccacaaaagacaacctcaattatccttttggcaaagtgttgataccaaccaaacagcccataatgtcattttagatggaacttgcagcagctaaatcatgatctcaaatcaacagcaaccgatcatcgcagttaaacactaacaggaaattcggtatttgaaaaaaccaatacttgcagaaacactagaaggcaaagtgaggagtttacctgtaggggctctgtgctctccattgattaaagagtggctaccacaaggtgcaggccctaaaacaggcagtaaaaaggacagtaaagtattggacatagaacaaaatcaagcaagtgtgaagtataataggttatcagtaactagttgtcagaagtgtactgcatgccaattgagatgaacaaaaggtactgtagtctgaaagtagtagctgcctttagaactttgtgcatatgagaatgaaaacatttgat

SEQ ID NO: 36566 - DNA, 15373 bp, Oryza sativa
  unsure (1)..(15373): unsure at all n locations
cttttgtgctgctgtagtgttatttcatagtggagaaccaacgtgacccaaaaaacggcgaagactagccaaaaaccctagcagctagcaagtcgcattaacataaaactcgtcaatgattagcttgtttgcaggggctagttccttacaggatggtgcagtgttttatgtttgtttatttttttttcttacatgtagatgtaagcaaggagagcaaaataggtgggtgatctataagattttgctggtaaggacccaagaaaaacatgagcaataaaatcgattggagcagccgtcctagaaagagagatttggattggagagaggaacaggtagggcaagggagaagaaaatatcttagaaacaatggagcaagagttggtcaccactcagtcactcaccaacaagtgggggattacggaggagggctggacgtcgtcgtcgtcgtcggcggcggcggcgggacgggaggagagggattctccgacgcgatgtgatgtgatttggggaggcgatgacgacgggagggggagcagagaaggatctctcatggtgggctgggcttctcttagctgggctggagaggcccgcccacgcatttgatggcccatataaaagcccgctcggcaactccaaagacgaagttgagctagggttttcaatctctttcttctctccaaaacacaaatcgtcgccgcatcccctcaactccggcgatccccttggcggcggcggcggcttccccaatcaccccactccacctgaactacaggatggcgtccgccggcccggggctcgaatcgctcgtcgaccgtgagttcatccctcttttttttttatctcatctcacccagctacccaagattctcctcctcctactattactagtgatagatgatgttttttttttctctccagagatcatatccgtcatcacaaacgatggccgcaacattgtggtgagccccttgtttgatctactcgtacaccttttttgttttttttggctctcgctaatactcactcgaattgccctgcctccgcttcgtcaggggacactcagaggattcgatcaagccaccaacatcatcctcgatgagtcccatgagagggtctattctaccagggtagggttgctcccaactctttctacgcttctttcatgctatcttgcaaaccttcaattaattttacagcaatatcaatatttcactaagctagtactatatgccctgataatccggcaacacacactttacttccatcttcataaagttatgtttacaaggcggtcatacttacagttagttactctgctaaatttttctgcgtttagaatctctaccacagtctgtttggcattttccatagagttgcctgtttgctaaggctacaagttcagccacacaatttttttttgttattccagtatgtccttgttaattgtgaccttctccctggtttgctgtcaaatgctctcattggttcactagtgcagaattctgcaatcagcaataagtttctctcatggtgcttgaaagttagttgccaacatgtattacacagtaccctttatggctaaacacagattgttttcaaagatggctctctttcatgatggttataaatgtcatcatgaagtaatgagttcatattgttgactgttcgtatctatcatcatgtctactgtcagtatgaactgaagttcgtttcctgcaaaataatgagtttatactgtaacatgttttagctgaatttgtcataacagcacctttttcttcaaggattggttcgattaattctaccttgtgcacgttcaatttttcagaagtcatattattttttgtcttcaatagttaggtattggaatgtctttgttctttatggtgcagagttgttgttctaacaatttgcaggcaatgttgactatgaatagttatatgtctcgtatcatgcacctctctattgaatatgggatatgccttcttaaggactaggggccaatgcctttaaattgtcatgcttttagtttgtggcatgtgctgttagtagtacagttgaaattttgagtagtgatgagagaaatgtgttgtacctgcaggagggagtgcaacagcttgttcttgggttgtacatcataaggggcgacaacatgtaagctatttcctcaattgtcgtttgagctgtttattgcttattaattacctgcatggaggtcgtttatggatgtgttattttgtttggtggtgtgcctaactgaagttgaatccgtgggtgatgcatatttacagcagcgtggtgggggaggtggatgaagaactggatgcgaggctggatctatcgaatctgagagcgcacccgctgaagcccgtgatccactaatggaaacgaatgaatgatgtactactactagtagtaagctaaacctaaatgtagtgttgtcccagaagttgtgaagaagtgggtgctagtgttgccgatgagtgaacttctttaacgtacgcgaggaagtccagcaagcggatgagcgagcatgaagaagaatgttatggttttatgtggtggtggatgggtgatgcatgtttgttgaacacgaacacagacacagtgactcagtgagtgaagatttggtttccattgtattgtattgtttgtgcagctgtatcaatgtacatgaatgaggaaggcaggcaggtcagttgttgaagagaagaagagcatattaggagtaggtgggaggggtagccggctggtgctgctcgtctttgaagtagttgcaggtgatgaagacgccgccgttgaagcactcggcgcgggcgcagccgatcctggtgaagttgggcctgaccatgaaggcgaagtggccgcactcgtggaagtcgacgccggcggtgcatttgccggtgtccctgtcgtagaggtgctcctcgtcgccccagcatcggacggcgtcggaagccctggcgttccagccgttcctcccgatgtagaggctctcggcgaagctgttgccggtggagtggcggatctggcagtcgccgcgcatggcgtcggaccaccgccgcgcctgcctcgccagcttgttatcccacctcatcggctgcagcccgtagcgcgcgcgcagctggttgtggccgtccacgaactcccgcggcatccccttgtaccaacccatcccattggtccacgacaccaaccaccccgctggtgccgatgctgatgcgtcgtcgttgaaccaacacatcgcgtcgcccacagacagcagcagaaaccaacacaatagcaatagtaatgggaggatcatcgcggcggcggccattgtctgccgtcgtcccgacgaggacgaggccgcccgccgatccgatccaatccaatagtgctaatgggcttcttatatcctagctcatcttttgccatttgcttttcttggatttgcctctcgctcttccaaccataaacaacgaactaataatgccaatgccaagtttaggcagtttttcttttcttctctgcatcgatcatatcatcatatcgcacggccactctgtccaaacaacaaagcctaacctccccgggcactggcagggcagctggctgggctctggctctaccagcttgctgcctgcctgccgtgtctcgtctgcttctacaactacggagcacctgtttgcaacggccaacggacggaaggaatgttttttttttttgtttggcttggattccatccatcctctccggcctgttcgtgtgtacgccttgtgctaggctaggctccacacacctggacattctactctcgatcgttcgcggtcgcggggccctcttctgttctgttgcgttaattgcggccgctttgctttcaattacttaatatctgttttaatttcttcgccacttgacatggttatgagtatgacagattaatatatgctatcttttttgtaagaaaaaccgttaatatatgctagctacgactgcatatatatgacagattatatacgtagtatatacttgtggttcgcaataacgaccagctagcttagctagcggatcaatcatacgacgttacgttacattatactagtacgtgatgatcaaagaatcatgcatgtcaagctcatatgtgctttgtatctactaccttacacttgctctgcttctttaaccggaaaagctgtatggctgctgaatgatttttgctcggaaaactaactatgccttacgctttcccttgctctgcttctttaattgggtcggagtgtgtgtacgtatatatgccgatatatatgatcgatatgatgcatccagccgcgcgctgtagaccaaactagctcgatcggattcaccctccgatcgggcgattgatcatgcaccaacagctaattataaggaaacaaaacagagataattagttatatactactccctccttcccaaaatgtttaacgttgactttttttaaatatgtttgactgttcgtattattaaaaacttttatgaaatgtgtaaaactatttgtatacataaaagtatatttaacaataaatcaaataatataaaaagaattaataattacttaaattttttaataagacaaacagtcaaatatttttaaaaaatagttaacggcgccaaatattttgggacagagagtagtatttagttactcctacctatacgttgttgttgatttcgagaggcgccgaccagccgctgatcgatcgagctacgtagctatctaggaattaatatacgacgaaagacaagttaccccatactgtatatgattatatatgaaatcaaatcaatcaattaactaattaattaaatgaagatgatgtgtatataaagacctacgtgtccggatgtatatataagtattccagtaagcaacatgcatgcatatcatccatataatgaaatcatgaatgaagatgtgtgcccctggcaccgtccatacgtaatactcgtacaattaacatagggtagtagcagtacatgcagtagcttatcttgtttattatctggacacacgatcgagtcatatatatatgtgcatccgaatgcgtgtggataacagctacctccaaatcccaatcacagtcacaatcagaatcgcatgtctttgatcgagtaggatcgatcacaacgaatggatatgtacgcatgcatcacctccatcccctgtctctcccgctctctttgaccattgcatatatatatatatcttcttcttttcttacatacatatataaataaaagaataaagattatatatatatatatatatagtaaatttgtttggtgctccatggtgtccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttaaaaattttgaaaaatttgagtgatttgtacattagataccatggtgcccgggcaccatggagcaccaaacaaatttaatatatatatatatatatatatatatatatatatatatatatatatatatatatatatatatatatatatatatatatatatatggagagagtgcatgcttgactgtcaacctagctatctagctacggatattatttagcctttgattgatatgatatataagaaaagccatatctagagtatttacactcgatcgagtatgtagctagggccgagtttagttacaaaatttttctttaaacttttaacttttctattacattaaaatttttctacacacacaaaattttaacttttccgtcacatcatttcaattttaatcaaacttttaattttaacgtaaactaaacaaatcctaacatcctagatagcgagccttgccaaatgacgtgtgtgcgcgcgggtggaattagctactgggggcggggcggggccggccgtcatacgaacgtggaagcgccagctagcacttgaattgcttgcttcctttaatttgtttgttttgttttgttttaggagcagaggaagttgaagtattttgtttgtttaattatggtgagagttaattttactttgggccatgatttattattaaagtttcactttagactaccctttgtccaatctttttactttaaactagataactttatctttattgcacaataaaccaccccaagcaacatcttcaatacttcaatgacttcaaggaaattgttacctacgtgccaacaaattttcatatatatatacataccatatatttgtcgaaagagacgctagacatcactagcgaaaagagttagggtggtccattatgtaataaagaaaaagttacctaatccaaagtaaaaagattatgtacagggtggttcaaagtaaaactttaacaataaaacatggcccaaagtgcaaatcactctgatgataatgactcttactatagtggaatggactaccgataccgaaagctaccagcacaacgtaggagtgcgtggtgtgcatcgcggccattaattatgtaagctatttagagtatgaccaattgttaccttcaattctaaatccaacccttttgacataggaggtcagcaccaaccttttagcgctcatctcaagcacaccttaacaaaataatatagacgttgttctctcattttcgtaatcttaagatatctcaagcataccttaataaatttgtagttgtctatattagaatatgtcacatctatattagagttgtatttatattaaaacgaaggaaatccatatattatagtagcagaccaataagatggtctagtggtttggggtagctgggcaactttattataggtcaagggtttgacaagggtagcaagagaaacattaattttataccactgtaatacaacaactactttcaaccttaatggaacaagtagatatatagtactccctccggtttcattttaattgttgttttagacaatgatacggtctacaaaatatacctttaacattatttttctattataatatacacaataaataaatgcatgtttatttttattatagtattttgaaagacaaatctatatatgttgttctactttctttaaactatatatttttgagacccggagggagtattaattaactaattaacacatggcgttgacctcctgctgacttagaaaatgtgcgagctcgatcggtacatatacgaagtatatatctcatgctggtattacgtacgtggcgttgatatatagtagtgccatcggacatgcatgatacggtcgtggtttattttgaaataagtttattatttagttttgaagatggcaatttggcgaaagctagttccggggagtaactactgtacatgaatttgggggcagacacatgttaggatagagataggaaggaaaaggaatagagcacgcacgcggcaggaggtgattgggagtgcaacgtcgtggtcggcgcgcggcgtctgcagggtcaaaaggcctggatgatgaagccgcgcgcaacgtgtacccgtacgcacgcgccatgcgggagcgggacgacgactcgatcgaatgacggacgttatgcttattccggtgaaagaaatgcgtgtcacacgcattccggtgacttgattttaagcaagcaatcaagctagctagcgccaccccgcggagtcaaccgtacgtggatccatgcatccatcgattcatgcttaattatatatatgctcctgcgtgcgagggccttaaagcgcatcaaatcaaatgactagctaatgcggtaatgccttcaacttcaaatggagtacctgcctatttacgtacgttgcacaatcaagcaaccacatccactttaattttctctatctctcttgagcctctgtttccttcctttacttgctgtcaaaaaagtggcatcacccccacctcacaatgcaagcaatgctgctgtaacatgatcaacgacagcatatatattgcgctacttgctgttaacgttaatgattcgactctacatagtaacgatggaagtacaggcggggaaacgaattagacacagttttcgtgttccttccccccggcggggtgggtgtcccttaattaaataacacgatgcaagtactacaagcgtaacacaacacacttgagcctaacgaatcaatttaattatctccatgtgtttacaaaaagagccacacagttcgctcttaatttactcccttttgttgaaggggaagttaatttacttggtgagatttgagcaaatccacaaacttgaaggtggttggcagccgaataatatgcgtttagttgttataggggctgtttagattgatgctattttcagccatacaaagttgacaaaaatttgttaccaaatttggtaaatatataaaaaatgctgtcaaaattttggcaatattgccaacttgatagggtttattttggctgcaatctgaacaggcctatggaaggaaggtaaaagaaagagggaccgacgatatatagatttcttaatagaagtggtgagtaggagtaataaacaatggagtgataatctctatctctatctctactattataaaaattgaaatgtttatgcggtccatcatccgtgtttgaggttcgtcatccgtatttgaagtcggttttctttggttttaatctatatctcttctctactattacaaaaactgaagatgtttttgcgggtattttgatacatcatccgtgtttgagtcgggtttttaaattcatttgcttttggaaatacaaaaggaatcatataaaaatctctttaaacaaacttgtatgctaacttgagatgaatgtcgaactcctaattgcagctcatgtttttctagaaaaaaaatccaagcgaattcccacggtggattaacagttataagattaaaatagcattcatccgttgcaacgcacggacattttcgttcacttttggtaatatagaagaaatcatataagaaatctatttaaaaaactcgcatgctagtcgtgggaagaaaactcgtgaaggaaggagaagattttgcaaagagataagaattgggcgtacacgtgggcggggcagatcgatcttagatacatacagattgaaaaagaaaaaaaagaaaagaagaaggagaggttgagggagggaaggaagctaggaaaaagggaaatactcctaaggaacgcggcggccgtttcccgaaccgtcgcgggcgttccctagttggactgggcggttccatcccagacgcaacgcgcagcggtcgtaggagtaggtgttttttttttgttttgcagttgccttctctcgaggccggggggctcggctatatatcctcctcctccccctcagttccgcacaaacacaaattaacctcctcctcttcttcttcttccgctctctagctttgctttgcttgcttcatcaaaccccacacacgcacacaacaacaacaagagtaatcaaagtagaagaagatggtttcggccttgttgcggacgatcctggtgacgggcggcgccggctacatcggcagccacaccgtcctccagcttctccaactcggcttccgcgttgtcgtcctcgacaacctcgacaacgcctccgagctcgccatcctccgcgtcagggaactcgccggacacaacgccaacaacctcgacttccgcaaggtcttccttccttccttccttccttacttaattctctctctctctctctctacattagattctgattttgcggttccttttattaatttaacaaaacaaaacaaccattcccatctcgataagcggcgcgcggcgatatatcataacttgtctttttgattagattgaaatgaaatcaattggattggattaatcatctcatctagtcaacatattactagttacttatatctgtattcgggcgacacaaatccaaatagtaactactcctcttcctccttagtaatggaaagttagagttcctacaaatatttttgtttgaattggagttgtagtcgttcgttttcatggggaggcggtcaattgaattgaattgaattgagttggtggagtagtagtggaaatgggaaaaaaaaacccaaggagggagggagggaggcgttggaaggcgccggacgcgttgttcccgcccccctgcttcatttctgttttgatttttcatggccaagcacacaacgcatgcaccacccaccccacatacgttccttctactttctttccacccatatataaaaagatcctttacaatccacatctcaatctcaaatataaataggattattaatactaataagctcattcccctggtgcattgcatactcataaaatttcttgcttaaaggactcaaaatctatcttagactaatataacatataaattattatgcaggttgacctccgcgacaagcaagcgttggaccaaatcttctcctctcaaaggttggttagtcttccttgctccttcaatttgcacttaagtacctacctttaatttgttttcatttttggttagcagcgtgacaccgtaaatttcagcataatatatatacaaactatagctattaaactatttcagcataatttcatcggtcggtcggtcggtcggtcgtttattccatgaatcaaatcaaatcgatcattgtcaaaataattactcctcatcatgtattacaagtattctggacctagctagctgctcagccagcctgccaggtcaagaatctggtgcttgggcagtttaatttgcagccgtctatcacgcacggtagctgtcacgctcatagtaccaaccaacgaaccgaaccttccttgtggaattaatgcattactatatatcacaggtgacagtccatcccttttgtacccaaccgcgtagtatactggagtactaataagcaatactatgatgaataaatgaagagtagtagtaggtattattatctgttttggcgaagatttgagacggacggacgctggtctgcttggctgcaggtttgaggctgtcnnnnnnnnnnnnnnnnnnnnnnnnnnnnnnnnnnnnnnnnnnnnnnnnnnnnnnnnnnnnnnnnnnnnnnnnnnnnnnnncatcactctcctgcaggtcatggccgcacatggctgcaccaaggtacagcccccgcaccatttcatttatttttctcccattgttttgctttgcctatatgtatatgcgtgcctcttgctggctttattggttggctggcctggctcttctttgcattgctgggggtcacaggatataccttatgcctttttgcattgctggggaacacaggaacatataccacagattacctacctatcacaaccactctgtgtctgtgtgtgttgtttgccatgcatgatgcacgggaatataaccctcccctcttaaaattgctgcctgcctggtcccactcccagccaagatttttttttttgttctcttcctactgccctctgatttttcttcttcctttcatcttgttttggttggttggttggttctgagcttactctggaggcggcatcgcaacagatttatacttacttaatccactaaaagtaaacatatatgctttagtttttaataatggacataatcataagctattttgctccggccagctggtgttctcatcatccgcaactgtctacgggtggcccaaggaggtgccctgcactgaagaatccccactttgtgcaatgaacccctacggcagaacaaaggtactccagttttttctcttctgttatactatattcagttcaatcatcatgcctaggatcaatcaatcaataaatcctaattaagccaaacaacatatatatgatatgatatgattgcagctggtaatcgaagacatgtgccgggatctgcatgcctcagacccaaactggaagatcatactgctccgatacttcaaccctgttggagctcacccaagcgggtacattggtgaggacccctgcggcatcccaaacaacctcatgcccttcgtccagcaggtcgctgttggcaggaggccggcccttaccgtctatggaaccgactacaacaccaaggatggaactggggtatgtatatgcattattcattcattctcaacaatcagtcgtatatgatttactaattaattttattccttgccggcaggttcgtgactatatccatgttgttgatctagcggatggtcatatcgccgcgttaaggaagctctatgaagattctgatagaataggtatatatgaaccctctcttgttgtgcatccatccacgggacgggacacatgaaaacatcatcatctcataaattaataatttattggctatattcttccaggatgtgaggtgtacaatctgggcactggaaaggggacatctgtgctggaaatggttgcagcattcgagaaagcttctggaaaggtaaactaacaggacaagtgtacttcctcttaattactataataatcattaattcccaacttgtcctttgcttttgttgatcatatgatgtcgtcctaacaataataatgccaacttgaacagaaaatcccgcttgtatttgctggacgaaggcctggagatgccgagatcgtttacgctcaaactgccaaagctgagaaggaactgaaatggaagtaagtatcaggatatatatatatatatagcatctcacatcatttcatctgtactgtaatgaaatgaaatattaaaatcatcatgtactctcttcacaccagggcaaaatacggggtagaggagatgtgcagggacctgtggaattgggcgagcaagaacccctacgggtatggatcgccggacagtagcaactgatccagctgaatataggcgtccaatcctccagtagcagcagcagcagcatgacttctatacatatatatatataatcataaagaatgaagaaacaaagaattcggacttgttgagttactactactactactactaatcccatctgatggaccgcattgtatagggggcttgtaggggtccagcagcttcatcatcagtctccttaggaggcctctaatataatctccatatttatggtagaaataaattttgcccaccgtggaagaactatataatagaatcatgatgatttgttgattcattgtcgcgtcgattcgtgcaaagacgtgtatgtatgtgcacgcccatcttcttcaagtcacattgcacaagttgaattgggccttaaaagtacctaaagttgatcttgggtgtttttccgtcaggacatacctttatgatttccgtatccatcccaacaagataaacgggccagccagaccatctccgaatcttcgatccgtttgtgtctctgcaggcccatgtaaaatacaaagcttgcgatataagttcactttaggtcactcctgttgacgttgaatctgaattccatccttgacctactacaccagaagatatagagtacccaaactatttttttctggtgccatgtcagctaaagcagcctataatactatcttaggactatatatgtaccggttttaaaaaatgagtgatgtactatatctagtatggtggttcaaggatgtgattcaaactgaacgtcaagataagagacctaaagtgaacttattccaaaccttacttacagggcttgctacagacacaataggcccaactttactacatttgcaacatacatgacaactagccacaaaactgtaaagtgataagtgaagcacaaacaaaaccacaaataccggtcatactcatatcacgatcttaccagataccttgtggtccgatcaccattagagatgataatgctatggaatacgttgtctatagagtagatatatatgatctgaatttaagaggaggggatccctattaagcgaaaatgagggtggtctagggactacttggaccaccccccttggaattgcctatgggtatggttagctattggctgagctaattagttgcacataaaacgaaatgggtaattgatgcatgattaattgaatgttaactataaataataaattcatttgattgtttcaataaatttttattatagatccaagtttttgcactctagtggtttaaagaaacgtgctcctaaaaatgaaaaggtagcccgaaccgaatagttatttggaactcagccttggctcatgtagataacctttcgaaccggctatgagacggagattatacccgcgtcaatctgaattattggccttgaggcaacttttgccattcatatcatcactaaagttaggagcataaatatgtacatcatctacttagttaatttgtgatttgggatgaatgatcttgtacaacttttacatcgtatctatacacgggaggttcgatcggtggcaacgaacgtgttgatcgataaagaagggcgccttgtgtgttgtgtgtaatcttctctctaaaaacaagctactaaaacagtaaaaagaaattgcactgtataaataaataaataaataaataaataaataaataaaattcaaactcaatattgtttttaacaaattaagaaacatatatatgcaaaagaaaaaaaactgaaatacgtatatatatgctactccagaaggaaattaaaagtaaatcgatctggcactagctagaaagaaatgaagaaatgacaggtagctagctagtgtgcaggaacgcgtgtgggtggaggaatggaatggaatgggttaggttagcggcacctctcccttccagttgcccggcgggtcgtaggagcaggtgatgaagacgccgccggcgacgcactcggagcggccgcagccgacgagcttggtgtcgttccagacgatctgggtgaagtggccgcacatctgccccgggttgcagctctgcccgcgccagtcgtagacggaggactcgccggcccagctcttgacggcgtccgtggcgcgccagccccacccggtcccccagaacacgttctccccgtacggcgactccggcgagtgcatcatcacgcagtcgaaccgcctcgccgccgaccaccgccgcgcgtacctggccagcttgttgctccacttcagcggctgcagcccgtactgggcgccaccttgttgtgagcatccaggaactcgtgcgccatgtacttgtacgtcccgcgcccgccgg

SEQ ID NO: 36567 - DNA, 8515 bp, Oryza sativa
cccatcaccccgtcctcccagcgtccctcttctcccaatgatccctccctcctacgctttcaagaaaaaaacataacccccttgtccaggaacacgtttgacgcactcacctcgccatattcaccacaagagctcgccattactgtttctctctctgtccggaccacgtcgtcgttgggtgtgctcccgctgttctggttttcttcgttgccaactgccagcatccatggacgtgccacattgtgggacaagtccgaccaccttactcgtcgatgtttggtaaacgaagcaccgtcgctcatcttctcttttgtttcttgtttggctagggaagacgatgaatagtgttagtcattttttcttcatttttctttctttcaatgcgttcaaagaaaatggaatcccctcatctgagaatgcattttgacacactcatccgatcatgttcaccactagagctcgccgttgttgtttctctctgtcggaaccacgtcgttgtcggtcgcgtttctgttgttctggttttctttattgccaacctccatcatatatggatgagtcatattgtgcaagatgtcctaccaccttccttagcatcatttggtcgcccgagcaccaacgcctatcttccctactcttttgtttctcgcctttgggaagggaagacgatgacctattggccactatttcttcttggtctagctcaaccatgctcttggacgactcacgtaatattgagactatatgaatatgaataggaccggaaaaattctaatttatgtctatgaaacaagcacctgttttgttgttcagaattattggatcggattttcatctaagaactgaaataagttttttttttcaattctagctaatttaagttgtttttccatttaggatattagttttagcactatttaattcattaaaaaatattgtaacctatatttttcctttgtattaaattatttatagccaaatgaaaaaaatggagatttagttacattttttttgagttattgttccggtcaaacctatgtgtagtttgatgttattatttttatgattatatttcctttcgttatttataccaaattgtgatatagggtttataattttaatttatgttatttagaatccgttgtaacacatggacattatgatagtgattaaaatacgactcaaacggttgattatagggggtatccaattgaatcggtaaaagtccttataaaaaggttgctattacataaaccgtgtctttccacatcttattagctaggcttaagttgtgttttagagaaggcaaagaagaagattgagaaaatacgtgaaacaaggtgagtcattctcgtatgactaattgggtattaattatttaaactttaaaaagtagattgatatgatttttaaaacattttttctatatttttttttcagaaaatgcaccatttaaaggttcaaaatgggtgtgcgtgcaagacgatagattttttctcccctttatggttgtctcaaatccaacctatcagttattctctccatcctaaagtaaacttatttttcacctatcccacgtataccaatataaaatccaaagactagagtacttctgctttatcaaattccaatacaactattgtctactttatccactcccagtgtatttatcctttactttcacaaacttcgacacgatgattacttagaaatgaatttattttaggaaaattttcaaaaaaaattattttaggaaaaactggaagagccaaaaaaaattattctgagatggaaggagcagctagactagaaataccttaggcctaaggacaaaaatccgtttataatgtactccctggttgttgggttgcatcaccattatctgtccacattttactggccaagtggtcagctttgcatgctttctgttgcactacacagccaacgatgggtccgtccatcatctagccatagacgatagttgcatcacgcacatgatcgatagtactattcgtcctcatcttcattgtctcatctttcagtagtggactggtatactcgctctgagtgcatgtagtatatgtatctcatcgatcaaaacgacacgacgactgcatgtacatgtgcaagtctgccctagatctgcactattatggccctgcttgacctactttgggtttatatatagggttaattagttccacgccattataaattcttcagcttagaaatatgccactaaaatttatttatttgtagcgataccattacaattttatagcaaattggtatatgccactacttacctcttcattgcattcataaacatatttagaccattttgccctcctttttcatctccctgtcttctttcccctctctcatgtcctaatcaggggtgggcagaaaaagaccaaaccgaaaagactgagaccgagattgaaaagaccgagactaataaattcggtcataggcagtgaaagaccgaattttgttcggtcaattcggttagtctcctcggttaaccgaatagaccgaaaaaaccgaattatcaaaaaaatgtctaaatgcaacctacaatccactatgtttaatagaattaaactctaattttcacatccctacttcttataggcatacaacctaataagagtctttactcataagtgcttacgaattttttttgtgatttttgtgttgaaaatttccatagtttgtttgcatatatgaaaacgttgttgaatttcagtaatgaccgagaccgaatttatcggtcctaacatttttcgctaaaattcggtcttcacttttcaaataccgaaagaccgaagaccgagaccgaaattttcagttagactgaatgcccacctctagtcctaatgtccagtgaacctcggacctccaccggcctcaaacacttcctctaggcgtttctttaccctgtcgccgaggaagacgagcagacgcttgcccgccggagtaggccgccatgctggagctccttcgtgggccaccggagcagctgtgcctgagccgtcgtgcgtggatccgtcgaggccgtgtccgggcgtcgccctcatgccgtcgtgttttgtcctctgctcgtcctcatcgtcgtttgcttgttgtcctcacgctgaatcctctgctcgtcctcctcggcacgcgggcgagcgggcaaatgagcacttgaagggaggatagaggccggaggaggaggagctccggtggagacatgggcttcactggacatgagagagagaagatatgggaaggaagaaaggggaagaggaagaagatgagggcagaatggtccaaaatttttcgtgaatgcactaatctcaaattacatcaaaattataatggcatcgttacaaatagacgaattataatgatatatttttaaactagagaatttataatggcatggatctaattaaccctatatacaattatacatacgataatccatcgatcatcatgcgttaaaaaagagagaacatgtcctaatatgatcgtgtaaataattagcatctactccagctagcgagttagctatctcgctcttgcatgtatatttatatatagtagtagtagtatttatatatcatggaagtgctcgtgtacaaattaaattaacgagctttttcgaagaaataagacaaataattccaaaaggagaacagaacaagatagaagaaagaagaaggcgacttacacgccggagaaggagaattgctagctggcgaacagtcaacaggtcgcggtccaaaacgaacaaattaataagctgtaaagagatggagaccagctagctagcaatcagcttcccagccacggatattaatttatcgcaggtgtattagctttctacgcgatttaatgttatatattttgactatttaaatctattataaccaactacataactaatactttcagatacaaatataatgaaactatatatgcatggcaataagtgccactattgatagttcaattgttaatgaaaaattaaatgtcgattttcttaaaaacgaaggaactatatacataccatacatcctaagaaaaagacaaatagtaagacatgcccacaaattatcattcttaaatttctttccagagtaaatttcataaaatcctaccttttatcattcaaattacacaaaaccacagagattttgacatgtgacatataacaccaggtattatagccttaaagttttcacaaaaccaccttgttaaccaaaattgccatattcctatattaaatttttttaaaaaactttatttacatttatatgatggataaataactcacaaatttgataggtgattgtagaactgaaaagtatagacgctcaaagtcaaaacaattaatagtgttgtttttgtgaatgataaggacatcctccactattacccgctaacaaagacacaaaagtcgggcggcgactatgtgagcctttgaataatcccaccttgcttagcttgggaggaggaaaccaccttaaaagggagagccacctgtcaggattatggataccatatacctaatagtagttgactaaatctcggtaagacccaccacataccatgtcttatacgaaaactgacctcggatatggagggagttccggataaggaaagacaaccggagttctacatggaaacgacaaggattactcgaagataaggattactcggattgtattcatattggtttccctagttctactctgacaaggggacacctatgggtataaatataagatcccctaggaggagaggagagacgaaacaatagatcaacatacaagccaacatacgccaagacaagccgccggatatcaacatcggagataggcctagtagtccccatacggtacctaagatacgactaccgtcaggaggatctagtgttgtctctgatctcgtcgggcacggattcgaggaggaagactactctgttgtcgactacgggatggttttatggctgccaagtcgacaacagatagataggctaccccaaatattgtactggtgtgattatggtaaataagagcaacgaccggcttcggccaacaggagtagggctattacctgacaattcaggggcctgaacctgtataaaaatcatcgtccccatctcttttacctcaatctcgcatatatcctagtaccaacgatccccatactatgcaaataccatagtcgtgacatcaaacgtcgacaccacccttcccctcttggactagtcttttagggagattaggcctttccccgagtgggtgtgcctaagaactgttggggtccgggcaaccttaagttattgggcctcggttgaccccacctgggccagattgttatgatgaggacatcctccactattacccgctggcaaagacacaaaagtcgggcggcgaccgtgtgagcctctctgaataatcccaacttgcttagcttgggaggaggaagctaccttaaaaggggagagccactcttcccctattggaccagtctttttgggagattgggtctttccctaagtgggtgtgcctaagaatcctccactattacccgccggcaaagacgcaaaagtccaagtgggtgtgcctaagaatcctccactattattcgctggcaaagacgcaaaagtccgagtgggttgtgcctaagaatcctccactattacccgctggcaaagacgcaaaagtcgggcggcgaccgtgtgagccactgaataatcccgccttgcttagcttgggaggaggaagcccttcccctattggactagtcttttagggagattgggcctttccccgagtgggtgtgcctaacaatcctccactattacccactggcaaagacgcaaaagtcgagcggcgaccatgtgagcctctgaataatcccaccttgtttagcttgggagaaggaagccaccttaaaagggagagccacccttccctattggattagtcttttagggagattggacctttcctcaaatgggtgtgcctaagaactgtttgggtccaagcaaccttaaattattaggtctcagccgaccccacctagaccggattgttattagtgaatcataatacatagagttaggtgtcatgtgtcatagggttatgtgtcaagtgtcagaatttctatgtgttttgtgtcatgtgtcagaatttctatgtgtttttacaacttactctctctatcccataaaaaacaaacctaatacgtgatatgaaacatcctagtactacaaaatctggacatacttatatactaatatatcacatcccgtaataggtttatttttacgtagggttaggtgaaatttactcttgtttttgaaatagtagtaattaattatttgtgctttatagggggtgtgaatggtcaaactctaaattttacacacatttataagtataaatacaaaataatagaaagtctagcgtagtaattaagttaagtggaatgtggatggcagttttaatttctcgcagagccgggtttcatactttcatgtgaatgatgatcgagttgttttttgaggcagtaatccgctatttattgccgtgtgggagaagagaaaggagagatggacggacaaaagtcccgtttaccgtaggagaggaccgtaaaaccgacgttgatgcgagcaattcacgttggttttttcctgacgtggagaagagagatcgaagagaaaagtagtcctgcgtactactccagctccggacatcagtgacggaaaaacacgactcgtcaaatatgagtcatctccaataaaccaaaaatatcctgattaatatatggctactggatagaacccataaccgatcacagttgatatatgatgagacataaccatggctataacatgtcacgtgtgacatatagtattatgaaccatcatatatagatgagaccactcatctttgacgggtctttaactaccacacgtgacacatcacagataaagttatctctgacgggtgctagttatgatccgtcagtgatgagtgaaaatttaaattttaaattttgcaaaaaatctcgagttgggacatgctctataaaagttgtagctctcgacgagatatatacaactttataactaacaacatttccattataattttgagttttttcaaagagtggtgctcttgtgaaaatgatttgaaccattcgttattaaggttaaagtagtaatttactaatatgtgattagggctaactttttcatttagtttttctctggctaaattgatctatggtcattccatgtgttgacaccactcatattccataaaaaaaggaaaaagtttggtcaatgctaaatgacaattataactctctgcacctaattgttttaacaaaaatacccctccatgtttctaatattgctaaccatggtgatagtacaattagatctgaatcttcgatcaaataagatcaatgatttagattgtcttctactactaagtagagagcacggtaatgggactctttttcaaatgacctggatgaaaacatgctttatatcaaagatatagagctcaaccaaatttacaatattataattgacaatattttcatttacaatattataattgacaatattttcatttgagatagtttacatactcaaatatccattataaggtgagatctattttgaaaaaaaataattctttaaacaacatcggatgaagatattctttacgtaaaagctgaacatgttgagaactataaatgtttagttgataatattttcatttaaagtcatttagagtattaaatatatgttaaatgatttggacacaaatagaaaaaaaataataacactgattgagtagtcaacatgtgatgaggatgagatttggtaagggtgctctttgtggaggcggaggtcttgagtttgaaactcataatacgcatgcatgtctatattacacaaaaaaatgtggatatgtaggttgtgatgtgtgaccttgtataggatggctagtaaaatctaaaatatttttttttactttttgttgctttaaaattaagagattgtcattcttgctttgtcggtgatgagtcgtaagagatgagtcattagcaacaggcggaagttacgacgacacgccactaatgacttatctgtgacggatgataagttatgacctgttacagatgacttaaatacccgtcagagatgagttatctgcaacaaatgttcactcgtcaccagtgatattttgtctttgctggaactagatccaaaaacttgcaaggggttgttgtattcttgctttctcttctataatgaaattggtagagctcctgccctttccttaaaaaaaagattttgtcatcactaaccatttatctatgatggggtttggacctgccagtgatgacctaatctgatgtagtgacgttaaattgttgtcgacagtaagaaaggaaaccgaggagttacggacgacgacttgtagctaagttttgataa

SEQ ID NO: 36568 - DNA, 1092 bp, Oryza sativa
  unsure (1)..(1092): unsure at all n locations
tgttatatggttatatatatatatatatatatatatatatatatacatatatatatatatatatatatatatatatatataatatatctccaagcgaactcctacagtgaatttcatcttaactaaaccatataacaatatattatatatatatatctccaagcgaactcctacaatgaatttcatcttaactaaactatataacaataataagaacaataataagattaaaatagacttcacctgttgcaacgcacatgtattttttctagtcttagaaaaaatctaaaccaatgatttattgtagaacaaccaataaaatcattagtacattatagaaaaaacaatatcaatctcgttaattgaccatataagagctcgatggatgggaacacttcccataagaagatttttcttctcgttagccgttacgacgagaagatcaagtactaactttttccccatcccatattcattttaacttttgcttattccaattccttaagcatttctattacatttttatcgttttcttggtgaagctagctagggcagctacgtgtatgtatgtatacacggtgccatttgaagtgaccagacaaatatgtcttgctagctggctaaaatagttgcctggtttaatttggaatgaaaaggccacaggatatgctagctaacttaggtgataatgatatgcattgctgctatatcacaccgtacaagaaaagagagaaaaaaagatagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36569 - DNA, 7375 bp, Oryza sativa
  unsure (1)..(7375): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaactctctgttgggccaattcagtctaacatagattggctggaggcccgcaaaattgatctcatagcgcaacttcaagagtgcaacgccgagctggatttggaaaaacaaaaattagccaatctcccaaatgctgtcgaagaacagaagtctagactgaaatcggctatcaagaatgtggctgatatgaccaagtccatcaaggtcattcctggaaccgatgcccaagacatccaagctattgaagaagtagatcaaattagagaatgggctgtgtcggctatctagcgttacttatctgaatgattatatttgtaataggacttagaaaatttttgtgattggctaagaaacgttggtactccttttgattgtcactgatcctttgtgtcgattaatataacttctcaatttgcttgaaatttctttacgcaaaaaattctcgacttttgtatatatgtgcccccctaattttgcaatgctgaaggcattgataaaattataatttagactaagggcgatatattaaatatcgtccatcatacatcggcagaacacaactgattagataataaaacaactaagggcaatataactatatcggccatcatacatcggcaaaacacaaccgattatgaataagaaaacaactaagggtgatataactatatcggctatctcaaggcgatgcaaacacatcggctatcatgtatcggcaacactcagccgatcatgcattaacccaaacacttggataatatttctttaagtacttgccattgagcgatgtccataaacttctccatcaagtccttgcaacatataagctcctttggacacaaccttatggatttgaaatggtccttcccaattcggtgaccacttgccgaatttgttatctcgagttcctatcggcaagatcagcttccaaacaaactctccttcagaaaaagacttagggactaccatcttgttataatgcttagcaatcctttcaatctggattggaccaaatcttccctttcatcggccatgagattgtaatattcatcggctgtcaattcgttttgtaattctgttcttcttaagccgattctaacttcccatggtaaaactgcctcatgtccataaagaagcttataaggaggaacttgaattgatccatgacaagccatccgataagactacaatgcttcggccaacctagtatgccattgccgaggataatcagaaatcttcctcttaatgagcttgatcaaactcttgttagatgcctcggcttgcccattagcttgtgcataatatggcgaagaattcaataatttgatacccatgctatcggcaaattgaacaaactcatcggtacatgaagatcgagccctgatcggttgtaatggtctgaggaataccaaactggtaaataatatgctcttgaacgaattgtatagcatcccctgaatcaactttcttcaaagaaatcgtttctacccacttggtaaagtaatcggttgccaccaatataaacttatgtcccttgcttgaaggtggattaatcataccgatcatatcaattccccaacctctgaatggccatggcttgataatagaattcatagccgacgccggtgctcgctgaattgctccaaacttctgacaatcttgacatcctttgtaatatctgaagcaatcttccaacattgtcggccaaaaatatcctgcctgccgaagcaaccacttcatcttatgagccgattgatgagttccacaaattccttcatgtacctcgcctatcgcaaccttggcttgatcagcactcaaacatttaagcaacaccccatcaatcatccgataacataactcatcatccaacaaggtgtatttcaaagctttatagagcaacttccgagaagctgattgagatggattctgcaaatattgaaaaatatcatatctccaatcatcggctgatatagtagcgatttccaccttgatatccttcgtcatcggcttgtaccccgatgctccctgagccaaatcattagcttcaatattttgctctcgagacacatgtttcaaagttactagccgaaatccatccatcaattctcggcacttttcattgtaaaccatcaacgtatcatttttgcattcatactgtcttgccaattgactgatcaccaacaaagaatcacccataatttcaacagcatcagcttcaacttccttgagcaactgcaatcctttgagaaccgcttcatattcagcctgattgttagttgcataaggcttaatagtataggcaaactcgaaacttgcaccccgaggagaaattataactaagccgataccacaaccgtgagtgcacacggatccattgaaaaacaaagtccaaggcacaatatcgaccgagccaattgagtcatcacgatgatctacaataaaatggctatagcttgtcccttgatcactttcggagactcataccgcagatcaaactccgttaaagcaaatatccactttccaacaattcctttcaaaattggagccggtaacatgtatttaaccacatcggctttgcatatcacagtgcattcattggacaatggataatgccttaacttcgtgcaagagaaatataaacacaaacacaacttctccacaggagaataccttgtttctgcatccaaaagcctgcggcttaaataaaatacggctctctctttcccctaaagctcctgaatcaaaactgagccgatcgacttctcaccggccgatagatataatctgaaaggtatccccttctgtggagggattaaaactggaggagaactaagatactctttaatgttatccaaagccttctgttgctctgccccccaggtgaattcttgatcggctttcaatctcaacaacagcataaaaggttctaacctgctagacaaattagaattaaacctcctaacaaaatttaccttgccgatcaactcctgcaacttcttcttgtcctctggaggttgaatcttcttgattgcattaatgctcctttgagtcacctcgatccccctctcatgaacaagaaaacccaaaaactggcgagccgatacgccaaaagcacattttgtcggattcatcttcaggccatattttctagttctctcaaaaaccttcctcaaattggctatgtgattctctatttcctttgatttaacaaccacatcatcaacataaacttcaaccaaccagccgatcaaatcatggaatatgtaattcatggccctctgatatgtagctccagcgctcttcagaccaaaagtcattacaacccactcgaacaaaccgattgcaccagggcacctgaaagctgtcttatgaatatcctcttctaccataaagatttgattatatcctgcattgccatccataaaatttaatatcttatgccccgaagcagcatcaaccaactgatcggctactggcattgggtactcgtccttcagggtagctttgtttagatcacgaaagtcaatgcacaccctgactttgccatttttcttgataactggaattatattggaaacccactcagcatatcggcatggacgaataaaatcagcatcatataaacgtgcaacctcagccttgacagcctcaagcatatcggctttgcacctcctcggtggttgctggtatggtctaaccccggttttgataggaagccgatgttcgacaatcgatcggctgagtcctggcatctcataatactcccaagcaaagcaatctctatattcttttaaaagctctatcaacttggttctaaattctagagataaattcttactgataaatgtcggtcttggtctatcacctggacctatatcaatttcttccaaatcatcagccgacatgaaaccttgtccttgcttgtcatcgagatcatctactgtgtccttggtgtagacgtttgaaccctccacgacgccctcaaaataataatttgggctctccatcttcaattggttgtatatcacaatcggacactcttagaaaatctccatcccaaactttcccagacaggcaatcaataccatccatctcccaaagagctaaatcggcactggcaacgttaactgacctatcggccggcacgatctcaatcttgtcgccttgccattgaatcaaggactgatgcatggtcgaaggaatacaacaattggcattaatccaatcccttcctagcaacaggctataggaacccttcctatcgatgacaaaaaaatgttgtaggaacagtcttgctgtcgactgtcagctctacattcaaaactcccttattctccgatggattgtcaccaaaatctttgagaaccatatttgtcttgatgagatcctctgaatttccgcccaactttctaaatatagaatatggcatcaaattcacagcagccccaccatcgaccatcatcttagacatcggcttcccattgacataaccgttaatgtacaatgacttgagatgccgattctctgttccctccggtttctcaaaagatcgccgcgcgaatcacaaagtgtgtttttgccacgaacgcacccaataccctccaatatgtccaaaaatcatgttttggcgttttttgaactttttgattccagtacaaaacatcgcaccctcgtgtgccaatattggcattaattgacaaaagttcgccgcgcgaatcacgaagtgagtttttgccacgaacacacccaatacattctgatatgtccaaaaatcatgctttggtgctttttgaacattttcattctgttcaaaaacatcgcacccgtgtgggccaatatatgccaatattgacattatttgacaaaagttagccacgcgaatcacgaaatgtgtttttgccacgaacacaccccatacgcaccaatatgtacaaaaataatgttttggctcgttttgaactttttgattccagtagaaaacatcgcaccctcgtgtgccaatattcgcattaattgacaaaagttcgccgcgcgaatcacgaagtgactttttgccatgaatgcacccagtacactccaatatttccaaaaatcatgttttggcgtttttgaactttttcattctggtcaaaaacatcgcacccgtgtgggctaatatatgccaatattgacattatttgagaaaagttagccacgcgaatcacgaaatgtgtttttgccacgaacacacccgatacactccaatatgtccaaaaatcatgttttggcgttttttgaactttttgattccagtagaaaacatcgcaccctcgtgtgccaatattggcattaattgacaaaagatcgccgcgcgaatcacgaagtgtgtttttgccacgaacgcacccaataccctccaatatgtccaaaaatcatgttttggcgttttttgaactttttgattccagtagaaaacatcgcaccctcgtgtgccaatattggcattaattgacaaaagttcgccgcgcgaatcatgaattgagtatttgccacgaacgcacccaatacactccaataagtccaaaaatcatgctttggtgctttttgaacattttcattctggtcaaaaacatcgcacctgtgtgggctaatatatgccaatattgacattatttgacaaaagtaagccacgcgaatcacgaaatgtgtttttgccacgaacacacccgatacacaccaataagtccaaaaatcatgttttggctctttttgaactttttgattccagtagaaaacatcgcaccctcgtgtgccaatattggcattaattgacaatagatcgccgcgcgaatcacgaagtgagtttttgccacgaatgcacccaatacactccaatatgtccaaaaatcatgttttggctctttttgaactttttgattccagtagaaaacatcgcacactcgtgtgccaatattggcattaattgacaaaagttcgccgcgcgaatcacgaagtgagtttttgccacgaacgcacccagtacactccaatatgtccaaaaatcatgttttggctctttttgaactttttgattccagtagaaaacatcgcaccctcgtgtgccaatattggcattaattgacaaaagttcgccgcgcgaatcacgaagtgagtttttgccacgaacgcacccaatacactccaatatgtccaaaaatcatgctttggtgctttttgaacattttcattccggtcaaaaacatcgcacccgtgtgggccaatatatgccaatattgacattatttgacaaaagttagccacgcgaatcacgaaatgtgtttttgccacgaacacacccgatacacaccaatatgtacaaaaatcatgttttggctctttttgaactttttgattccagtagaaaacatcgcaccctcgtgtgccaatattggcattaattgacaaaagttcgccgcgcgaatcacgaagtgagtttttgccacgaacgcacccaatacactccaatatgtccaaaaatcatgttttggctctttttgaactttttgattccagtacaaaacatcgcaccctcgtatgccaatattggcattaattgacaaaagttcgccgcgcgaatcacgaagtgagtttttgccacgaacgcacccaatacactccaatatgtccaaaaatcatgctttggtgctttttgaacattttcattccggtcaaaaacatcgcacccgtgtgggccaatatataccaatattgacattatttcacaaaagttcgccacgcgaatcacgaaatgtgtttttgccacgaacccacccgatacactccaatttgtccaaaaatcatgtttgggctctttttgaactttttgattccagtagaaagcatcgcaccctcctatgccaatattggcattaattgacaaaagatcgccgcgcgaatcacgaagtgactttttgccatgaatgcacccagtacactccaatatttccaaaaatcatgttttggcgtttttgaactttttcattctggtcaaaaacatcgcacccgtgtgggctaatattgccaatattg

SEQ ID NO: 36570 - DNA, 3264 bp, Oryza sativa
  unsure (1)..(3264): unsure at all n locations
ctctttttgaactttttgattgcagtacaaaacatcgcaccctcgtgtgccaatattggcattaattgacaaaagttcgccgcgcgaatcacgaagtgagtttttgccacgaacgcacccaatacactccaatatgtccaaaaatcatgttttggctctttttgaactttttgattccagtacaaaacatcgcaccctcgtgtgccaatattggcattaattgacaaaagttcgccgcgcgaatcacgaagtgagtttttgccacgaacgcacccaatacactccaatatgtccaaaaatcatgctttagtgctttttgaacattttcattccggtcaaaaacatcgcacccgtgtgggccaatatatgctaatattgacattatttgacaaaagttagccacgcgaatcacgaaatgtgtttttgccacgaacacacccgatacactccaatatgtccaaaaatcatgttttcgctctttttgaactttttgattccagtacaaaacatcgcaccatcgtgtgccaatattggcattaattgacaaaagttcgccgcgcgaatcacgttgtgagttttatccacgaacgcacccaatacactccaatatgtccaaaaatcatgttttggctctttttcaactttttgattccagtagaaaacatcgcaccctggtgtgcctatattggcattaattgacaaaagttcgccgcgcgaatcacgaagtgagtttttgccacgaacacacccaatacactctgatatgtccaaaaatcatgctttggtgctttttgaacattttcattccgttcaaaaacatcgcacccgtgtgggccaatatatgccaatattgacattatttgacaaaagtttgccacgcgaatcacgaaatgtgtttttgccacgaacacacccgatacactccaatatgtccaaaaatcatgttttggctctttttgaactttttgattgcagtacaaaacatcgcaccctcgtgtgccaatattggcattaattgacaaaagttcgccgcgcgaatcacgaagtgagtttttgccacgaacgcacccaatacactccaatatgtccaaaaatcatgttttggctctttttgaacattttgattccagtacaaaacatcgcaccctcgtgtgccaatattggcattaattgacaaaagttcgccgcgcgaatcacgaagtgaatttttgccacgaacgcacccaatacactccaatatgtccaaaaatcatgttttggctctttttgagctttttgattccagtacaaaacatcgcaccctcgtatgccaatattggcaataattgacaaaagttcaccgcgcgaatcacgaagtgagtttttgccacgaacgcacccagtacactccaatatgtccaaaaatcatgctttggtgctttttgaacattttcattccggtcaaaaacatcgcacccgtgtgggccaatatatgccaatattgacattatttgacaaaagtttgccacgcgaatcacgaaatgtgtttttgccacgaacacacccgatacactccaatatgtccaaaaatcatgttttggctctttttgaactttttgattgcagtacaaaacatcgcaccctcgtgtgccaatattggcattaattgacaaaagttcgccgcgcgaatcacgtagtgagtttttgccacgaacgcacccaatacactccgatatgtccaaaaatcatgttttggctctttttgaactttttgattccagtagaaaacatcgcaccctcgtgtgccaatattggcattaattgacaatagatcgccgcgcgaatcacgaagtgagtttttgccacgaatgcacccaatgcactccaatatgtccaaaaatcatgttttggctctttttgaactttttgattccagtagaaaacatcgcaccctcgtgtgccaatattggcattaattgacaaaagttcgccgcgcgaatcacgaagtgagtttttgccacgaacgcacccaatacactccaatatgtccaaaaatcatgttttggctctttttgaactttttgattccagtacaaaacatcgcaccctcgtgtgccaatattggcattaattgacaaaagttcgccgcgcgaatcacgtagtgagtttttgccacgaacgcacccaatacactccaatatgtccaaaaatcatattttggctctttttgaacattttcattccgttcaaaaacatcgcacccgtgtgggccaatatatgccaatattgacattatttgacaaaagttagccacgcgaatcacgaaatgtgtttttgccacgaaaacacccgatacactccaatatgtccaaaaatcatgttttggtgttttttgaactttttgattccagtagaaaacatcgcaccctggtgtgccaatattggcattaattgacaaaagatcgccgcgcgaatcacgaattgagtatttgccacgaacgcacccaatacactccaataagtccaaaaatcatgctttggtgctttttgaacattttcattctggtcaaaaacatcgcacccgtgtgggctaatatatgccaatattgacattatttgacaaaagttagccacgcgaatcacgaaatgtgtttttgccacgaacacacccgatacacaccaataagtccaaaaatcatgttttggctctttttgaactttttgcttccagtacaaaacatcgcaccctcgtgtgccaatattggcattaattgacaaaagttcgccgcgcgaatcacgaagtgagtttttgccatgaattgatgaggacatcaacaccatcgatacatccacgtccccccatgtatagcatgatggtcctattacccgcgctcgtgcacgtcaactaaattatcaggtgagttctttcttgagttcatattcctcgtctttataccccggagacgcgtgcactcgtgttttactcaggaacgatggagaggatccaaagggaagaggattcgcgcggggtggattaggactgcagggcagcaccaacttctgacggccgccacgacttcatgcgaactccgatttgggcgtgcaagtacttcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36571 - DNA, 1013 bp, Oryza sativa
acccatgacattcagaacgcccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcatggagaccaccttggcgggcactctcagtgtctatcagaatgccacgggcaagatctgcggtgtctggcgacga

SEQ ID NO: 36572 - DNA, 197 bp, Oryza sativa
tattagaaccaaaaagtaaagacaaggccgattgaagaaggagatttagtcttgaagaaagtgctcaatgaggtagctgttggaaaactcgagtcaaagtgggaaggaccattcatagtcaaaaagaagacagaaacgggagcattcaagttagcatatcttgatggtgatgagttaaagcatacttggaatgctat

SEQ ID NO: 36573 - DNA, 727 bp, Oryza sativa
cctgaaaaaatttatcccaaaaatggtcctttatagcgcgccagagtggctggcgccgtcatccaacgggacggcgccagcatgccaccgtggcgcatgcgaaccgacgtggcatgaggagggcgccagccatactggcgccgccccagggaggagggcgctagcatggctggcgccgtcgcctccattcctgtttctctgtatggagttgcaacggtgtcatttttattttatttttttggatttttttttcacactcaagatcacgatacaaccaaccacaaaaaaaattaaactcgaactaccacttagctaagtctgaaaatagttagcataccacttagtctactttgcaccttcactaaaattagaccataattcatttagtaaaaccctttgattagcatgttaaatataatgcactttaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacttgtagaattttccaaaactctaccgaaacggacaaaatatgtcatctattaaaataggcgtaactttctcatacggactcggaatcaggcaaataatatatgcacgaacatct

SEQ ID NO: 36574 - DNA, 1126 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacg

SEQ ID NO: 36575 - DNA, 1621 bp, Oryza sativa
ggaaatagcttgacctaaagtttaaacaatgagtgcacaagtctgtataaaaagacaagaaccttttgttatttgttagatcatcaaactaaaatgcgattgaaaagtgcagcttgataattggtaacagacctaggagaatgggaactgttaagaatcagagaaaagcaaaccgttttcaacatgcttttaggacattttctctagaggaaatgaagacttttttgggtataggtgagtaaagtgtatcttgtgatgttcagtgtactgtacttatgtttggtgcattggctgttgagatattacacaattctgctatatgcatgcctgcaatgtgcacaggacacccttgtactttttttgataaaggtagctatttactgaaaaaaaaaagacctatttggttagggtcatgtcacagtagagtgcctagctggcgcataattatgtctgataaaaaaaagggtttcatatatgtcttttggtaacacttgattttttttttctttttgctcactttgttttaatacagaactctctctgaaggttgacacattttccttggtgtgatcaggagatactggtatttgttcactagccaaggacatactttatcaagaatacactccaagggatgattaattatttaatcaagggaaaaggatactgcagcgtcaaggtaatttccaggattccaccagtcatatgttagttttcttttattttctgcttctctgaagttcttttcaacctcacccccagacaacatttttttctaatatagttctgaacaaacagcaataacttggtgcaaggtttgatctccaatctgttaatgactctgaaagtaatactacctccgtcctattttaagtgtagccatgagtttccgtgtccaacgtttgaccatccgtcttattttaaattttttattattattagatgataaaacatgaatagtactttatgcatgattcatttttgttaaaattttcaaataagacagacggtcaaacatttgacacggaaaatcacaactgcacttaaaataggacagagggagtaccgagttattcatgttggacatgctacaaagatttggcttattgtggatcagttcacctgttgccatcatatacagcaacacttcgcaatcaatggataccaaaagcagaaagagaactaaaagtagagtcagtaaagcatctagatttcacagctgatgcatcagatgcaatacacaagggcaatttaatcaattaaatcattaagctagaacaagacagtgggctcacggcatgtatacatcatatagtggataatggagatatcctgcctatcctacatgttgctgctatctgaagtatgtgcagaagacaacgtggcctacattcttacagcttttcttggaccaaatatgtttcctagaattgacaattcgacaagataagaatctgcagactgtaacaaggctgtacgcgtaccgatgatgattcaagtaaatctgatttggtaggcttaaattcccatccgcggctatagaaacatcgttacttttccatttaaagcagaaacataattacttgatggatattatcaaatataactggggcattgagtt

SEQ ID NO: 36576 - DNA, 18156 bp, Oryza sativa
  unsure (1)..(18156): unsure at all n locations
atagattcactttcaagcttgaagaaagcaaaggaagaagggcatccttatctaatgcgggtcacatctgttcgacagctctgaagatccggtgtcatttggaccacctgccctgctgcagtggtaactttcttcatccacacactttgaaattctttagcaattactagcttctaaaccatattaattccaatagatccgcagaccaataattagctccacttaagttcacatgttgctacagcttcatgtagccgttactcgggcggtcggccgttggccagctgcagcctgcagataccggagcatacaatgtaccctgcacatgtggagccttgctctatacatctcacaatccaaaattttgacaacaattcctagttaatactttgactccacctgttactagctgcctgacgcagaaaattggcaaatgcctgtaccactgtgcaaggctttggagttcggagcttaaatggcacacctctccatgtgggcagataaggtcgtcctgagaatgagctaccgacccacgccctctcttcatgctgcagccaccgacactgtttgaatttctgcactaatgaattgctttgctactagtaccacccaccagggattattagttgctgtaagagacagttttggaggtttgcttgatctcatgattcatcagctcgatcgttttgtaggctactgcacagcacagtgttgtccgagagctcagtttcagcaaggaggggggggggggggggttctgtccaatcatgggcatgccgatgatgggcaatttcattgtaaagggtaccgacacatatggtgagtaccatagcattaaaacgtctagcgagatatactttgtatacgttaattgctcctttatttgttgatttttttaggaagattttatttgttgatttgatcctactggttaaattgtctggtcagtcatgctaaactgatcatggtaacgggccagaacttacctgcaaatcatcagatatataaatgtcagtcgtcacacctaaacaatatagaatgatgccgacaattaagagcaacattctttaatcctgatatcgtacattttgaggtcgtagaacatgtaaaaagaatcaacaaatggaaggcaaatgttgttccaggtgtgcatttcttttactttagtcatccaaccgtcctctagatccacaagaacattgctaaagtctccgggcaaatggatcgaataaaaagccttttttagatcgcttagttgtttcaattccatcagatcggaacctcgccataatgcaagctttacttgtcatgattctctagaagaaaggcatcaaaggagataggtaagaagaatcggttcggtacgcctctttaatcaggctcacgtacggttgatccattcagatcattcaagaagccaagggggtcctacttgatcgcactaagcacataaataaggcctaatgcaaccaaaaggttgtgcccccaacaaccaaatcagaagatactgcagcagtctgcagctaggattagtataaccatcctagcatttgtacattactagtcgtaatattttgtttctccattaggtgcttgatgatatcccctactatggttactctcttcaaaagcgaactgaaaatgattgtttttccagcaaactgaaaatgattgtttttccagcagggtttgaaggatcgcctagctggcttatcctgctactaataagttgacttccccagggcatccagtatttggtggatctgcttccacgtagcactgaactgggtcagtactttactaatcagctatcagggccgtagtttatgggaaatgcagttatattttccaaggcaaacacaactctactatatccccaaatgcactgttttccaagacaagcatatcaattctgttacaagcacaagtatacatcccaaaatggtgaggttttcatcagaaagggaattgcatgtgaatgcagctaacggatcggggtataattcaagctggattattcgatcctaaccttcatcttcaagcaatcaaattaacagccctgtttaacaaaagtttgagagattttgaatgaggatccgtgcatgcagcaggaaagtcggcacggaagctggagatgaaaagctgaaacatgatttcttttcaaagaaaaatgaaaaaaaaaaaacagcagcactgcgctggcagccggagccaatgggcgaggggcacgtgtccccggattcctcgaccgaccagggagactccgcacgagcagggcacgtgacggacgatccgctcgtctttatatacggctaatgcgtcgctggtgagtttacctgcatcgcatcagctctcttgactcctctctcttcgtctcagcttggagctcagtctttgatttttcttcttcttcttgtttgtgcaattgtgcatcgttgttagctgggaacaagcagaagaatggcggacagcacggcgacctgcatcgacnnnnnnnnnnnnnnnnnnnnnnnnnnnnnnnnnnncttcttcaagttcggctgcggggtaagccgccgttatctacagtttttgcactgggactactttgatctttccatgcagcatgtctcctcctcctgtcactatgtgtagttaatcgtctgtggtgattgatttgcagattgagttctggatctgcttgctgctcaccttcttcggctacctccccggcatcatctacgctgtctgggtcatcaccaagtaggaggagaattactacccttccaaggtaagcatggctctgcatgcatcttcaagaacttggagagtttgagtacacaaaattttgtgtcggtgtttcaggaaaaaaaaagataaaaattgctgaacaagtgtccgtggagtagtagatattaggttactactagtaccattaacaacagaaagaaggaaaggaacatctcgcctactgttctctgatctgtttttgctgaggtgtttcaacaatttagctaataattaagtcgcctgatcgaggttcagaaagtgactgactaacttatctttttctgattttcttattatcaggtgatggtgaattggtgatccggagcctgtgattggttgtgcctggtgtaagcggcagttgtcaaagctgtgattttctggttctttggacggatggtgctcgctgtggtgttgtgtatgctgtacatctgttttggtgttgtgcttaggtccctcttctgttacaacaattgttttctccctgttcttccggggtaccttctccagtttatcttctgcaccttctcgtccctgtactttgaatattaattaattaattaattaattgctccttgttagccatctgctcaaagagtaatttaagaatcgtttgacaaatgaattcaatgtcctgtgaatgtggtcgagggttgcgaatttcaagcggatgtgaccaatcaaatggtggccatttttcatgtttctagtgggtgggcagtcactatctagatttttttgtatgtaatatttatccatttacatttcactgtattattgcttctctattctttcatcaatttgaagaggcgatgaattgaattgatgatgacagcggctgacaggtccccccacactgccacacagcatgccatgccagcttacacactggcaccgtgccatgtgctgtgtactggtagctactacgttgcatagcaccgtagcaactgtggaaatccaagactactgcccgtttcaaaatataagtatttctactcgttttagcataaactaaagttaagatgagaagttgttttgaatagtagagaagttgttttgaatagtaggtgaagaaattaattaagagatgattgtgactagatgagataatgaagtaggcgaagaaaatgttgtcttacaaattttgaatctaaaaatccttatattttaaaacagacggagtgagagacagtcattgcaggcttgcagaatgggccgcagggccggtgcgcgcgtcctgggctggagatgggctccgtccgtccactagctcgagacaaccatggtccatggacctgaactcatgtgaggccttttgtgctgtcaaattttgtcagtctcctgaaaaaagagactacaccaacctacatgtagaacgtgcatgcacaaatctacaacgaggcgatagtagcggtatcagaaacatgcaattcatccatcacattcagatatgcagcaaaaaaaaatcgtaatttcagatatgcagtatattgtagaaaagcggttcatttggcaagaaagaggaacagaacctccagcactagaataacaagagaaataaactaacaaaagaactgagcatcaatccgatgcttttactgttccccgatgcaactgaggaaaaaaaatactccctccgtcctacaatataaggtattttgagtttttgtttgtaacgtttgtccactcgtcttattcaaattttttttgcaaatataaaaaacgaaaagttgtgcttaaagtaccgtggataataaagttagttacaaataaaataaataataattttaaaaaaaattgaataagacgagcggtcaaacgttgcaagcaacaactcaaaatcccttatattatgagacagagggagtagaggagtaggagccaaggatttgaggcttgtaagtttcatagattttgccaaaagtacggaataacggcagccagcatatacaaataacaccataataaggtcatctagtcttccagcagaaaaaatacacaagacactttggaccaatggcctgcgttgttcatccagacttaagagcatcattatctcagaaataaaactcccgcttgcaaggaaatagaaatataccaatttaactaagaatcgctacctaggagtattcaagtgtcaagaacattggctgattgaatgattgatagtcatttggtcaccaatatcaaacagtagaccaatgtaaggtgtaagcaaaactcactgcactaactgaattatgtgtcgggtgtttcaggggaagaaagatatagcattcagagagttgtggcttgtcaacaaataccacaataccatgatcagatcatctaagacttctagcaaagaaaaacacaagacgctatggaccaattgtttgccttgggttttaaggcaaagtatgtgttaagtttattcagagcatcaggggtctaagaagtaaactcctgcctacagggaaacagaaatttaacaatttcaactaagaattgctacccactacctactattaaacagtcaagaacatcaacgaatggatcacataatggtatggccgcctatatcataaagatacagtaaacatgacccattgcattactgtgaggtgtaagcaaaactcattgcattaactgaaaacaggaacagcaatacatggctcattgttcaacaagttcaatggaaatatcgctacttaccacagtacttcacagcagtaaaatggtagtaattcaaggatgggcattaggcctttgaaaccattaatggttgaaaagggatcacagcaaggaaagataggcatctcaaactccctacaaccgcagcaaaaggatacattcagccaatgcgtactataattctacctattatgcctcctctgtatctcgactcttcttctttttcttctcctttttcttttcgcttttctcagcttccacgccatctccattggctgcgctctctggatccacaacatcacctccttccttgctcttcttctttttctttttcttctcactgccaaccttctccccatcagatatatcagccttctcttccttcacctctgcatcacctgatccttgttcacccttgtctttcttcttcttcttcttcttctcactcttctccccttctacctcctcagcactctcttcaaccttgatcttctttacaggcacagaagcagacgcgtcatcatcctcaatcttcctcttgcggccttcgtcggcagcatcctcctcatccttgtgcttcttcttctttttcttctccttgacctcttcagtcgcaaccacatcctgttccgccttcaccttggcctcttcaggagcagctgcaatgctagcgatcatcgcatcaccaccagtaggaagtgccacattccggatccactcagctggggtcttctcatttggcttcccatgcttatccagtaaaccctctgcgaccatctttttcttcttgagcgcaaccggaccaagcccccacttcctcggatacgtgtctctatccatcaccaccctcttaatctttgcgactgcaccatggtcacaagtcgccataacagcggtggtcatctcggcaataccaatagcaatggcctctcctttagtggtcatgagaaccacctcctccccgacatcgatatcattttcaaaccggagcaacccgggtatcataagcttagcaccatagcatatagcattgacagcagagtccttaacaacaagcctcttgtagctagtaagcaatacctcgagaggcatcacgatgcgccgcaagtaagtctcatcgttgtagttgtccatcgcccacctcgcgtccatgacatcgtgcatcgtgaccatgttatcctgctccccgaggatccccgatcgcacgcggcgcagctcctgcatatgcgcgccgacgccgagcagcaggccaaggtggacgcagagcgtcctgacataggtcccggcctcgcaggagatccagaacacggcgaggtgccggtcggcgtcgtgctcgagcagcttgctctcgtagatggtcctcaccctgagctggcgcttgacggcggagatgagcgggggccgctggaacacggcgccggtgagagcctcgagcgcgcgggcgacgcgggcggtgtcggggactgcggcgtggaagcgcgcgacgcagacgtactccttgccggcgccctgctgcgacttgacgaggcgggtggcgcggtcgacgcagacgatgaggttgccggtgaccttggggtcgagcgtgccgctgtggccggtcttgtcgacgcggaggaggcgcttgatccaggcgacgacctcgtgcgaggaggggttggagggcttgtcgaggttgatgacgccgtagcggaggtactcggcgatggggcgcttgagcggcgagtggccggaggggagcggggtgtagtggccggtgcggacgttgaggcggtcgtagttcttgaggaggagcggccatgtcgaggtgtcgagggaggggaccagcgactgcggcttgatgaggtagccgtcggtcttcgcctccgcctcggcgagggacggcgggtcgacggcggcggcggtggcggcgtccttggacttgatcttcttcttcttggacttggttagctcggaggagggggaggcggcggcggccggcggcggggaggacatggcggcgggttggggggaggggattttagggtttttgcggcggcgaggggaagaagaagaggcgttttaagggggaagggtttagtgggtgcgagatggtgcgatgggggaggtggtgattgagttgggctgagccgtgggcccatgagagttatgctgtaggacggagactgtaggacttgggctgggccctgggctaatgaggccggagactgtagacctttataatataatttcaccgttttaataatttgtaaaaaaaaaggagtaaattgctctttttaccgctcttccgccttggacatgggtaaaccaactttttcactctaaatcaggcctttttcttcaaaaacatttcactttataactatgtttatcttcggtttatcccctctctcttcatctctaccagagaaagcacgtcaaaatctcaaccctccccaccttacaacaaatacgctcgtagcaatggaggagactaagctcaactgctctcggtgttgtccatgcttgagatctacatgcattggtgtcgatgctgggatgtggatattggattttcttagcaaacaggctcgaccacgtagtggcgggtgctacgaagctcaagaaaatgcaacaaaggatgtggaaacgacagagacaaagctaatgcgatagatgtcaagttgactattgggcactttgtagatgtatctctattgtatgtcataagcttcaacttgcttaagtatgccatccgcgcaataccgctctcgaaggcctcctcaagtccaatggtgctatcggcgtacgctcgattgggttgggatgtcaatacctgattgctagacctactcaagcaatgagaggaaaggtgggagctaaataaaagaaatatgccaaattgaaacattttggaaaagaaagtaaaacaagacctgtcagggttatggataccacatacccaatagtaatcggctaagcacggcgggacctaccacatactaagtcttatacggaattatacctcgtatatagaatgtgttttggataaggaaggataaatagagttctatataaaaacgacaatgactacttggattgcatccatattgatctccctagttctacttagataaggggcacctatgggtataaatacaagccccctaggaggagaggggacaagttacaagaccaacaagacacacgccgccaaatatcgacattagatattagcctagacataccccatctagtgcctacggaagccggcaagagatatctagcgcaatctctgatctcgacgagttcatattcaaggaggaagactacccctgtcgtcgactacgaggtagttatctatgccgccaagtcgatgatagctagataggttatcccaaatattgtatttgtgtgtttcagatgaataatagcaacaccggtttcggccaacaggatgtagggctattacctgtcagataaggggcaacctatataaaaatcactgtctccatctcttttacctcaatctcgcatacctcaatctcacatataccctggtaccgatgatccctataccatctaaataccgtggtcgtgatctcaaacgtcgataagacccgaagtaagggaaaaagtgacccaaagtgcaattcatattttttgcatgaaaaatgttctgtatagaagaacagatcgattattcgattcctaaaacaatgtacgaagacactaaacgtctatattgaccattaaaaaaaagatgcttagacagtactaataatgttgaaatattagagccgttattatatcaacgcaaaaatgtttatcaactccacatgtaaaaaactgtattgcatgtttagtctatattatcgtgaacttaaggaaaaatctaaaaatatcactggataatgttgcagcccgggcgtccaacgggggtggagccgatcgggctctcccccccccccacccacgcgcccctctccccacgcgcttgcatgcaggtgcctgaccccaccacattgatctgctcccacctaccattgcaataaatcacccacatattttggaaactctctattataggaatttggtttatttttgttccacaaaaaatgtttcactagtgcattcacaatgtttcactatgtagatctaatgttgcagtgaactaaaatactccattgcaataaatcacccacatattttggaaaccctctattaaggaattcgttttatttttttaccacaaaaaatgtttcacctagtgtacttataatgtttcactatatatggatcaaatgttgcagtgaactgaaacattctttcgctatttgctgaaacattgtttttatataaggtgaaacaacgcccgatttaaacaactgaaacatttttgatctacttagtgattccgatatacatggtggaacatcgtgcaatattttttttaaaaaaatcaataataagctaattttttttcgtcggaatatatctatgtgtggtcttattttgaagatttaattgcaacgaatttaatggtgtaatcggatcatgatttggataaataatttaagagaaaaattagtttaaaatggttttgcacatatcctccatatcactgacaagcactcgattgtaataaatgctatcgcaaatgtgagtttcatgaaatattatcatatatttaattttggtttagaaataacattatcattacagttctgttagcagccttctcttaagtataggataaatagtgcattttaacgatacaggatggacggaaccctaacgacaattatattttggacaaaatcacctatacaatagcatttattcaaattggatgcttgccaacggtataaaacaaagataatgaaagtatcaaaagtataacgaaacttattggcacactaccacaccaagttttcaacaatagcccataaccctattgtaaagctactaaaagtctaatgaggaatgcctctatcttttgagaacccaaaaaatgacttgaacttcattcacaacccaaacagcgacatagtgagggcgtgagaacaatgagaggatcgcgctgggaatttttcacacacacacacaaaaagagatgcggttgggtgtagagctcctacggttggaggctggggagatgatttgtgttgtcttcctactgaacctcgattttctcccttcacctcaataactattcgggggcttagttaggtactctattggagatgctccgagcattctatacctgcttatatatccctatatttaacatttccccttataattttaccaaatcactatgtttaacatatttcaatttagtactagtagagcaataaaatcagctcaatccaatttaacgtgctacaaagctacttcctccgttcaaaatatttgacaccgttgactttttagtacgtgtttgatcattcgtcttattcaaaaaattcaagtaattatttattcttttcatatcatttaattcattgttaaatatactttcatgtacacatatagttttgcatatttcacaaatttttttaataagacgaacggtcaaacatatgctaaaaagtcaatggtatcaaacattttgaaacggaggaagtataattttttttccaatcaacgatgaaggaaaaaggtggacgacgctgaaatagaaaacaaacgaatttcggaacgggaaggccatgtcggactttaaacagtaggacaaacataccactggacccacatgtcatagacacatgtggacccacatgtcattgagataggggtggcaaatagttatttgtcaaatctaaaagtggcaaatagttaaaagcccctgcaaataatactccctccgtttcaaaatgtttgataccgttgactttttagcacatatttgaccgttcgtcttattaaaataaaattgtgaaatatgtaaaattatatgtgtacatcaaagtttatttaacaatgaatcaaatgatatgaaaataataaataattacttaaatttttttaataagacgaatggtcgaacacactaaaaaagttaatggtgtcaaacattttaaaatgtagggagtagctctgaaccgaaccgaactgaactgaagatttgcgacgaccccccaaaatggcgaaacgcgagcaaattcaattcaattccccctcctcaaatcccgcaagcgaggaaccctaatcccatttccgcctcgatccaattccaaatgctccccgccggcggctacccgtcggccgccgccatctccttccccgacgccgacgtggatgacgactccgacgacggcgacttcaccgacgcccccctcatcgacccctccgaccccaccttccccaacccggcctcctcctccgccgccgccgccgccatggctactccagcctctgcggggggcgggagcgggagcgtgggaggcgtcggctcctcctccggcggcggcgagaggaggccgctgttccagcggctgtggacggaggaggacgagatcgtgatcctccgcgggttcgcggagttcaccgcggcgcgcggcacggcgttcgcgtcgcaccagtacgacaccgaccccttctacgaggacatgcgcggccgcctccagctcggcttctccaagagccagctcgtcgagaagctccgccgcctcaagcgcaagtaccgcaactgcgtctcccgcctccggggatccggcagcgccttctccttccgctcgccgcacgagcaggccatcttcgagatcgcgcgcaacatctggcgccccaccaacaagcacggccgggacggcgactccgacgacgaggacgccacgcaggtcaccccagcgcccgttcccgtgaacaccagccccaatggtgaggtcaagtccccaacctcagggcggcagcggcgtcgcaggcgtggcggagattttgccgccaccgcgcctgccgctgctccggccaccaccaacatggtgcagcccattcagccggtgcaggtgccggtttcggtgcccgtcaagatggatgacacgcttcctgcgttgtcgcagaccacaatgccaattacagtgacaatggagggctcggaacccctcagattgccggtcatgccacctcagccggctgttttagatgccgacaagagttgcttgacgcctctgtttaaggagatggtacgtgcagtgataaatatcgaatcaaacccgttcggtgcacaactgtccgagccgccacatggtttgcccatggaaggggagaaatggaggaagcagcgtatattggagctggaggtatacttgaaacggatcgagctgctgcaggaccaggtgaaggctacgcttgaggagctcaagtcctccgcgcctgggacttgaatgaccgagcgtgaaggcctgtcttgatgctcatttaggattcttggtatgattcgtagtggtagatgtttaggtgtttttgcagattttcgtccataaaagaatactgttgacttgtttgggcttggaactagcttattttatgtttctaattgtttacatgattatttagctttcacttcttgcctcctttcctataagataggtatatggttgtctctaagtggtatatttggggcggccagtaaggcatcctgatagaagggttggacacttcaaattaatttatgaggattacagattattgtaatttcaccttgtttcttgttcttcattctgtgtgtttttaaatatttagttataaatgaattagattaggtttgaagattttactatgaatggtcatattggctagaggtcatagtgttatggcacacaaaaaaagtgtatttgtctatctgcatgagaaagcaagagtggaattatcggaaacaggtgataattggacttgcgtttgaccataaccaagtctttttgggggtaaagaactaagaacagcaccacagaaacttaccatgctccacagtaatttcccacttatgaaccaaataatattttattgataataatagtgaacatattggctccacattctgcattgcattcattatatgttggcattcttgatctgtatttgataattacaatgattccttctattgctttgcaaataaaatcaatgcactcattagtcaatgacctggattagcatggtagaaactaagatgctctgtgcatcaaatctggaggcaaggaaagcatattcacaaaaaattgcatacagtttcttcatagacaacgcaatgttgtggacagcactgctgattaaagtactacatgttctactgtctatggtggtcctacatgctgcatatggttatttggttttaaagttctattgcattatcggtatatctaaatttactaattgtggaatcggattgcttcttgagacaaattgccagattatttattttgataattcactcttattggtgctggatgcaattaaaaatcgttagatgcaatttaattcatgattgtgtaggctgtctaccatgaagctacaaaagttctgctactcaatttctcacatgttctttgaaggtgtctacatatttgagaatcacagttcctttctgttagttaggtacgtccctttattttgtggatatgagttagttacagctggtttggctaaattctacattgttgctttgattctctattgtgttttacctctttggttcatttatacatatacagtaacaaattgagttccattgtgaaatcaagatgtgagctatgatgctaatcccctgcctgtagcttctcataagcatctttatttttattttgctgatgtttttgcaaactgtgatcatcattcatggtgtaacataggttctgagaattatcccatcttactggtgaagtagcgataacctttcttttcttcagagaggtgtgtgtaatcgggaatcctgacatcctgagataattgatgtagcagctaacctctctttcgtgctttagctgatttgtatcttttgtttgtatgcccttgtgtgtaatatttggagccagatttgagagtcgaatgtacatgctaatgcattgatgcaccggcgacggccagcaagatcggctgtttcagcagtggctgttcaaaagaatttatcttttatttcaaatgttggatgaaattaatcagccgagtgcaatttcttttgctaaagaacattatatgcaatttctggaagcagtaacaccatttcttttcccaatttgatccgttctatgacaagtaggtatactgctaagaagacgatgaattgcagaacaacaaaactattactccctttgttccaaaatatttactcccttcgttccaaaatatttgttccctccctttgttccaaaatatttactcccttcgttccaaaatatttgttccctcttgagtcttgaccggcactgtatataaatgaacgaaaactcaatgcttcttatatttaggatatttgataagtataacatcttttcaagtatttataatttctgttgtaaaagagacgagtggttaaagtttaaatatgaatagcgttcgatgataagtatttaagaatttataattttcttttgtagatgacagtagggttaaagttcaaatgtgaatagtgtcccatgataagtggattactctctccgtcccattttaatcgcaatcataagttttcgtgtttaactttgattgctcattttatttaattttttattgtgatttaatgataaaacatgaatagtactttatgcttgatttatattttttagtttttttaaataaaacgggtgattaaagttagacattaaaactttgtgcttacaatgggacggaaggagtattttagaagagaggagcaataatcattaatcaaccgtaatttttttttgaaatttgagactatggtatgcgatgaaaattttcatgcgtacaaaaagagagaaattttaggttctgtctgacaagtgctcgattctactatgaattacaacctgacgaaaatgtcatcgtagtttccgtcaaataacattcattagccccttttaaaataacatttattctgtggacgtttgcggatgtctaaattgtggacatttattcttttttctttttactttcgcagtatatgaaatacaaaagtaaaaaaaaagaaaaaaaaagaaaaaccttcttcttttttcacctttttgcaggctttgcacctgaatcccatgatccgttgggtacaaggaagaagaggatactactctccaagtagcgaaaatccacaaattccctctccggctcgcgcgcgcgctctcaattttttgggggaagagaagatctccccttggagggaaccccgcccaagaatggcgggtctcggcggcggatggggcggcgggtacgacgacgacgacgactgggggctgagcgcggagcagctcgaccagctcgagcgggacgcctaccgcaagctcgccgagcgcaaggcctcctcctccgccgcctccaccgccacctcgccgctcccctccgcggcctactcgccggtcaagaacagccaccaccacccggcatccagggtttcccaggagtcttgcttcggcaaggttagggtctcatctcctctctctcttcttattcttttcttttctttcttttttttccttcttttgttaaaaaaaaaacttgggtcagtgagggttgcatcttcttgcgaattggcatattttcatcttaatacatttcgtgaaaaatgtgtagtgttcgttctggcaatttccttatatttcttttacctaattcgtcatagtgaattttcgttcaaacaaatggatggggctcttgtccaagaatttagccagtgaataaaattcttattgacaaccatagccagtgtgaattgcagtacgaccttagctcagagtttgtataccgtggtaattttacgaattttcttgtgctctgcagttgagttctttgcgttaccggctatctgtttcaactttcaagaatagtttttttctctgcgttgctgtttcattgagttctttatatgtcctgcattgcagtatgaaaaccaaaagccaaaacttttttgcacctgacaaacccaaaaaaaaatttggtggtttctggcagaagaattaatcatggattttgtgccaagataataagtgatggggcctgttctgtttcctagcgatctgttaaacttagtgggccgtgtgttaaattgcagctgcacaatattagcaccatcaggggtttcttgttaactcatgagaatacgaccaggcagagcgtgtattttagtatttactgttacaagaccatgatcctggccattttctaaggctgtgttcgtttggacgttttcccagcgcgctacagtaacacggaaaacggaacggttcattaacacgtgattaattaagtattcgctaatttttttttcaaaaatggattaatttgatttttaagcaacttttgtatagaaactttttgcaaaaaagtacaccgtgtagtagtttgaaaagcgtgcgcgggggcaaaacactgtagcgcgctgggaaaacgtccaaacgaacacagccttattgcagattaattttgaaaaatttaaggcatttgattccatcatcatcatttgatgtacttgaaaactatctagcatttgatgtattacgggtgtgtggccactttaaagtttgggatcatatggttgacagggcttgctttggtgatctctagctaaattcactggctatggctgtcaataagaattattctcttactcactgtgttgtgtggattttttattcattcttgagtagtgttgtttagcgcaacttcaatatgtttatgcctttccaaagagttgatttttacttacccatgtactcatagattggtaaacacagactctaaaagaggcacccaatttatccggagtaaggacagcagttgagaagggttttcatatctccaaattggcttaatctttcagttttaaaccaactgcccttctaattattctaatgtaattgtgcaaatctccagcacttgaaatcggtacgaatatatgataccatagtgcaagagcatccctgtatatgtctgtgttattcactttattttatttaccatcatttattatagagtttgcataattgtttgacaaaactgatatttactcatctctttttatatcactaactgccattatgctaatgaataatatttcttaggtagaatcactttctccttctcggcttagtcaaccaaatgcatcgggaaatgcaggtataagacattcttggtgctttatttttattctaattggacatgtggcttatctccttttttgtttgtcatttaagttaataatagtcagggcaatatgtctaaggtatcagtacatcttttccttcattctactggtgtgatcgcagcgaagttccagtaccaccaggtacaattctccccaatgaaatctttaatcagttgttactgtattatattgtgatccatatatttgactcctctgttcctttcccagaaacttgtggatgcagttcacaagatccccaaagccagctggaacgggaaggagaggttttcattaatcttctacctgacaaatttacaagatttttctatggcctatcaaagctcaacttgtagtgcttttatgctctcaaaaaaaaatgcaactctgtaaacacatcgggagcctgatatgcaact

SEQ ID NO: 36577 - DNA, 11796 bp, Oryza sativa
attcctgattctattttacctttttcttgaaaactatagggtatggatgttcccacactcatcattatcagtagcagaggaagttcttagtacagtacctggaatagctgttgaggtaacagttattttgtacttcataaaaccgacttactgtttgttgtaatgacctctcacctcctgttgttttgattaatttattttacttcctcctgttttagttggttgacctgggctgcttctagttagcttagcattattagtaggattgttttttagttttctattttgaaaattttcaaatattagaaattcttatatgactgttaacaaatcctctgtaatgcttaaacaattcagaacatagatgatgaagttggacagtgacttttatgacttttctgttcattgcgtacatggctactatttttatttttctttccacaaggaagtttgaaagcttgcattttcagtttatgcaaacaagaagtaaacagactcaaggcataggctttaatgtgcggtccactatatcatcgaaacctttctaatctttcagggaatgcctatctgacagtctatagatggttcagcaataccctgtattcctgttgacccatggttactctatattttgcagttgatggtcactaataacggtgaccaaaaaagtttaatatgactgaagtaaatttgctagtttgctacctttcctttactttattattgttgttgatatggagcaaaatctagttttgaacttctaaagatattcattctggccataccttgtactttcctagcaggtccaaaaactggatccgctggttaagcgcgcactaactgcttctttatatgccggagatcttcgaggtgaataaaattgaaatagctttggaaattccaaatcatgcttataaaattgttcttcactttgtactaatactgttggaaaacaacccaattgtgcatgtgcctaatacaaaagtgttggttatgcactgtttctttctgttctctccactaatctacttggagtttatattaaatgtgttggagaacctaaataattctgtatgcaatactatagtgtaaactatgcaattgagtgcaaactttactttatattttccttggtgttaggctttgaaacttcaatgccttgccttttcctagtattttctttagatgctaacttcactttttttggaagatttgtatggcaagattccaactgatgttgagtcaaagcttatgccgtttcagcgtgaaggtgtcaggtatgactatatgatgatgcaatgttcagtggacttttttctcacatgacagtgtaaaaatcatttttgtagatatgtgctgcatgttgaacttaattgtccagagatatcaaacatggcagatgaccattaataaatatgagaattttgtctagtctctagcattatacttaatgttgttagtctagtcatactaggaatgttatgttgcagatacttatggctcaaactgggtatggggccagaggactaaggtagggcacttgccctcaactagccattggcaggggctattccttcatgtggtagagggttaaagaaaaggggggaaattgtaaacttcatttactagctaaatgcccgtgctttgctacggataaaaggaaaaaaacatcatagtattgccaaataataaaaacatattttccattgaatatgtacccaccttaagttaattttatatgtggctaaccatttagatttagttgttatgtactattaagaagttcaaggggtgatatgtaaaagctacaatgggagcaggtaggtggcggattcactgtcactacaattggagtctttttaaagtaagtatagattcgttgcttaataataagagataaaaccccattgtcgtttagatgggataacttggagccttaataagcttatctctaaaataaagaaaaactcaagctaatcttatctctaaaatatgccctagaaggtatgcttcactgcctacagggcccaaaccccataacacaaagcttgaactttgtaagtaccaaaacccaggaccaggagcataagtaccattcaatatttgaaaagtgtagtaccataacacaaagcttgaactttgtaagtaccaaaacccaggaccaggagcataagtaccattcaatatttgaaaagtgtagtaccgcatgctttgccattttttgcacttcgaacacgttgctgctttacaagttcaacacatcttaccttttctttgatgtttaaacaggtttgctttacagcatggtgccaggaccctgatagcagatgaaatgggtcttggcaagacattacaggtatactttttctctggaacattgtaaatctctagtggctttatatcctttctatatttataaatagcagtatttttctttgcaatatgacccaagcttcatttagcatgacatatctgggcactcttccactcttcctccatcattaggacatggtgatatggcactactagatagtagtgtcatagtgtggtatgcaggggtatgattactgtgagttgatgccaattctcaatctgcatgtggaccagtctataattccttcaaatagcttgaaagaaaatcgataaatgtaccatcagtgtgtgcttgcacagtagagattgatcagcaatggcctattcacagttttataagtctggagtttatgtgttctttcaggcattatttatggtcccctcattttctttatgcaggcaattgctgttgcttcttgccttcatgatgcctggccagttcttgtaatctctccatcatccttgcgattacattgggcttctgtgagcacctgtgttaaacttcctatctttcatttcaacagtaactctatgcatgagggaagtttaacctttctgctttgcggttgtaacagatgattcagcattggcttaacatccccacggaagatatcttggtacatccctttagttttcttaatgtagcaatggatatatatatatccatgtttgcacattacttattcacaaaacctatccacagtaatcccttaatcactaattatgataaatctccctgtgattggagcagagcacttgattttcctcccttgaatgtttgctctccatatatgctgtattatccttattatgctgtacagtatttttttggttgtgtttttcctgcttcccttgtcatatttcaccaaaataataaactgccatccctaaattttgtggcaatttatgatccttaactccatttgctgaatgtgtttcttcaatttcctagtgtatgtaactttcgtccatttcctagagcatagtaacccgttatcttattcaggactatcattgaggtggtcacatgctatactgagaatatgtattttatgaaaagggtctctaaagatgcactgcttgcaggatctaagatgctgtcacctcccatatatagtctaatgcttcataattgctttgcaaattcttgtttgaacatatgagatgtagcagtgcactcgatatataaagaaaggaaccattaaaaatatttgcagttcccaactaagctaagttcatatagaactttagaagtcatattttgactggaagaacttgatatggagattaaattacatagtttgacaagtccaaagcatataaacggatatggataatttgcatctatgggctgtgaataatgcttacagatacagattttttttccaggtggtgctaccacaaactggaggatcaaataaagcaggatacagattggtatattcaaatactaaaggggattttaatctggatggggtgttcaatgtgatatcttatgatgttgttcccaagataaaggacatgcttctggacttggattttaaggtaggattttgtctgacatgttatcgtgccgtaattatattacaagcatgggctatgggcttgggtgagttcgcagtagaacatataggatgtgtgcctcgtttcacaggctgttcttttactgcttagatattgaacagttcaatattgtagtgaccccctgatatctcctaaagctcttgctgaatcatttgaaatacaacttgttcaaaggcctcctttgatcctatacatcaatcaaacatggtagcactattttatagaagttagcttgggtgtagctttacttgtaatttttgcggaacttgatttggacttctgttggatatcgagaatattgttgtgttacgagcactattgtgtcttggctggatcaatcaatctaccaacttgataaagtcagaactactttagggatcattagtgtttagtaactagtaacattacctgctgatgcatttgttgaccaatttttttgttgcttcttttggtaactgaagtaattaggtgtcattgtagttcaaggtaaaaaaaagttgactcttgttgtgtatcgttttctcaatagttccttctgctctgtaccgtaaattatgtacaatgatgatgttgcatatttacaccatttgcatatatggaactagtgaccccctgatatctcctaattactatgaatttatctggagtattgctgtgtataatctgtttatactcactttaaatggttttcattcagattgttatagctgatgaatcacactttctgaagaatgcccaagcaaagagaacaatgcattcacttcctgttctgcaggtttggtgtttcttatgcagagttgattggaacaaattatactttggttctttagtgagcttatatagcaattgatcgaattgggagatttgctcttttgccccatagttgagtggtgtttggtcacttgccacaccccctgtgaatgacaactgggcccaggtgccacatgtcatacacggtacacgcatatgtggaaaaagagcaaatgccatccatgtatgtgtggcaaaattgcaaatcgcccttccaaccatagcatctctacgttaattgtttgacacaaagcgggatgaaagtgtaagtggggtgctatatgtacacgagtctgcggattttggaagctgggggtgacaccaaacttccataaaattctgaatgctgttgtcttagataatgttcagttaatatcatcagttccttaggacatttctgctttcttagactgaattccagatatcaaacttggttttaaatccatttatcatttctctttagagattagagtgaagtatatcttggctgattgcagttacatgaaagaatctctatccaatggcatggatgattttaagaaaactaactgtgtattttttaatcgcagaaagctaaatatgtggttttgctaagtggcacccctgcgttatctcgccctatcgagctgtttactcaggtacaagattcaatagttaaatgcacattttcactactagcaatttttctagtgtagacaaacaatttatttttctacgtgcagctccaggcattgtatccaactgtatacaagaatgttaatgagtatggtaatagatattgcaaaggtgtaagtactagctcaatcgaattgctttattcactttctgcaaaccaattatgatagagtttactatatgaactttatcagggcttttttgggctttatcaaggtgctagcaatcatgaggagcttcataatttgatgaaagcaactgtcatgatccgcaggttgaagaaagatgtcctttcacagttgcctgttaaacgcagacaacaggtaaccttgttggatttgtcggaaatatggattgacttcatcctataattggataaacacccaatttttctcttatccagaaaattcatgacaaattcatgacaaagttatcatttaaattcaacagctcattgtatcttctgattgctagcatgaccttctgaataagttcctgcttgaacaattatttccattccttctgttgacttgaccttttattctaaatgcttaaaaccaaaaaagctcatttatatgcagaaatattaggaatacttggttactacctccatcccaaaacaagttcatttttcaccatcccgcacataccaatacaaaaccaaaaaactagaatacctctactttatcaaatcccaatgcaactattcctcactttatctactcccaatacaattattccctgctttcacaaactccgatgcaatgataactctaaaaatgaacttactacgggacggggaaagtatcttccacatgaaacaaacttgtaggatgtagcttatctctgatatgttggttcctattaatctattttactgttgtgattattacctgtctaccctaatacttttacttacattggaacctactcaggcctttctggatttaagtgagaaagagatgagacatattcgtgctctatttcatgaggtattccatttctgtttcatttgacctacttcatagtgcacaagaaacagggaatcatttctaggtagctcaatgcatatgcatttcatatagctcattttatatttatatctttgcatcagtgaagaaccttagaatgatatgctgatatggctttttgctgtccctgcgcagctagccattcaatccgtatatatcacatatttcaaagctagtccatatatttcttcttaagttgagctgaaaaacagaattacgttgctcttatctttacatttgttatcaacaaactatgctcttttgaagtggttaagcttcatttttatccaagagaagaggtgcagcatgaattagtcatttgttttgttgtgcctgtagcatccttgaatgctatttaaatttttgtacggaagagctatgatgcagtgtgtgcttttgtagttggagactgtgaagatcaaaatccagtcctgtgactcccaggagacgatggactctctcaaatttgctcaaaagaatcttattaacaaggtgatctgaattatgtcttcatgctcctctatttctggtgattattactgcaaactagagtatgcttccaactataaactaagctgcatcaattatatagaaataaaaatggatattccctaaaattgcaacttttgtattttatccaaatattatgtaaatgactaaatgtatcatcgaatgaaatgtgcaaatacttggatttgatcaaaccttttgcccttcatttattttccatctttagagtttagattcaaattcaatctctgttatatgcgctcgacattaagatttgtgttctttggaagtggttttattcttgcatcggtgctcatttgtcattcctaatcacagatctacaatgattcagctgaagccaaaattccagcagtgctagattacctgggtactataattgaggtaattgtgcgaaatattatgatttgtcctctattcctgtcttgtggtatcagatgtgagtaacatttcacacactggctaacctttgctagtttctggattaccaaaaaggaacaagctcattaatttgaacaaaattacactgtgctatttgtgattcacagaatcctggccatgcttcatgtgctttgacaggacctacattggtagatgatattacttgatatttagaatcaataacattcattttcaattggttttcaaactggctctcaaatggccttcctagcctgttttgtgacaacactcttttggtccatttatttacttcaaataacagtacaaataactatcctgtcgtcgcaagcattactaaatacttccttcatctttcaggccgagtgcaaatttttaatatttgcacatcatcaatccatgcttgaagctattcaccaacatctcttggtaagcactgaaaatgtatttcaattggattattaatatactgacccacttaccatcatgtttcagaaaaagaaagttaagtgcataagaattgatggtcaaacacctgtacctgtaagacagactctagtcacagatttccagaataaggatgacatcaaggcagcagtggtatgtgttagaatttgtatgctttatatctattagaattttgatcaaatcctacttagcaaacatcttcttacagccagattttctgaggttgctgattgcatgtaaaatatttttttttctgtaaaggctgatttttgaaaccccaacaattggtcagtttttaaaatctgtgtccttccctgccaaatgatctgcagttgtggcaacttgactgaacctaccactgggttatgtagctaacattcagagcgcagtatgcgtggttgcgttatgcaatgtgccactgtttcaccatactggctagttgaaaacatttatagtccttcattggctccaatctcatgatatcctaacactatgcagttatccataaaagctggaggtgttgggttaactttgacagcagcaagtacagtaatctttgctgagttatcatggactccaggtgaccttattcaagccgaagaccgtgcccatcgtattggtcaggtgaatactgcatcccgtatctgtaaatttcgtaattgattaatgtggctaccctgcaaccttttcctcaaaaatttaaaatctcagtgttgtttgaatatttgataggctttcaatggattcacttacataggtaatttgtggattcactcacttggctgttcttattttctgtaattattttcaggtttcttcggtgaacatatattaccttcttgcaaatgacactgtggatgacattatatggtacatcccattctttgttttcacttcataagtgttctactttagatcttgtacttaagtggccatttttaccatctgctttccagggacgttgttcaaggcaaacttgagaatttgggacaggttctttatctctctaccctccccccacaatggactattattttcctgttagaataactgacaccttttgcggtgaactatagctgatccttggatttgttgggtgatgaatgatgatagctaaaattagcgaaaactgttctacagttccttttggttatatcagacttaagttcccttacacgctttgctcagttacacgttaacatgaaataatatgtaacaagaacaataacatttgctcatgtttccacctgttcatattatttttggaaggagtcatctctagtgtacctgcatttgttaatctctgacatgcatatgtctacttcaaaaagacacagctaaactatacggttaactctgaacataataacctgcatgtttgcatgttgcatcatcatcatctccaaactccaatgatacaaagcttgaatgaagcttgtgcatgagaatgattctgaagagagcaaactttgccttgtttttttgtgtttccagatgctggatgggcaggagaaaacgctggatgtgtcccagagcgacactaggcccagcccttccaagcagaagacgctcgacgcctacctcaagcgatgcagcaattccacagaagctgatcagcccaagctcaagaaccctaggttctgacatttctcagggtttttagctctactatgtttttgtttggcaattggcatgaccctcttgccttaaacgaaggaatgctgcagtgtcaggtagctgtgtgttggtgttatgatcacagccatgctgtattttgtattacccagctaaatgcccgtgcgttgcaatgaaaattaagaataactttgatcacaatatcttttaaagccccaagagaaagtaaatcattcatgcaggctaatcatcggcccgtatttgcacacatgttgagctaaacattaaactacactgttgcttttaataatagaaaatgaatctaaattattgttattcttctattcgattaatgtagaatttttctcaccatttaattcaataaacgcttcacctttttttggccccatatgacaccacaactaatcttaaatgtaatatgaatactagtctttgtatttacaaaagagaatcacggagcaggtacgaaaaagaacaaaaaaaaaaaaaagagcgcagaaccccatctcctcccaaaacccatcgccgccgcctagccattgccgtcgcctcctccgcctccatatgaccatatccacgtcgccggcgcagccccaccgcctcagatccctccccctaccatccggcgaagtttctcatctgcctttgttgacgtaaaaatcgaacacggcggcctgggagatctgcttagcccctgtgcaggtccaaatatgatgagatgcgggcgtgccagtcagtttgatcctgccactgacaagatatgcaaacagtagatcaaacagccgatcggctgataagccgatggagtagttccagccgatagccgataatagccaatgccgataccagccgatagcgatagggtttaagcgatcggctatatgtccaatgtagataatgatataaaggcggctgatgataatataatatagcaatataatccagtagaaaaccaatcggctaataatatgatatagtagaacaagtattgatccaaaggttaaagcatacatcggctggggatccgatgtcaggaaattcacaagattagattaaacagtgaaacctttgttgtcatcggctaaatctaacttatatgtatatgcgatccttatgagccgatgcaacgtccagataactcaccggctgaaaccccgatgaaacccttattggcaatcaagaagcaggctagaaattatggttctaagcacgacttagtagatcaaacttaactgatgcagcactaagtatgaaaagaaacataatatctagacaatcaagccgttgactgattttcagggtggtagatatctaagctaatctaatctagcaatacgatttagccgataccggcagaaaccctaaagcgagaagcagccgatagagctaaattgatatgctaagactagattaacagagacatatgataaataggtaggtaaatatatcatccaaaccgtagcaatccaagagattgaatatactaatgcagccttgagcgatgccgacgtagatgacaaattcaccagggcccgacggaacgtaggacttaccccttcgccggagatcgaactgaaccgatgcagccctgcgtcaggtgcccaaattccgccggaagataagtaaagacctcaggaaagagggtggcgatgcgccgagagtagttgtattgatcgtgattgatagattacatagaccccgggtgtacatatttatacccatatgttgatacgagtggttggccgaccaaaaaaaaactattctaaaaataaaaggaaaaaataaagtccttatcggacattaaacacactttcctaaagataaaaggaaactaacaaactatgcctaattaatagataaactgccatgccgcatccttcttgaactcggactcttctagataagcttcctttgattgatccgattccatcgagaacacaacatcgtggcaatttgacgactcccatcgactgattcccccaatcggctgattccagccgatattaactctaagccgatgatgactttgggctttaccaaatttcgctgttaacagccttcccatccaccccgagtcccacgccgtcgccttctcctttccgcccccggcggcgtttcccttcctctctgcacccggcatctcgatcttctcacacagtcccccattgccgccacctcctcgcctcctactcactttctcatccccatccccatcccaatcgcagctcaaaaaagcatcggatcacagcta

SEQ ID NO: 36578 - DNA, 19259 bp, Oryza sativa
aggagtttaggacacaatttaatgctaagcaaatagaaaatctattattacctgttccctttaatatttttgccttcggagttttgaagctaaaaaccaagcaaacagctcatggtcactatgttattggttctctggtgtgttcatgaggcctgatggcaccttaaccttaacctgttaattaacaacaaaatttagattctacttgatatatcttaaaagccaacatcgatggcacctttttagttgtacaccaatcacctgaatactgtaattcctgactttgcatttagcctatgtaattagtaaatgtcaatcatatctactttctcaggtctacagagaagagttgagaaatcctctttggctttgggctaaagggtttttgggtggcaacaatgcacaaacagacaaactacactaattgtgatgactctggatttttttactacacttcataacaaaattgtgcatttttattttgggatgtttattatgttatcttcttgagatactccgaggtcaaatgatctttgagcaatctgtgttggtttcaaaatatggactagattgccgtttagtttgctactatgtattgcgttaggtttgactattttatgccttgtagcttgagctacagttcaaatatagcttgagctgaatctatagttctaactaatagtttatcaagctgtatgattttgtaaaagaaaaaaaaaatcaaaattaagtatgattgtgcattacgggcacctaaagttgtgcaacgcactattaagtggctagttatcagagaagcccagatggataggccgaagatggaccatccaaatgggccgttcataataaaaggcccaggccaacgacggccctcttatgagcctcagcccggttaagtattgggcttaacggcccatttatcttgtctctctggcccacctgcagagaaacaattggtttgggccgttgaagagaggaaaacctaggctagttggcgagctcgccccactccgtcggcggccgcgccttccctgtgctggaatccagcggccgccggagacggcgagttcgacgccgcggctgcgcgcggagacgttaaccctgcggcggctcctacctaggaggtaatctccggccgcagtgtccgatttttgcagattaagtagtgttcaggttcgcgcgcctcgatgattgagcatcagtagtgtttggatttagatttgggctatcgattcctcgctaactggttgagtagatgggtgctcaatgtacggatgttcgttgaaattatctagtgtgctataatctgaaggcggaaataatggcttggttgtattctcctgctgtttataggtgttcttactggttgttatagcgattctctgtttggtgcccatgagcaagaagaagaacaagtctcaattgccaataaaggcgccgttgaaagatgctgaacaagggtatatataaataaatataatcattgctctactgtattcttggttgtaattctagttgtttgagtgacttttagaagaataatttcaagggattgattcacaatgtgttttcttcctgggaagaataacttcggattacattggaggagacgctcttgatgacctattatcgaagcttattaagtcagtagcaaattgtctctccctcgacctttctttagggtgttgcttgcttctaattccggtgaaatgtactgtttaggagcgtggaggttgcaaaggcttcaagggaagggttgccggaaaagatatggatgaaggtagttccatatcctaacttcaatttcacagactcttattgtctgtagatctcttataatgactatgttcagaagatttttatgttcatttgcatgtatgacttttgtccatgtagcgacaatttgccgttggggtcaatgatgtcacaagggttcttgagcgaatgcctgctgctactgctgccacccattctggtcactcttctactgaagcaataactgacaaagctctgtgtagagctcctccggtgcttcttcaggtcgatttcttttcttgctattgcttagtctttagagtttgacagccttcttatgaagtttgagtttagcttgcatatatctattagttcgaaggaaactattttttaattaaagcacaaatatgctttgatgcataataacacaccatttttttctctcttttagtccagaaaaggacatgagtccattgcccccttcaaagaacgagtgctttacagcttgccagtaaaatgttactgaatgtagttttcaacgtatttcagtcatggttacgtactacaatctcagaactatcaattcattattcacgtgtgatgtatcaaactctggtcttctgcagagtgctaagtctaaacattgtctacatatggaaacacgctgcattcatgagttgctcgtgggactgtccctattttctgtcatatgtttagccaataaaaaaagagagattcagttaatatctggttaaggttcagccaagagcaacaaaagggtgattaggtgttgcacatgcccttagctacaatgtctacatgcagaatgttaatgctgacaaatatttctcatcttgtaacatggtattgtaggttgtccttgtagctgctgattgcaaccctaaatggttaacaaaacacataccaaccctggcatctacaaggcaggttcctgtgttgtgcctcaaggacaacaaagaaagctcactgaggttaggtcaagtggtgaatgtcagaacagcactggccattggagtaaaggtcggcttttgatttcttgttctacaattctttcattgtttcttgaagcatctcatgatgatttcatattctggtgcatactgcaggccagagatagcataatcaataaggctattgatgaagtcctgaagactgctaatctggttgccaaggaaccgtaactgagcttctggtccaatctcagtgacataatgggcgaatttatttttaaacaaggcagaagctctgcctcattccactaataaagaatagatattgacccaagaaaatgtttgcaccaaaaactgataggtgaattttggacctctgggtgctcagcattgcagtagcatcttgacaggaagtcatgaggatgaatgggcatgcagttgagaatttcgcgaaggaaatcaaggatgctgctgaactgtggcgtttacatctgaagaactttttctgcctgtattcatgaagatcaggccagaccaggcttgtttgttaggtaggttcattctgtttagttgaatttgtggatcatagagctagcaaagttgctcgcctagactgtaggctatattatgagcaatttagtgcgtatgtgtccactatgtataatgccatttgcagccttgtggatatctgccttatgttgtttgtgttcaaccttaatttggacgatataaatcattatcataacaaacatccttaatacataaaccaggatagatgtactaacgttattaagaaatgtcttgcattttgcattactttctcatcatgtcaagagtaacatatatctatgcggtcaacaatagcgtgataaattaaactacagctagttaacgtatatttatagtcaaatttgtttttttgttgcgagacgtagaaattgaatttaaacttgcatgtttgtggagtgatatatcacatattaatatatcttctcaaattttttcataactatttgagtgacatgcaaacaataagggaacatcccctcgagggatcaaaatccactcccatgagaaagggaataatgcatgcatgcgagatgccccaaattacacgcaaaggccaatgaaaaggatgcagcgactgttactcagtcctctgccactgttcactcagtcttcgagtttgtttgtggagtttaaaattctaaaaaacaactagctggtagtcagtttatgagaatatggagaagctagatttttcagcttctgacttctactccctccgtttcacaatataagtcattctaatattttccacattaatattgatgttaatgaatctagacatacatatctatctagattcattaacaacaatataaatatgaaaaatactaaaataacttacattgtgaaatagaggaagtagtttattttctcaattctataacttcagctcactgtggttcggtcaaggtgtgtcaatctgaacagggctgctgacagactattggagtaaagctcggctaagcttccatttcctttaggttgcaatgtccatcttaagaatccaccataccatgtttatacatcctgtattaaaatcatatttagtggcatatttattgagattagttattatgtgagcatcaaccttggtaggtgaagctatccatccacaagggctccaagaaggttttacattttcgttttggtttgctaaaaactgatgagttttgatcagtgcctatgaaaaccgactaagactgatcaattttgttaacctagctagccacaactacattatatcttcaatgtagctatgcccataattaaacaatgtggtggatataggcatcggactccatctgttagagcaactccaccaacctatttaagccaggctctacaagcatcagtatagccagttctccaactaatttggtaagccagacccattgctcaagccatttacacaggaacccatatgtcagtctctcactccttcctcctctacaccttcctccaactactacctccaatcatccatcctccagttctccaccaccaactggcggcaatagtggcggcgaaaggggaagcggccgcgatagcagggtggagagaggggaagaagtggatggtggtaggagctgcactcaggtggtggcagcaccagcaccctaatggggtggaggtggtggtagggactagggacaaccacatcgggaaggtggggacggcgatgcagagaggaggggtggcacgacgacgagcgaacgtggtgggcttgcgcggtggagaggcataggcgtgacagccggtgacgacatgcccttgcgcggtggggaaggcggaggcacaatgtccagtgacaacatgtacttgcacggtgaggaggtagaggcacgacatgagagggattagggaggggagagagaaggtagggtggtgggatccatgctacaagtggttccaatttgctagatttggtcagccaagtgagaaatctgaccagccacttggcttggtaagttggatgacaagtttgttggagggcgttctcttgcccaagtttaccaaaattttgcttggagagtaagatggaaagactattgaagatgcttttaagatacatgtgattccaagaaaattactgtagcaaagtttcttactactttgagtatgtatatgcttttctaattaaaacaaggtattggtgatggtattaaatctgtcactccacctactcccattaaaaatttacaaaatttaccccccttaaacttcttagaattaaaaaaagttacgacatataaaatgattatgcgctataggaaaaaaacacatttcataaaaagaaaattgtatttttttgtatccggtgcaaagtaggggcactcagctagtactaaagaaaggcactctcggaggtgtatgcttgtagtgtacgtatctgtgtgcacacgtgtattaaggaaataagaaaaattcagggcgaggcatgctgctagtcgggtggcgtcgacgcgagcactcgttgtcaagatgtttgtagcccacgagcgcggtggcgaagtagcagagcacagtgatcgtcaggtaggccacgatggttgcccttccacggccgggcttggttatgagatgttttaactttgatcaaaattaaactacttcaaatttaattaaatttatagaaaaactaataatattttttattcaagataaatttaaaaaatacatttaatttttaatttaataaaactaatctggtaatataaatattactatatttgtttataaattagttaaacttgaagcagttgattttttactaaagttaaaacatcttataacctgaaacggagagagtagctggctagcaagtaaatttgctcgcctagactgtagtccatattataagcaatttagtgcgtatgtgtccactatgtataatgccatttgcagcctttgtggatatctgccttatgttgtttgtgttcaaccttaatttggacgatataaatcattatcatagcaaacatccttaatacgtaaaccaggatatagatgtactaacgttattaagaaatgtcttgcattttgcattattttctcatgtcaagagtaacatatatctatgtggtctttaaaatacaatattgaccatcaatatctaattcctctgtccctaaaagggcgtagttttactctaaaaaattatctctaaaggagagtagtttttaagaatttatctctaaaggagtgtagttttagtttggtccactaaattaaacctcttttatacggcttcatcatttttagctatactctgtccttgttttttatctgtattaacgaatgtcatagtattcctttaacctcttgcttataatatctttatgctaaaactacatgccttttgagatggaggaattaattattgcagaagattttttttctaaaaaaactgagagcattataataccatgaaaatattgttttaacgcaaatatatagatagattttattttatgcaatctactattataaaacttgataatgttcctacaagtttttcatctgttgcctccatcgtcgatcgggtcaggctcttgtccggtcacacggcgacggaatttttttcggttttagatttttttttaatatttacagaaataatctatcggccaaaaaaattacaaaaatagaccctgccgcccacctctggggcagcaagctgacgtggcaaacgggggaggaacgggcgatgacggagggagggtttttttgcaggaaaacccggcaaggggcccgaatgcaaaaaagccagacggggccggctattttgcaggcggccccttgccgccctctggccaggcggcaggcctcactgcctataaaaggcctgctgcccagcccccagccctcattcttctctcctcaattccagtgaaaaaaaaaagaagagaggggaggagaagagaagaaggggcgaagccctgccggattcaaacgccgatttcaggtaatattcatagatcctatatatgactattgagttaaatagtgtgtattctttaaaaatttgtttgaataaatgcattatatttttagggttttagttgtactaatctagaagtgcgtattgtagatatcggtaactacatagatctgctagtttggaatcaatacattaccgttgcattggcttacacaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaagatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaacgagacttctgtggaggaggtcaacgcacgagaggacgggggcatagtagctccagtaggcattcaaccaggtagagtggctgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagtttagggttgccaagtcgaaccggtcgcaatatgaagttcggtgtattaaggaaaaagatggttgtccctggagagtgcacgcgtataaggggaaatggaaggattattggacagtgtcagtcgttaccaagcatacatgttttctacctggtgttcagaaataccacaggaacattacttgtgcatttgttgcatctgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaattgaagaaattcccctcaattgaacatcctagcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgataggcacgctagcattctgcgagcgatagaagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtagagttcattttatatgggacatgcaggtattttagggatcggttccaggcagttcttccctctatgccgaacaacagcattttgtttggagctttcatgcagaaaaagctaaaggagttgcgtaaaaaggccatgaaacatcgagctctagtgcaaggtacccaacagcacaggtttgagatactatgtcaagataaggcaggcaggggtatataccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctagggagttcacagagactaacgatgaagtactcaatattcctgacccatcgaagctccgaggcaaggctggaaggaggaggactcgtcgcatccgcaacgatatggacgagttggaggctggcagggtgaagcgttgcagcaaatgcgatgaacatgggcacacctacaagcattgtcctaaagacaaggagaaaccaagtgtggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtcttgtgatgtaacgtcggactaaggcgcctaatgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgagggagagccacacactgaggagtcgtaccaggcctacctacgctggtaccagccacgcacccgtactagggtcaccttcgctcccttggagcagcagccccacgttgcgagcactagagacctctacgccaggcaccgcgaccaggacttcgctcgtgttgtgagtaccctgcatcgcaccattcctttatgttttcatgtctttctcttcgtcaaattttacgaatatttacgaacaaattaaccatgcaggtcgacgacatcaaccgggtcgtcgttgatggttcaacgacgatccaacgtttaggcgcggggattccggtacccgtagaggagcacctgacaacgtacacgcggatgggaagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttacttgccgattgcttcagggtttcgtgcaccgttcagcaccccgccttcctcggataggccttctgttgtgccccccacaggtacttaaaaaaacaacattacttccgcaatcaatttacatacattttatgtcttagcttacaagggtcccgttgtcgatgtgtaggtttcgcccagttcgctatgacgcaggccgcccacttctcccaggctgcagggtcagcgtcacaggcagccggcacgtcgagtcagggtccaccactggaccattcttggaacttctccgacccttgctgcttcaccggcccttcaatccttactccacttccttcagctcaacaaagaacttatcgcccttacacttggagggcaccgcggtgcaaacgcagggaccagcgcaggccactccttccgcggacacttgtgctacccgtgctgtgccaccggatcgtttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcaccgatgcagcctcctttattcgtgtgtgatacgagtatttgcccgccatttggcgcatacgaccaatgtaactttcggcgccgatcatgcatgtatctttcggcgccaatcaggcgtacccaccataccccaccactttcacatgtcaggggtatcactggattttttgcgcctatataagtcgccttaacgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgtactacggcttgcgcatacatcgagtgggtcgatacagaaaatcccattctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcaggtgtggtgatcgttgtcaggttcttcgttccataaatcctacaacattgggtcgaaagttctttgtttatccaaatattcttgacgacgatttcatggtaagaatattttgattacatgaatccttattttctcacaacatttactaactttgcttgctttacatctattctttcctcctaggaaccaccaaggagatgtcaatacagagaatggatagacaccagaagggttctaactccacctagccgtgttgtgcagcttgaactaccagagcaatacagggttactaaagcgcggtttgagagaggagaaggatcctcacgtaggggttagctattatcggacaacttagcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttatcaataaatacttctttatttattattaacataacatagaaaaatcttttggccgtacttttttcatctgggtcccttaccgccctctacccagatgaaaaagtacggccgcaagctttttatgggcggccaaaattgcaattagccccttgccgccctctgtatgggcggcaatggcctaatcgcaattttggccgacggcggcagacgacgcggtcgacccaccgtctgccacgtcagcttgccgcccaccattagggcggcaggggctatttctgtaatttttttggtcgatagattatttctgtaaatattaaaaaaaaatctaaaaacgaaaaaaattccacggcgacgcgggcgccggcgagagaaagcctcggtcctaaatgggccagatgggccttctgcccattactccttacctgggcttgctcctctgcctgggctgctggctgcttcggtccgccgtgcttcacagatgggcctgtcggcccaagacgagcggctctccaattatcgcatatgtgattgtgagtgacgatgggaacagtaacacaagctataataagtgtaacgtaagaactcatagagcaaacttcatctttattgaatgaaaataaacaaagttgggatacattttgcacattcatcggtgcatataactcgtcaagcaaacaagtatatttcgcgatggaaataaatcacgcatcacaccgtgtatagcagtattatatgttaattaccatctatcagaattcagagcaacgtaatcagacgacgtagcattcgtagagcttgatgtccatctgcagccggaagtaggtgaagccctcgaaggcgtcggtgcggagggtggcgacgccgcgggacatgaagaagtcgccggtgccgcccacgacggagatgtccctcgtcttctcggcgatgatgtcggcgcccatgaggttgagcgtgccgcggcgccccgtggagttgaacacgatggagaaggcgaaccacgcgttgaacgcctccttgctgttgtagaggtagaccccctgcgcgcgcaccgccgtctcctccagcgacggcggcagcgccctcccctccgtcatcgggtcgttgaacaccaccacctgcccgaagaaggtgccgccggtcgacggcacggcggtggccagcgccgtcggcttggtggccgccgccgacgtggagttggaggtgctgttgctgtagtcgtagaggatgtcgtggaggtagagcctcatctccttgcacggcttgtcgtagctactactcctgacgaatctccttccatgggcgacgctcgcagagcagctgaggaagatgcaggccgcggcgacgatcacagacgccatggaccatgtcaccatccggccttgcattgttaattatttgcttattatgaacaagcaggagaagctatatagctacgtacttagctaagtgcctgtcaatgctggctttgatttgctgcagctagagctggagttttgcatgcctatttatggaggtgagaaagggaataatgcatgcatgcggcatgccccaaattacacgcaaaggccaatgaaaaggatgctgcttctggttgtcttccgcaactgctcactctcttctgaggatctgtttgtgagcttaagattttaaaaaaataacttgttggtagtctgtttatgagaatatggagaactagatttttcagtttctaacttctagtttattttctcaattctataactacaacttctaagaatctaaatgaaaaactatattatatgaaagctgcagctcccaccacacagacctctggttgcttgaatgctctgagtctgactatcctcgtgcaaatgcacagtagaacacacttaccagtagtattttatgatagtggagctatccaccagtcaccttcaaagggaacacactttacttgttgtgcttcaaagggaaggataccagaaaaggtacataatatacttagctatagactgctagagtatccgttttctaaaagtttgtaaattaagaaaaactggttattaatgattaacggtaactaaaatgtttggtaactaataattactatcccagcattgtattcttttccaaaaaaaaaagttatgacctacttacgtggaaacatatatctcatctcttcgggacaatgtgtccgactagttaagtgggccaatattaagttacttaaaaagattacgataatatttaccttaaggatgacattttttttattgaaatatccataaggatgattcatcttacccatgacagtttgacaccgtaactcattcatgagatcacaaagtcctcatggtcattgagaaggtatcataaggtaaaataaaatttagtgtaaaatttgatacctcatattactataccaagagataataaatttataatagaaaaattgatacatcatatcatggtacccttcttaaggaccgtaaatttgctcatataacagaggcaaataaacaaaagcatacatatttttttaccaccaaatcaataacgttaaatcctcttaacaaaataggggcagatctgagcttgggttaatttagaaaaacaacgacaaaatcacaaagttaaaacctgaacttccgtgatgaatacatcacttaattaactaggtcttcctgttgatgcatatatatatatatatatatatatatatatatacacacacacacacgctaaaacttgcctattacaacccttaaaatggctacagaatgcatagcaacattggcatctagaaggagattaagattactgtactgtacatgtggtccacggacgagacaattaatagaggtcgcaactgaagctcactgtgtggttcggtcaagttgtgtcagggctgacgcgacagactattggagtgatgcccaactaagggcctgtttggatccctgtcacatcaaatgtttatacactaatttagagtattaaacatacattaattataaaacctattctataaccttggactaattcgcgagacgaatcttttgagtctaattacaccatgatttgacaatgtgatgctacagtaaacttttcataattatggattaattaggcttaaaaaattcgtctcgcagattagctttcatttatgaaattagtttttttattagtctatgtttaatactccaaattagcgtcaaacattcgatgtgacacggactaaaaagttttagccccatctaaacaccccctaagctttccatttcctttaggttgcaatgtcccttttatcgcatcaacgtgcatgaattaatgcaccatttttatgcattcttaaatagacacgggataataataaatccataaaattcttactacaatccatattaaaatcatatttattgagattagttattctgtgagcatcaaaacgttggtaggtgaagctatatatccacccacaagggctccaagcaggttgtacattttcgttttgaaattacaaaccgttcctcaccggtttgccaaaaactgatgactttcaatcagtgtctatgaagaccgactaaaattgattagttttgttaaactggccacaactatattatattgatctttttgtagctatgctcataattaaacaatgtggtggatataggcatctgactccactagttagagcaactccaccaacctacctaaatcaggctctccaaacatccgtatatatacgtatatatatagctagctctccaacttatttggcaagctagacctattgcacactctatttacattgggacccatatgtcaatctctcactccttccactacatcttcctcccaactacaacctccaatcctctatcctccagttctccacgagtactccaccaccaacccacggcaaccactacaccaaatccaagaattaccgtccaattaatgttggttgggaaagaactatatataccaacaaattgttcgtcggcataacttatcaacaaactatcggcgagagggaaagctgtcggtggttgcagggtggcaagaggggaagaagtcgatggtggcagcagctgcacctgggcgacgacggcactagcaccctggcgggatggaggcaggggtagggactagagtcaaccacatcggaaagatggggacgctggaggtggggacgacggttcagggaggagggtggcgcgacaacaagcaaaggtggtgggttcgcgtggtggagaggcgccgtaggcgtgacggccggtgatggcatgctctcacgcggtggggaaggcggaggcacaacgtgcttgcgcgatgaggaggtggaggcaccgcaggagagggattggggaggggagagaaggtagggtggtgggatccatgttacacacaggtggctcaatttgctagatttggctagccaagtgagaaatttgatcagccatttggcttggcaatttggatggtaagtctgttggagggtgttttcttacatgggagacatgacggctgtattgagtgtcatgcatggcagctggggagctatgggtgcaggaactggaagatgcaaatcctatccagactccagtacgactgttgcagcagcgcccacgacgagcccagcttgccggccgccgactcggcaaacttaattctacattcacttgactccggcggctgttgcggcatttcgtcgaacatttgcttggcatgccgaaccttcttttttttttctttattgaatgaaatgaaatggaggtgcgatacattctgcacacagtacacacaggtgcattttgcacacgcgcgcgcgacgtgcatatatacgactcgccgcgcgttaagacggagaaatatcgattgagatggaaattactccaaaacacacacacacacacacacaacgatcatgtttaatactaggattccacacaccgcttatgcatatatctgatcagacgtagcattcgtagagcttgatgtccatctgcacccggaagtatttgaatccctcgatggcgtcggtgcgaagggtggcgacgccgcgcgacatgaggaagtcgccggtgccgcccaccacggagatgtccctcgtcgcggcgttggggtcggcgcccatgaggttgagcgtgccgcggcgcgccgtggagttgaacacgatggagaaggcgaaccacgcgctgaagtcgtccttcttgtcgagaaggtagagcccctgcgccctcaccgccgtctcctccagcgacggcggcagcgccctcccctccgtcatcgggtcgttgaacaccaccaccctgccgaagaagtagccggggctcgacacggcggtgctcagcgccgtcggcttggtggccgccgccgacgtggagttggaggtgctgttgctgaagtcgtagaggatgtcctcatctccatgcatggctcgtcgtcgtagctcctcctgctgctgctccggcggccatgggcgacgctcgccgaggtgaggctgacgaggaagatggcggcgacgatcagagacgccatggaccaagctgtcatcgatcagagacaccagtgtaatgcagctagcaaagtagctaaacttaattaactactccaattgaataacctgtgatcgatcagctcgatcgagagagaattaagctaaactaagctaagctaagctaagcgcgcgcaagtaagacagtacgtgtgttgctgcagcttatattagctgtgatgtggaggtcgagttgtgcacttctgcatgcttatttataggagatggcaggaaaaggaatcctctcctatcttaaaataaactaatatcttagtatatactttctccattttacgatgtaagtcattttaacatttttcacattcatattaatattaatgaatttaaatagatatatatgtctacatttattaacatcaaaataaatgtgaaaaatgctagaatgatttatattgtgaaacggatg

SEQ ID NO: 36579 - DNA, 4705 bp, Oryza sativa
taggacctgcaaaaaaaaaaaattccgagttgttaggatagaaagaggaatcaagtgagacgtacgcaaggatactactgttactcctgttgctttaatttgcttgattctgacgctgataaatgtactgcggtctgtggattatgtaccgtaaggttaggttaaggctgtgttatacagatacatatttaaagtattaaacttagtctaataaaaaaacaaattataaaatctacctataatctgcgagacgaatttattaaacctaattaatctgtcattagcaaatgtttactgcatcaccatattgttaaattatggtgcaattaagcttaaaaaatttgtctcgcaattcataattagttattttttcgtttatatttaatacttcgtacatatgtccaaacattcgatgtgacaatgtataaaattttggcagtggatcttaacaggccctaactagccagatctgaagctggctactgctgattagctagctagtgtttgctggctttattactgcagctgcggtggagactggataccaacgccgcgtccttccccgtatgaacaccgtgcacagggccgtggcaccttgttgccgcaggtttcatgagtgattttcccggtctgcacccgaagccaaagattgttgatcatcctccaccatgcagaaccctactcgatcggcgcaacctccacttatggtttttattttttacattttagaactttttaaaaacttattttacaaataaatctctaaaagaacttattccgggaatagaatttttttgcaacgccaatatcgttggcgcagtgatccaacataacgacactaatttcatcgcataaatggatcagaggcataaatagtgtgccttgccctactactgccctcaagcaagtttgaaaagacacatttggttgagctggtctaaccagagacgtgttccccaccggattgagatcctctgcattgaagagtaaaatgcagaggatctatagtatttttgcattaacacatattttgagccattggatcttcattaaacggtacagatcagtccactacagcacaacgctacagtaaaaacgctcaacggtaaaacggtattactgtttagaacactggtgttaatgcaaattgttgtagtacaagttcaaacaatgttctctgcatttacggcagaggacctgcatccgttccccgccggttcatgataaagttgtcctgtttagccggttcaaagcggtctggtgcatacggtctttgcgctgaaccagaccgggattactgatgagcattagttcgtatttatctggtcgaactgctggtttattcaactatgcttcaaacttcaatcctcttaaatttagaccccaatccaaattcgacttctcttttcgtacacatacaattcctcttataagttatatggatatgtcaccaccagatacattgttctctagccttaatattccgtatgatctttgtcgacgggggatacccgtagaccggatatagagggtatcggggtccgttggaacgatgatctacgtagtacgacatcaagcaaacaaaagacaaggattatacttgttcaggccccttgataggtaatagttctaatccagttggtatgggattatatgatggaaaccacagattacaaagggaatcacaaaactcgatgataccgacgagaccgtagtcgagttggtccgactaaatctcccggcgacttggctcctgtaggctccaactccgtaggctgtggtgggtatgttgacggtaatattcgatgccttaggtcctgcctggggggtcccttatataccgcgggctagttgatctctatgtaggactcggagatatcggacccctcacgatatggtaaagacccaatcttatccgagtaggactccttccatccgtagattctgtttctatcacgtgatagatttccttaacgtatacggaaattatccgtatgcgtgcgggtatatcatattgatacctatcgtatatccaaggatagagggtataccttatccgtaaccctgacaatcttcttgatcatttggatcttagggcctgtttgggtgagttttagattctgagaagcagctgtttggtagccagcttctgagaatctggaaaagctctgaaacccagcttcttcagcttctggcttcttagttcattttttagaatctgtaactacagattctcagaagctgtggactgtttgggacagcttctagcagaagcagcttttcccaaaagctgcagctgggacaagctcccccaaacagggcctttaacttctcccaagtctctcgattccatcataaacattttgtgcaattgataaggttaacccgagattttcgaattgaaaatcatattaagcatctgttggcgatgctcgtgggcatattaacaccaatgttgttgtaaagccatcaaggtggcaaggttaatgagcaaagcacaaattaagaaagcggcttctccgactgactttaacaacagttattacattgttcccatgtgtttttatgctgccagaatattaaaatcatggttggagaaaaataatcgataagtatggtagagtagttgctaaagtacgatatctaattaagaaggacacgttaacacaataacactattggaaacaagtggtcatcctggaaaaggaaagttggagaacaaaaaggagttggagaagaaggaataatgagaggtttcttcttatggaaaaggtaagttgcaatgattgtcatgggaagggattggtcactggtgtattccaccatattctctccgccaaaaaaaaaaatccaatcctagctacgaaactgaacacacacgtgtccaggttcatagctaggattggatttttatgggacggatggtgtatttggcaatggctcgaccaacatgtgactataatgaagtagaaaataaatttacattcgaagcaacagcgagttggagacattaaacatgatatattgaatctataagttaatttaattttaggatataaaaagaaaatacatagaccatatgtgttgataaaaagttggttttaaatgtatcaatgggatgtcttacctttaatagtttaatagtcctattacccaaatattaaggatgtcggtgacatggggccgagggtatcatgcctagaggcttgggcagccgcggtcacccacgtggcctgaccccctcgggggggggggtcgggcccgtgggtgacgtggccaccccttcccctctctccccgaggggtcggaccgctcccgtttcggccccgagggccggggcgccccgaccccctatgggtttggcgccacgtgtatgggttaggtgagcacagcggggctcacctaaccgcatttattgcgggtcggacgagcgcgtcacgccgcatgtaatgcagcgcagcgcgctcgcttatccggtccgtgaccgggcgcagtgtgtgaccggtcagatcgcgggttaggtggtggcaggcggcctgttacacgcctcaccccgtcccgtcggattgatgagagcctccaggcacatgtccctagccggagacggcgtgccagctcctgaagatggcacgtcggtcccggtcagatacatgccaggcttcatcgcaaccattgtaaggaagtcattgtatgaagaagggcagacatgcagcttgctaaactgacggcgtggtggacgagagtgaccggtttgtccaatggttctgacgcctgtcatgtcataggcagacaaccacgctcccgttttgcacctccttccagcggagtggaggtaggtatgacccatcccatcggagggtcattcgaacagcagccattgcaaatctccgcccatttatgaagggatgacagggtgatctccgaggttagacgaaccaggacggctggccacactcaagaacaagctgtgttttagcttccaagagaaggcgagccaagttttggtgaagataggatgggtccccacccaaaagaaaagtaggtagaagtggagcatgtgggatccccttgagttataaaaggaggaccttgccaccaaaagggggagagccgaagaaaaaaggaggagggacgaaggaagacaacggagagaagacctgagctctctagctctccaactctctgtaattccttcacacacagatccaccagaacacaggagtagggtattacgcttctcagcggcccgaacctgtatacatcgcccgtgtcttgcgcgttttcttcctcgcgaacattccacagaccaagggcttagaacctcactcagcgcccccggccgaactggcaaaggggggcctgcgcggtctcccggtgaggagccccacgctccgtcaaaggagtattctaaacggtaaatctaattggagaggcatccacatgctagtactttagaagttttggttgctattaatctattgagcaagtaagggaaatattcctatcatctatgctataaaattttctcttaaattactcatccgatttagaatccgattacaccgatgtgttcgtaataattaaatatttataacaagatctcacatgattatattttgatgaaaaatcacaaattacttttatgatatgtctaaattaattttagattttactaagttactttttagacatataaaagtaaatt

SEQ ID NO: 36580 - DNA, 7020 bp, Oryza sativa
aatttctagatagagtcatgtttttatctctacaacggatttacttcaaatgacatgctaaagttaccttcgttttgtcctaagttacttctgtaatatatatatatatatatattacttttaggttttactgaatttacttttatatatctaagaagtaacttagtgaaatctaaaagtaatttagacatatcataaaagtaatttgtgatttttcatcaaaatataatcatgtgagatcttgttgtaaaaatttaattgttacgaacacaacggtgtaatcggattgtagatcggatgagtagtttaagagaaaattgtatttgaagtataggtggatgatgcctcttatagatggagtgatagctagtttagacaaaccagctaccactagctgtatagttacgtcctattctaaaatatgtacgttataccttttgtgtcataaatctagccaaggcaatacacatgggccgccccggtagtcataaaattattgttagagtcagacttcaaaaaaaaaaatccaaaatggtagttctatcaattcgcctattactgattataaggtaactcaaaagtaatttagaagctcttaacgacttaaaaactaatcatgaaagacaaactatgataaaaaaaattaaaatatactctaaaattaagctccaaaatcaattattttgttacacggctgataaactaatgagcaaatgatagagcaataccataagtatatagtataacgaaagaacgtactacatctttattgaacgaaaataaagcggtgtatacattgttcacacagagagtcggaaaaagataaatgggtttgggttacatttatttgcacactcatcggtgcatacagatactgcaggtactcgtcatcaagtaaatactaatatcgagaaacaaattccttttaaataaacaccacatcatcgattaattagttatcagacgtagcattcatagagtttgatgtccatctgcagccggaagtaggtgaatccctcgaaggcgtcggtgcggagcgtggcgacgccgcgggacatgaagaagtcaccggtgccgcccacgacggagatgtccctcatctcggtgttggggtcggcgcccatgagattgagcgtgccgtggtgcgccgtggagttgaacacgacggtgaaggcgaaccacgcgtcgaacaccaccttgccgtcgtagaggtagagcccctgcgccctcaccaccgtctcctccagcgacggcggcagcgccctcccctccgtcaccgggtcgttgaacaccaccatcctgccgaagaagaagccggggttggacacggcggcgctcagcgccgtcggcttggtggccgccgccgacgtggagttggaggtgctgttgctgtagtcgtagaggatgtcgtggaggtagagcctcatctccttgcacggctcgtcgtagctcctgacgagcctcctgccgccgctgcggccgccattggcgacgctcgccgagctaaggaggctgacgaggaggaagatgaccgcggcgatcagagatggcttggaccaagtagccatctgtgtgcctagcttggcgcgtagcttgcagagtaatgcagctagctaagtagctaacaaacttaacaatttgattagcctgtgatccatcagctcgagagaattaataagctaaacgcatgcaattaagacagtacgtgttgctgtagcttaataattagctgatgtgtggagctcgagtttgcatgcttatttatatatagtgtccttgtgaggagtggcagactccgagctagctagttgttgttaggatagaaaggggaagtaagacgaccgaattgtttattctcaattccgagttgttaggatagaaaggggaatcaagtgagacgtacgcaaagttagcactgatgctgatccgtcaaccgcatacggcgcggctcccctcccctgctatcgagatccggccctccctctccctcctaatccagccggacggggagggcagcgatggtatagatggtcaaatgggccgtccggccagacacggctcaaccaacacgccagaccggtccaggcttgtccacacgctgcacccctagcttagacacgccaataagactcatgccgcatgtcgggtcggtttaaaggcacgatagcccatcgtattttttcataaaataaatctatttttcctcccttatctatttggttgtatcttatatgactagaataagtctattttatatccctcttctctttgggcagtgccttatatagctgagtcaagtctatttgggatccctcaactatttctctttgtcatgccgagccgtgccgagggagcagcccaggccgggccggcacgggcacgaccccagccgtcgggcctcggaccaaatggccatctataggccacgggtggaggtggtggcgtttttttatttgttgagattgtttttgccggcggatggatgttgcgcctatgaaaagattttttttttgaatgccaccgggggggaacttctcacctgaattaaaattaaggaaacatcaaaactgtacaaaccatacaagaagaaaagaggaagcataacagagcgaaagaaaagacgaaagagagagagaaaacaaacaagagagattacataaggtggagaggagaggagaaggatgcaagccaagacggaagaaccgcctggtcagccagcttgaaacggtttgcccaaagcttggcgtcgttgacgcagcagcggagaagacggttgatggatggtgcaaggtgctggaaaacaacttcattacggtggttccataagcgccagcagcacaagaggaagaaggtgctgtttagtcgttctggaaggtctccagaccagtggatggtgtgaatctcactcagggaggttagcatgtgtagcacttgaatcaggccccaggaagcagaagccagggggcaggcaaggaagatgtgatcagtgtcttccgggcaggtattgcatagctgatatgttggggaggggatgattgacttcttgtgcaggttgacagcagtaggtagtctgttcatagaaattaaccaaccaaaaaatttaactatcggaggggctgagctcttccccagatgaattcctagggtggccaaagttgctgactttccatggttttacaataagggcttaagttgatatcaggcaactgcggcagctgattgaactttgtattgtgtcttggtcttgtgagagtgggaagtcttgaagtaggtcttgcagcagatgcagttgttgttgagccactgttgacagccttgggacaaggggtaaattaagcccagcgtggagcgctgaacgaaccgtgagatgagtagttgtgttgtgagagaatagggctgggaactcaatcgagagaggtttatcagtcagccagacatcaagccagaagtttgttcgacagccatcaccgattttcatagtggaatgagctcgaaggaccggcagaagagtgattagagtgtgccagtgttgtcccagatcggctgagccgagagcaggcgcctatgaaaagatgtagaggtcatcttctaaagtgatttttgcaggaggggttagtggcgaaaatcgtctattttcgtaagccttgaagtgcaaacggggtagagctccgcatggaaaaatttttcttacccgtttgcaaaaaaaacagttttctagtaatgatttgtattagttataataattagcacttcactttcactaccaggaagcttaatttagtttctttcagttggagaatatgtttgttactctgtaccccttgatacacatttgttacttatgtatctctggaacaatacgtttgttactctgtacccatgccatcgatcaaaatcctacgttcgccactgctatcgccggttcacaaccaccgcaaatccggcctgcagccttgcgaccgacgagcgcagcaccgttcaaaccggtgaacatagtcgtctacaagtactagttattagagtttaatcagtctcaaaacagcactgaacaatgggataaaggggccggcagtaggggttgtaggcgtttaatttttcaacagcatcattttttgctttacgaatgccacagattctaaaatctactaacatgacaactcagaaagctctgtgcatctttatcggactaattaaaaatgtgagacattttgcagagcctttagggaattaagaaataaattgagttggtgctatatactgcgcaggcattttttttatgggaaaacacaggctttgccatgtgatcctccgacaagtgcgccgtattaggcaacaagctagcttagcagcaaatgcaagctggttaattggttaggtgaccaccaattaggaggagtagtggcattacttgttggcttcaatttataaattcgcctcgattaggtccctttttctctacgcgttgcggacaatctcgagcaacaaaatcgctgaagtattcatgctcgtgtttatttctcgagaacgaaagaagaaaaaaataaagacgaggagattatacaaatctcaccgagaggcggatggcacgtctcaccacgcacacggccacgatccatctttttaatttgtgggctacagttgacacggccccaactagtagttctctatatgaatatctttaacaaatccctaactttacactaataaaagcagatggaatatactatattcacaggagtttagtattagtagtaactgaactgcaatataatctgcactggttgacagagagtggatatgcttcatgaatcgggtgtgtagcagtagtagcgcatgtgtcttgcgtagccacgcacacgtgcatcacgagctccatgtgcgtctgcccgctttctacgccggtactacgtgtttctcgctagacgcctcaacaactcatgttttctagacgcctcaactgaagcagctgatgcacgcgcgagagagatcaccggagatgcaacgcaaccaacaacaacaaaaggggctgtttggatggtgatcgtactttgccacatcaaattttagccgtgccataattttttagttagtgtttagttgagtgctacgattaaatcaaagtggccaataaattattggccatattttgagtagctttaccacagttataataaatggagttatggcaaagttagtctccatccaaactgctcctaacatattaaattcgggcttcgtcatgatctcatcccatccaaccccgtgctcgccaggaaacatgcagtacaaaccacttaaaccgtgaaaagcctgaaaattaccattaaattctgaaaataacttctgagatttgtccacgtcatttagagtaaaaaaatatttctggattcgaccacaagtaaaagttttacttttaattatgtgaaccaatctcatacactcatttctaaatccaactatattttcgggatgttcactattgtacgtggtttgtatcacttccccccatcctaaaatataagtattttttagcatagtgagtcaaatattttttaaaattttttgactattaataacaaataaattaaaaagatcaatcacgtaaaattgatgttactatatttatcattaaacaaactatcataatatgtaaattttttttcatttaaaacatcttgattttatagatattgttgatcaaattagcgtatcgaaaactacgtcgaaattctaaaatacttatattttgtgacggggggagcaacgtagtatattttttccatgctcaccggctgcggagcacggcgcgcgggagcacacttgagtcccgcgtctcgtctcggtgccagaatccccgcgcggacggggcgcgacgcggtctccggtggtgccagccgcggtgaccacataatactatcgcggtcggctcggctcggcctgactagtcgatcaacgaacccaccacaccagcggccggcaggaatctctctctctctctctctctctctctctctctctctgtatgtggtgtggtggtggttaattaactgttcagtcaggggcagcacagccacaggttgctgtagtatctatcacaggatcgccatcacgacacaattaagacactgatcaagtgactgcagatggatcaagtgcatatacaagacgcgagcgatgggatccatccatcgagcccactgtgggcacaggcgacggcgattggttaattgattttctactgctgtcgtccgatccaatgattctggttggagtactaattaattgactgctagtacgttctgtagatgatcatgtggtgtttggagccatctaacagtccacgatccagctgattcttggaagggtgtttcctttgtttatactggttgttgtaccaaatggttttttttaactgcatgctacctcccgcccccgggtaactatcaatcattcgttgatactacaagtgaagtgagtggctagaagtaaaatgaaaaaaaaaagaaaaacagtgcccttttggctatacaatacaagaaaaaacatttttatgcgacttttgaaagagatttgggagcgtgagacgaaatggcctctcgatcggaactgacgagtagaatcggagtcaactcatcgcccataagacttttctaccgggcgatttgaccaggtattgaaaaacttgacaacacgccagtggaaaatcaaacgagctcacacacagagtaaaattcaaagatcaaaatttcaactttcccttaatttccacatccttgataagcccacattaaaaaaaaaggaaaaacataacaagttaaacacgcagttaaccacaaataacgagaaactcaaacacgcaggatttttcacattttggtccttttaaaaaacttatttcgcaaatagacccctgaaaaaatttatcccaaaaatggtcctttttagggcgccagagtggctggcgccgtcatccaacgggacggcgccagcctgccaccgtggcacatgcgaaccgacgtg

SEQ ID NO: 36581 - DNA, 12651 bp, Oryza sativa
accgccaacgcatcctcgccatgaagatcgacgaacaggtgaattaaccttgattgattgctcatccgggttcctgttcctttgcttggccggctggttaattaatttcttgctcagataaagagggagatcgccacgttgaagctgctcaagcaccccaatgtcgtccgcctccacgaggtgagcttcgcaacccacagagtttcagcagaaatcctttcttttgtgttttttttactctcttgctttcttcctcttgctgttcaacgcctcttgcgccattgatgttgccgtctgaactcctctccggctgcgatatagcactaattttttttttaacttggctgctaatacctctctttggataactctcccccttgtgtgcagtagaataattgtcctttttactgtttcttgacctggacatctgcataaacaattgagcacacgaaatgaccacccaatatgtttttttcctgctcatggaagtagtaggacaaggcaaagggtctttcagtttcagcaagcaatattatttccctttccttttactgcgctcttgcttctcggagtattttagtcgggtgatgatgcgcccgtgcagacttgggtttatcagattcccctgcagcaaaaacaaacttgggttgtcacgtcaaaccctgcgaatctcatcacggagaatcgcccactggagcattggaatacttgctgatgagatcatgtggctattaggagcaaggttcatgtgccatctgagccgtacaatctgatgatccgatggccgtcgttgctctacatgctctgaagcctgcctggttaagacccaatccagaagccaccaaaagagctttctgacgaggttggccgacatcacccaataatcagagcgatcttttactagtcacttttaggcaactttcagtcctgcaaggcagagaaaacacagaaaggctgcacgacatgagcccaccacagcaatacgtcatcatatctataatgcaattcagaagggaaagtgttaaacgtggttttggtaccatttttgtaagtgttaggttcaccgaatgattgcattagtggataaatgtccgtgagaggcttacttcttgcaagcggaagattagaaaatggagctcctgactctaaagcaaaaacatatgcgcaccagtgtgactgcccaatgatttggtactgcccaatgatttagtagagagagagagagagagagagagagagatgttgcggctgttgatcagatctctgcctcccgattgttcattaaaccttgtttctgtaggagatgcaattgacatcaagaattagctggggctaaattcctccagtgaaaaccttccccctatccgtccaaacctgattccctgaaacatggaattaatctttttattgttgcagtttcagaaatgtcaaaaagaaactacttttcagttgtacacatccacattttgtccttgggaagcctgagatagattactggtttttcccctgcaggtttcagctagcaaaaccaagatatacatggttcttgaatatgtaaatggaggagagctattcgacaaaattgtaaggattttgcttctcattttaagcatgcattaatgaatcaaaaacaactgattgtgattagggttttacacaactctaacaatctgttgatgcatgacaggcattaaagggtaagttgtcagagaaggaaggaagaaaactcttccagcagctgatggatgctgtaagctattgccatgagaagggagtttatcatagggaccttaaggtgactacacagtatcactgatctatctttttcatattttaattgtaagcaagaaaataaggactgatccaaatggaacacacgattaacatatgctattttctgtgtcttctgtagccggagaatgtcctagttgatgcaaaaggaaacataaaggtttcggattttggactaagtgcccttccacaaaatcaacgggtatggaattttctcttacatcaaatcagctgaataaattcgttggtgtctaaaataaggctccaatttcagaaagatggattgttgcataccacatgtggcagccctaactacatcgcccctgaggtaagaattaagcattcttaaactgaacctattattgtttcacggtctttagtttagtgcatatggaggatgtagttctgacagaggtatatacaggtccttctcaacagaggttatgatggctctttgtccgacatatggtcttgtggggttatcctatatgtcatgcttacagggaatcttccatttgatgaccaaaatacggttgtcctttatcagaaggtataaagcaaggaatcaaagattacctcagcaaaaatttggctaattttatttggctcaatatctcaatttaattttgtatccagattctgaagggggatgctcgtattcctaaatggctttccccaggtgcccaagatatactgcgaaaaatcttggatcctaacccaattacacgcttagatataactggaataagggcacatgagtggttcaggcaagattatactcctgctatgcctttcgatgatgatgacgacaacaatatcagtgatggcaacctacatatgactgaggtaacccaacgttaggtgtactttttgtttgccatataatccattgctttaactgaatggtatagattgaactcaatctgtgttctctctcgcttttttttttcatggtgaagaatcaagatattgaaaccagcccagcaatcagccaaatcaatgcattccagctcattgggatgtcctcatgccttgatctatctggattttttgagaaagaagtaagtttgatctttctttcttgaccctatttgctaattccttaactaacacctacattaaatcctagcctgctagccaaaacagacacacccaaaggtcaagtaggccgtaaatggaagggtcccatgtgaactcatcagaccataaatcatgaaataataagttagtgaccagcaatttgacaaagccatggattgttgtcttatatatccgatgtccctactgagacctctgctacgttaatgcccttaactcagacatgtgactttgttacaggatgtttctgaaaggaaaatcagatttgtatcaaattattcccctacttctctatttgagaagattgagagcactgtcacagaaaagggtttccaggtacagaagaacagtggcaaggttagtgacctcagatgtatctacctgtaatattaatatgagctatacttacactgctcatgcatagatgttaaactgaaacttatgctatcatgtactacagctaaaagtgatccaagtttgtaaagaaccagcaaatccaagaggacatggaaatttattgatttctgctgaggtacttctatcacattgaacatccatagcaataaataatcaatagtgtgcaatgtgccaatgtgtttctgttaaacatccatgattcttaatattgatgtactgcgttttcaggtgtttgagatcaatgaatctctttatgttgttgagctaaaaaggtcatctggggattgttccctttacagacaggtatttctccctcccttgctgaatcagtattttaattcattttctgatggaaaatttaaactaaattattttgtcctagagcattgttcttacttctcaaacttccaatatgcaatttaacatatatggtattgtttatgttgcagctatgtgcgtcactttctgaagacttgggcatatgcaaaaggcaacagcttttgaagaaagattctatgagacaagacctttgtcgatataacagtagcttttgataaaagggtctctctagcttttagttgtgaaggctctagcatttttaacaagagcccccaatacaacgacgtatgacacagttttgtaaaattaaactgtaaatacaaaacaatccaattgtacaccgaaaagagtataccgatcatccaagtatttcctttaggagttcattagtttgtgttctttttgcctttactggtaaatcgctacctcctgggcaaattggctactgacagtgtataaaagtatgatgtagacaatctaagtgtacataaatagttacctcatcttgtgttcctttgaagttatgtgttgaatgtgtaagtttgtgtcttgttttggtaaaagcatgttaagttcaccagtaatccttgcatgagcactgcccttcactgaaatgatggaaacggttccggtctctaacaatcaacttgcgatcatacaccaaggagatcaacttcatagctgaatggcaatcttcacaagctctaagattcttcgttattcgaatagttgacctcgcaggggtagttagcagcgcaaaagcaatggccagcttctcactatgttcagccaaggagcgttccttagattgctcatcaatatcttgcaataccaaacctgtcataggcttataacctgcttgttttaaccgatccatcatctcttccaacactctgtagatctccttggaccttggatgcaatctatcaccagagacaaactcatgaatcttttcatcccattcaattgaacttcttccaggaatcctctgaatattgtcccttctaatcgtcttcctcatttctgcaacaccttcccaagagtttgcctgtgcatatatatttgacaatagcacatagtgtccatcaccaagaggatccagaactcgcagtttggccatggcttcctctgcaatctccacattcttatggatgcgacaggccccaagtagtgctctccagataattgtgtcgggttcgaatgtcatgctcctgatgagttgtcttgcctcctcaacatggcctgaacgccccagaagatcaaccatacatccatagtgctcaactgttggctctataccatgaacttcattcattgatctaaaatacttcttgccttcgctcacaaggccaacatgagtacacgcgataagaacaccgacgaaggtgaccccattcggtttcatcccttcagatatcatcttcgagaacaagctgagcgactcatggccaagcccgtgattggccagtccgataatcattgaactccaagtttgcacatccttctctggcattctgtcgaacactctctgtgcactctcaatgtcaccacacttggcatacatgtcgatcagagcagtgccaagcttcaagtccagctctatcctgttgctctccacgaagcggtgtacctctgcaccaacggccagcgctcccaaatcactgcacgccgagaccacgctcaccaaggtaatgcagtccgggatgatgctggcggcgtgcatctcccgccacagctccagcgcttccttggatcgccggctcttagcgtaagcggagatcatcgagctccaggagaaggcatccctgtcctccgtcccgtcgaatatctccctcgccaagccgacctcccctctcatggcgtacccatggatcatcgtgttccaggacaccaagtccctcatcggcattccgtcgaacaccttcctggcctccgcgacctcggagcgcgagacgtacgcagcgagcatgacgttgcagaggaacacgtcgcgcaggggcgcctcgtcgaaggcgtcccgcgcgaggtcgacgcgccccgccttggcgtacatctcgacgagcgcggtgcggacgaagaggtcggcggcggcgaaccccgacctgagcgcgcgcgcgtggagcgcggcgccgacggacacgggcgccgccgcggacccgcacgcctggagcgcgacggagagcgagaaggaggtggcgaggagccgcggcgcgcgcgggaggagcccggcgaggaggcggagggactgcagcgggaggctcgcgcggaggtaggcgcgcatcacgccggtggcgtagagcacgtccggcctcgccgacttctcgaggcgcgcgtgcactgcctgctgctccggcaacgccgccgtcgccgccgccgccgctccccgcttgccgcgcatcgagtcgagagagagggagatccccccctagtttgtacatggcgttttaaaaaaacatcaaaatatttgaaaattttaataagataaaacaatatgatatataattccacgaacatacaagttcgaattcggtttatataattaaaaacaaatatgataaatttgattgttatatttattgtcaaatttatatttttatacttatatataaattaaatttgaacatacatatttgtggagtgatatattacatattgatctattttattattttataaaaacgaggaaaattgctatgcacacaacatgtacaactaaaattgattaacggttgtaaacggttgcaatgcatatgaacatattcttttttattgatctatgttgtactccttccgtttaaaaaaatccaacctcctactacgatgtaaaatattttatctatgtccagattcgttgtcacatcctagtacttgtttttttacgaagggagtacgtctttagttgtactcgaaaaggagaggagagggctttagcaggagctaagcagttgcgtgagttaatcccgcactctgtataatgtacagctatagtggttcttcgttttccttttatctctagggatttgtattttctcatactctatccaatgaaaaggcactccgttcaaaaaaaaaaaaaaagagaggagagtttcccggagagagagaaaggggaggcaaattgctcgggaaaagtcgggtgcttctcggccgccagatcggcggaagcgatatccgacgggtataacgccgccacgtagtcatccgcacgaggcaaatacgtggagcggcctcggctgctgcttcttccattcgctttcgcctacccgccgccgcgacacggaatttcaggcggcgccgctcgccggagaagtggtcggcccccgtcgagagggagggttagacagggagaaggagaggatgaggagcagcgaggccatggagctcctgggcctcccagcgcacacccgcccgtcgccttccgaggtattcatcttctcgattccctctctcgccgctccaccgacgaatctccaaatccgatgcttcttcctgggggttggtacggccttgattaggtagctcttgctcggaagaagcgattttagagctggattttggcgggacggggtgccaatttgagaacctgattgctatgcggttgggagttctttgagtttgtggtggtgttctgaacctctgaagcttttgattcaggttaaggctgcgtataggagaatggtgatggaatcgcatcctgatcgtgtcccgacgcatcagaagtctcaagccgagtcaaaattcaagcaggtcaggtacagattgatctctgatcattgtggaaaactcctaggccatcatgtttttcggtttcatggtgacggtgtgcttcaagcatgaactttatgatatgtgctttccacaatcaaatggccgatgtatgcttgtttttgtatcactagctttccaggacttatcataaacatgtatgtatatggctttgcaatactgcacgcggaagaatttttcatgtctgcatgataattagcaatactaatccgtttccagttggatgaatctgaatgcggatttaccaaatgagcattccgtacactttctgaagttgataaagtgtgagttttaacgtttcgtgcttctgttttttcagatatcagaagcatattcttgtttgaaggatggtatgtcacatttctgctcatctaaataatcaacgcaaactcattccctttacctatattgctactcactcaatcgcttaccaatgagatttttttttctttgttgtcgctgttttcaggaagaagatatgggagtaggatggaaggtaacaaaatcaatttcatgaacacaaaatttgctgttctttgtggtagctaatgagattcatcatcatacatgcagtacatgtgatgaggtctggtgttccgacgggatttggacgatcaaataagacattggttaaagccccttttctactcataatttttgcagcggtttcattgggtggattcagcgcttcaaggtaattcaaagatcccagagtttgccctctccattctgtttttatttctgaattgattgaggaatcaactttggttttttgaagagcataccagcggcagaagcaatgtgttcctctcagaatccatttcttccatagagcaaggcaattgtagcatttccctattgacaagcggagcagagttatgtgtacattgtaaaacaatcatgctgggaacagaagcaccaaatgcaagtcccatgtacattgtaaacaatcatcaagtttgtgaataaaagcatgagttgctctttgtggtttaccatgatagggtgctattatttttctgcctgtgccaagacagttcgtgctataaaacatgaacacataacagcattcaacaagtaaatggtctactgatgatttgtcaatttagtgatatttgttttcaacttggcacttttgtctccaattggtcagtatgacaaatgaagacatcaatactactcaactagcaaatctcttctagttgaactgttcatgattgcgacccaattgtcgtgttttcatttttttttcatcgtttgttcgactgctgataaattgtggaaacataaaggattgtgttcttgccgaactacgatgaaaagacatcaaaagttaactctaaatttaagttttaaaatttaacatattggttgtgactaataatccaacgagcaaacgatggacatattcagatatacattttgaactgaaaatatttcatatatagtgaacaaagaaagatcattacataaaccacgctgcaagtgaggtacaaactcagatctattgaagttgctcgtgctcatcctacagggttgttagtttatgctgattaaagtactgcatctctcttaaacacaaggatcaaccggaactccagcatctgtagtagcaatattaactcattcccgcattcctgcttgagttgagtgtaagtgttcgcagaacggctggattacattacacgagatacaactcatgcaaattatagtagttgcaacatgagaattcaagcatctggcagaaccagcggccgttaagagcctattcgcaaatcctaaggattaattactatgaatgctattcgattcacagaaattttcctttccaagttgttgagagaaaacatagaaaattttccatccactcaaacctcatgaaaaaattcctatggattgaagtgtgcatccattaattcttatggattgaagtgtgcatgcatttatattccttcaatattcctattcctatgtgtcgaactccaaaacgaatagcacctaaatagatttacaagaaacatgatactgataaacattagctgattcccagccttccccagcagagtaagccgacaaaaggataactgtggagacaatgcaagcacacaacagcacaaaacgaatatgtacataaatcatagcaagtttatagttccatggcacgctggcaaggttaccaaggcagctctaagcctctaatgcattactgacaatattgacatgtaccacaagccatagcaggggtagctttgtatccactcgaagactcagacacattgattaaatggacagcaaaggatctctgaacatcacatggttcattcatcgatccattcgtgttaagacgaaggggcttcaacttcggtactccattgaactgaacagcttgaatagttagcatattctggtgccactatggcagatttccacaaaatagacaataatattttgagcagatcataacctcccaatatcaggcactattatactgcctgaacaaaagatcgttgttctgtatccattttgctgattgaagaaccactggactatccttatcataccattaaccaccacctatgctgttcctggagtactggaagaaaaaccagtgacagtttgatcccaagttcccaactaaccactaagcttaaactagtaactatttcatctttagaagaaaggtttggcatactgtagatgcaccatcatactaataactttcaccagagcatagcatttgaagaaaccaccagggcctcaaattatccatctgacatgagcagacaaatgtaccaaggctaagctttcccaccagcacctgtcgtggcatcaaccactataatgttaaacgacaacggctgccaccctgaagaatgcggcacaaaccacttctttgtattgattatgatatacaaaatctgaagaacttcaccaagggcaagatgtttcaagcattgattctttaagacaattgcagcttgatacctgcaaacagaggatattgaaacaccataaaacagaattcaagaaaaagatacagaggattaacacatattgatgggtgtcaggccttacttggatctagaattctttatagcagagctgccagaggtggaagatatgaacctatgaacagcatcaaacgtatcttttggatattttgcatttatatccattatattcacacatttccaaagattttggttcttccccaaatagaatgacataggacctaacattttcaagacgatggcttgatgctgaatggcaagttcaagagccttcttaacatcaaaatttggtaagttagcttctccataacgtatacaatctgaaatatgctgttctattggtggaatcttctctgtcttcaatacttccaaagcacctaatatatttcttataagaccttgagggtcagaagatggctgtggatatcctgggttcactccccattgtccagcattttgcatgttgctgggcatactaggtggtgttggaggtctgtaactattataagcaggctgaacattatgaggagagccagaatggttagggtggtagttcatgttcacaccttggttgtcatgaattcctctggggtatccagaaatatttatccgattcaaatcaggataattaactggtgggctgtgatagggaggggcacttggccaggattgcagtggtgcagtaggagcgccattatgcccagctgatggtgagcatgagttggttctttgtgaactcaatgtatgatgaaaaatctcagatccactatgaggatgagtaattgaattttgtggtcttggagactgggaggtatgaggtttatgatgttttggattatagccaccaccgttgccagagtcaggagtaccattcttcgcagcagattccgctgaggcaccagacttcttactattgaagtcatgtggagcagtcttttgatggcaatgagcagattttgcaggctttttaggcagggaaaagggctgaacttttggtttacttgactggttcacctttgccccatcctgtgattcagagcttgatgatgaagatgacgatggcatagaagactgagttggatggtcagtagtgtattctttagaattatcagcaacttcaactgaattttcttcgttgcttgctggtttagatacattgtctgactggtttcttcgaggttgcttcactttagattgcttatctgccttgccattaccacccttttgatgatcagactggagaccattctgagggtttgtgtctgtagtagtgtctgaagaatctgaattaatgttcttagacttatctaactcaaccatattgccacttgctgtgctactaacatatggcgactctgctagaggtggttctccagctacaaggcttttccagagccaaacacttttcgctgcagcagtaagggcctgagacacatttggaggctgtgctagtagaatattgtaccgtctcattgtaagcttatgaagggcattagagaaatcccgatcaccagaaattaacaaatagtttgctggtggagggttgtcaatagcccagaacagcatgtcaactaagatcttcttatcacttgcatctttaatacctgccagttgataggaaacaaattagttgatatcaattctgtcattgtttaagagaaaatgaaactgtttaataatataagtcttgcaaattcatgaatctttttatgcaaaaaatttgcttccatgaaacaagctctagtttgcaagaataattaagaaacatggattcaaaatcagcacgcagctatgccaatgacatgtataatcgccaacattcagaagaatatctgggatgcaatatagtggttaaggctgtacaggtccggttaaactggattttgccaacccacacaggaataacatggtatgtgcctgtatttattccagtttgacaaaacataactaggttgattcacccctaatagtaataactcaaaatcattcttcaaaacattacacaaatcgtacaactgtggacctaagagaagatgaaaactcgaagacgcggttattagaaaacaaaattgacctagtctactacacaaagtcaaatggaagacatggctactagaggcttagaactttgtaacccgtagtatcatatccgcaaacacaatcaaaatcataacagcaaccagtacaaataactactgcagaactactg

SEQ ID NO: 36582 - DNA, 6014 bp, Oryza sativa
gggggttccgtttccgtaccggcggggacgtggttgagggagatgccggtgctggagagggcgtgggtgacggcgttgccgatgcggccgatgtcgccgtaggcggagatggagacggggccggtgtagccggcggcggcgagggcggagctcatgttctgggcgatgaggttggggtcgcaggcgcgggggacctggcagttctcgatgtcccaccacaccgacgtcttcgccgtcgcgtactccgccatcgccaccgccgccgccgccggtcgccgactccggtgatccccccctagggttcgccggcggtgaggtggggggagtggggggctggggtttgcgggcgtggagaggattttttattggttttcgacggcggcggcgtcgaggtggactcgaggagaagctattcttttgattttttttagataaaaaaatataattaaggacgatatttgtatatggataaaatagtttggtgcgaagtggagagaagtataaaaaaaacatatacacggatatccgtacctggatttgttttttctaatgcggggggagtaaagttcaatggatacaataagatctttttacttatgctaagtcaaaatttaaattttaaaatttagttttagagttgattttgtgattttttttataatgatttattttacagtatttgtttttaatcgttaaggacacgtatataaaggttatacgtataagttattttctaattgctaataaacctgtcgataagcatatgaataagcgaaacgattgcaccaaataaagtatttcctttttgaaatttagacgtacgtttttggaaggcatgcaatcaaatttgtgcaggaatccaaaccattagattttccatgcacacattattgaacatctgtagtagaatatatgcacgtggattttcattattactaaaccattttaaatttttgattctaaaaataaacccccaaatttattgaaaaagtaaactttttttaccacgccatccgaaggggagtagcaagacaatgcaaaggcagggatcaggatcctatgcagttgactgctccgtgctgttatcactgacatgtgataaatgcacggtaaagtgactgcagaggatctcatcaatccgcaagggcagtagcctaccacgtcattgcgggtgccatgtcatgggtttttttactggtgccaattaaaatagtatgattagagatgtttaaatatagcaataggtttttggatgggtttttttcaaaaattttaaaaagtgtttcaaaaacaatccatggttgttggttgctatctgttttctccatagaaaaggtaaaggttaatcatgacttgacagaaagattttatgtttttatacggaaaaagagagagcccacatagcagtgcgtatattcattcgcaaatgaaggctctcacagttcgctctacggctaataaaccatagaaaaataaacgagtcaactgaataaaaataatttatcggtgtaacttttattattctttgtattgtaaaaatcaaaactaaaatgaaaaattttatctgcaagtaaatctttttggcaggtacacagagagcacaatggtgatggtgcatacctaccatggaaagcaatgacctactatcaaaaggcgcagaacaaactgcatcatcaggacatggaaaaaaagcaaagctgcgtcatcgaaagctataatacagagtaaagtagtaaaaccaataaaagcagattgggctatagaacaggaaaatgcactactttaaagaagttaaatcagtgaacagctaaaggagaatgggccgatgagttaatttcttctcctttttattagaagaataaataaatgaatttagtaaaaagaaaacatggttacaaaaaaaatgatggaggcatcctttggaatagagaaattttagagaattttcgtatgaattaaaccaattactgtgaaatcctacaaaattcataggttccaaaagacttcttaagggacatgtgctggcccatgtagtagtccttttgcttagacaacaagaaagaacggcgtctgaagaaatggtttttgcagaaccgtgtaacttttttttaaaaaaagagaatcgcaacttaaaaggtttatgttccctcttcatgagagtgtacttatcttatgttttttacattgtgttttgtatcacatgaatgattaatgcgcaccatattgtttactatctcattgactcaagaaacgtccacactttgaggttttgttaagtgacgtgttcgtcgctgtctatcacggccctcgttctagcactggaaggccttgcctgttcggccgctccagtccccttcctcctcaatcttccgcatcctcgccaatggcaatggcatggagaaggagatccatatctcgtcctagtcaaataaagtttttaggtttttcctcaagtaaaatccttatagggttttagatttccgagataatcgagagtttatctttgtctatggattacggaatctagacaattattgacaagatagaatagatcttccctctgttggtcaagtttttatttaattggcagtatcggctttaggacctggtttgccgacatgttcacttatgccagttttctaactcgttggaagaatgaagacgatgatcgatgctcgtttatatggttttgcacatgttgaagttgatcgatgttgtgactgcactcatttgctcgtatctcttgtggtaatctaagatatagagcctctttgttctattttctcatattcttcctttcttgcttttgtaacaacagggttgtgatatatcctcttatttaatatatgggagaatagcatatttggtccttcaacttttgcttggagatcaatatggtcattgatatttcattttgttcaaactggtcctcaaagtctatctttcagtctgctatggtccttagacccaccagaaaacatcacgcacacataccgtctcacaatcttatacagatttgtcatgaaatgtctaatatacccttacatacaacataagagagaaaaaagaaaaatgtcacacacatttgcaaatactcaaatatatcgatttgtctatcaatacatctaacataatcaattttgtgtatatatcaattcttgggattagattaaattatctaatcatataaaattaattagttacagtatttcatatcacatacaaatggacagatcagacatttcaccatccatttttaataagatgatgacatggcatgtctacattacgcttctagtggacctaaggttcatattggaccatatgacaaagtttatagatctgattggaaaaaataaaatatcaaggaccatattgacctcaaagcgaaaatttagggaccaaatgtgctattctcccttaatatattttatcatgtttcgaaaaaaaaaacagaaaatagttcatgctttgttaactttaggatgaactagttggtgctaaactcaacaccaagcttttataacccctaggtgcatacttgatttgcaaaattccagaaccgacagcacgaggttttctccccagatcaatggacagagaagtttcaaaagctgcaaactatatgtagaacaaaagacattcacttgatgaagttagcttactactgataactatcaaagtacaatctgcaccaagccatgaagctcaacaagtacgagaagtatgaacaatgccatgtgcgtggcagaagaattctacatttcgctacaaggcagagtagagagagagagaaagagagagaggagacttgtgctcatgctgctgcaaagctgaagtgatgaaaccgtggcaactactgtagaaggttaacagctataggtggctggcacttgaaaacaatattccaaaccagcccaggaattacaagagacaagagcaacctaattaattacagagatggtatcaggacagggaagccttcaaggcaagggctcctccgaatctcccaaccgtgacaagtgcaggtaagcatcggtgcctaaatgacagaaaaggcaagactggtcagatcaacatatagtggattataaatctagaatttgtgataattgcaaaacaaagaaatacacaaaaaataatcagttaaacatggatggattgttcagcatctaattctataacaagtaattggactttgtcagcacataaaaaaacagaaaacctcagctaaacaaaggctaaattattagacattcacattggttagaaatcagaaaggaaatgaagtgtgggaataccgtatccttccatagagatgatttgcaggtcaccaccaaaatatcgagcatacaggcgactgattggaagaccatagccatatccagccatagttactccttcactagggcaatccatatcaggtggattctttgcagtgctatatagatatgtgaaaattcttggaaggccgctccttggtattccaccaccttcatcactaacctgcatcagcataacattgatgttgaaacacttaaatatcacttcccttattttatgaaaattccaactccctgatgtttcctcacatggaatatttctcaaatttattccaactagaatacattatatattgcaccaaaagattgagcaagatgtaacttctaacgacggaaagcatctgccacgtaaaaagacagtagcacctatcattcttgacactgaccagtttctagtaatgatagtaatgatatgccccacaaataacatggcagctgtacagaaaggcagcttgacttgcatcacataataacagtatatcaaataatgttcttcagctaattaaattttctgttcgtcaatattactagaaacaaatataccattcaatttgcatccacttcaaagataaaatatagcatctttcttactgccagattggtttaaagttgagacatgtcctgttcagcagccagcgctaattcttacctgatccttctgccagtcaccatccaactcaactaattcgatataactatataagtcagagttattcatatttgctatttatgccaagaatgttaagatcgtatgataaattggtgccagtggaacttccattacagtcatttgagtctaaaaacttgtaaaggtacaactcatttaatgactgctcatacccaggagctaggatgctattaataacagatgtttggtgatgtaatagatgaataccttgatagttacatcctctgccccatcagcaacgataattctaactggaggaacatctttatcggaattcatatatcgttcctgtactgcacgcaaggagttcttcaccaattcaaatagcatgagatgtagatgtgatgaaacatatctgcagtttacaaggttaaaggagttaacacattagtatgccaaaatttagtaggcagtaaaagatgaccccgaacaaattatgtcttataagaatagtcaaattgaacagaaaacaagctctatgacaatagaagaataatcacacaagatgcactaacagaaaacatgaactggactaaaacatggttaatgaagtttgaaaaaaactaatgttaatttatatcggagacttacggaaatgtaaaagttgggtctccatagatgtcaatctcaggagctgatccatattccctcaaacaaatagaacgggcatcttcactggcagcttgagccacctgtataggggacaattctgtattaatgaggcctatgacgccaggctctgggtcaggatcatgcaaagccacatgctgccctgaaattaagcaagttgacaataactcagaacaagaatctatcaataactagaactgcactcttatatgattagacaaattagcacataaaccaccatacgatttaggacaggttaggagataaagttgactaaaaaaagatgtcactgccggacaccaaatccagagttgcattatgacaaaaaagcagtgtcaagctgatgaagtact

SEQ ID NO: 36583 - DNA, 5883 bp, Oryza sativa
atcaatagtgcgtaaaagcgagctcgtcgttcctattcctcacttctggaaagtatctgatgtcgcggaaagagtccaagtaccaatcccgcaccttcaaatatggcgaacaaacccaccatcagtcccacaataagaaacttaaaatttgcatgaatgaattcagctgcgaaaattccttgattaaatatttactctgtgctgactccaaaattattctagtacaggcgtgataagatcaataagacagcacaacataaacttgaagcaaattaagaacccccgaccccactccaagagaacaaaattcaagcaagttggcgagcaagaatatctaaaattgccccccttatcctactttttttagaacacctttcgaatattaacaacacaaacacacaattgatgctgtgtcaagagttatcgactactacaccaatttcaaccaatacaaatcgcacattttaagtagttgcatgtggtagtgatgtaccttattcacactccactcccccagaattacctttcaaaaaaaatttcccagaattaatgataaaggtgatattctaataataacaaaacatgaaagacatcaaaggatccatccaaaaggcgccacctctttttagaataattcctattaaacatcactgcaagataagcagattcagataagcatgcaacggcataacccatccataatcaaccgagccacacaccgaaaactcgccattaattcatcatccatccacgggccaaaacgacagaacaaacaatcgccatgattcagtgtgggcatagagtaatatacatccaatcgcccaccaaatcatcaatcaatcaaccaatcgatcacaacgaacacacagagagatagagaggtgcgcgtggtaagtaactaccttgaggatggcgggcttgcgggagaggccgaaggggagggactcgagctcgagcgcgcggcgcgcgatccggattgggagctccttctgcaggaactgcgcggagagcagcaggttccgttccgtggggcgcgacccgaactccatcatgtagcgcaggctcacccccgtctgcttcatgctcccccacctccccacctcctccgccaccgccctcgccaccggttccgacgccatcctccccccacctccacctccacttttacctccttcaccggcggcgagatttggggatcgacgagcgcggcatgggaggccgagccgagctcgcgcgcttataaagcggaggaagcgaagaacagaggagaggtgtgtggcgtcaagaaaaataaaaaaataaaagaagaaaaaaattgctggattagcgctgcactggtgtgtcccggatagaaggagaggaatatggtggggcccaggtgtcagtgggagaggggtatcccgtgcaaggtctgtggggccgaggtgtcagtgggagagggtggtttactggtgtccagcgctaggtctgtggggccgggtgtcagtgggtggttggtcattggaatctgttgttagccacatgagcttatctactatgaattagtgggataaatctcaggacaatcgccccagcttaatcatgtgtttttttaatctatcgtttcgacatttccgtaatctttatccaaaagtatgttgtgcttagtgtaaatatgttcgatcagaatttccgaaacctcaaaattcaaaaagttctaattggatcgaataaacaagcattcctcgtatattaatggccgaaggaatatttttgaactaaattaggcctatgtttagagtacaattaaactttagtagagggatgcggtcatggtcgacgacgaagacgacttcacacggaaatttggtccaatggcactaccaggagaatgaatcttttttatgctaaatgaatcatttcatttatgctaatttactagtggacactattcatggaagattcaggccacatgctcattttccccccacatgcatgcacaacaccaccaaaccgcagaaaatgaccccaaacgattccaggcctcaaaattctccaaaatcaagaataaatatccatgggttaaatttttaaaattaaccatatcagtaggaaatatcacagtggttaagaatctttcagaaagagatatggctagctttataccataagttgtgatctaagtgacaaaggccattggagagagttccaggcatggagcgaggcaggatggccacaggtttggatccatggtggtggagagatccaacgattcggcgcaaagggagaaccataggttttgtttgtaataatcatcagtgtaatacgttattaccttcgaggcttaattcttttcggattatttatcgaattgttgaaacgaattgtttacttcacgtttttaaaaaaatattcatttttttgaatgaaaaaaactttcttctactatatttgctcagagaacttgttttaagagattatcaagtttatttaccaaaacaattaacttgtgtacaaaatagataaatcaaaaataataattcgctcaacgatctatttcaaatctaagcgtttagatcacttgattgattccaactgtaataatcaaggcgttgcttgctcggagagggcaatgatgtgggtcagaaacatcgctagctggtaattaactcgcccatttaattaacagaaatgtgacatctctgaaaccaaggttcactgattggtctgcacatagcattatatggctagagatatttgcaggagcaacattaatttgtgacttattatttcacttaggcccgtttgagttcacgacggacaaacattaaatgcgaacatgaaaaacaaaaaatattaacgcttgattaggtgagtttgaattattttaaatcttaagaaaatatatttatttgatattttaaaacaatttttggatagaaatttttcgtacgagatgtaccgtttaactgtttgaaaatcacgctaataaaattcgagtaaaatatgtattttaatcagaacagaaccagaccttatcacttatctgagcttgataaatttccgataaattagagtgttctaatcagttataattcgtttcatgatttagggcggaattattggcggcaacacgactatcagttggtacgactcatagtacagcggtttgtggtgggggctatggctgtggatggatggaggggaatctcttttaatttctctgtgtgacacgtcggtcggcccaataatgccaagggatgaagttgacacctctggatgaacgcttggccgccacgtttccgtctccttggtcatcacggattccagggccaattagctggctggttcacacgtagtcttccgtcgttcatgttggtcatattttaattacgtttaattacacgctctgtggagtatacatatatgccacgtctcctgtgaaacattgattaaatttcacaaaactatatatttaagataatatattacaaaactacagatttaacactgaatttctcataaaattatagatttaaggtagaatattataaaactacagatttagtaacaaaattatcgtggaactatatgtttagcatcaatttaattacaaaacttagatatttataactcaatcataacatattagtgctaagaatttaaaccccaaaacctatatctttgtgataattttattattaaatttgtagttttgtgatacttaatcttaaatctgtagttctgtaataatttcatggttaaatatgtagttttgtaatacatcacattaaatctgtagttttataataatttgatcaaagtacctgcagttttgtgaaatttactctgaaacattttttggtagaagcacactgtatacgcagactctcgtagcacacgtatactcactcatatgaacgtacacacgcacatcttactcatatgagcacctccgaaagactgtgcgagcatatcttgagattaacgaagtcatgataggcgtctagcacgaaaaaaaaattaacaataaatacaagcatcggcgtaagtctaggacttcaacttaggtagactgattccataaaaaaacataaccagttgagttacactcacttcacactttatgaaacattttgacgtgcctcaagccatcaaccagaattattcttgtaaattgtttaagcatgttcatataatttttgtaattatagcatcttttaaaatctacagctccataaaccgtagttatcaaacctagaaaataaaaataaactagaaactgggaaactaatacttcttgattctcaccaattacgtcttaaaatctcaggctcttcaaacaacacgtacgagctcatctctataaacgtgcacatgcatacaacgtacactataattgtcgatgagtgatactcgtaaaccggatgagttgggtattgatgtacattgtaacgaggatctatgtaatacgacatcaagcaaacagaagataaggattatactggttcaggccccttatcaggtaatagccctagtccagattatatgggactcatgatggaaaaacacagaatacaatggaagtagacgaattcgatgataccgacgagatcgtagtcgatgtattcgacaagatctcccgatgacttggctccgcgtactccggctttgtaaaccgtggtgggtgtgttggcgatgatattcgatgccttgtatccctctctgggggtcccttttataccatatatcatcttgatctccaagtaagactcagagacatcaaatcccgtacgagacaatagaaactctatcccctcctagtaggactttggaaatcacttaactcgtagggatattttctataatttgtagcggattcctacaacacatacggaaataacccgtgtacatgaaggtataccatatccatatattccataagtcgtagaataggaggtatgccttattcgtaatcatgacaataataaccatctctgaaaactgaaccagaatatctctagattgatgaagtcaccataacgccttgttatccatgtgtacattaccttaagaaaatagtcgtaaatatgaacactcgtcaaatatagaacttgaatattttaccataagaaatcacaccaattaagcgtgcacctccaaacaaagactctagttagtatattatgcaagaggagtgacacacgtcacacgcgtacagtttattaactcgaccggatggaagacaaaaatggttggaacgtacagtactagcatatactcgtgtaacggcattgaatatcgattgatctgtcacatatcattgttagtaacttttttgacaagtcgataagcacgatcacaacatctaaacgtcttgtggtgatatagagtcgccaaccacctcaatctagccgaacggccaaatcaagatgggttttaagggaaaacaactaaaccggctagcgaaactgaattagagatcaaaatcagcctctaggccgatttagatcgatacgaggataactacccgtctcgtgggcaaaacggaaggttttcaggacaaacctataaagaggtgtcgcactctcgcagcggcagcggacggtttatggcgcaaaccgacaaagatggactaaactagggtaaaatataaaacatagtaaaagaacgattcaaatagattgtattcgggggttttacaatgaaccggccttgtcccttaaatagggattggtcttgccctctacaggcccttctctatgcccaactcaggatagaaaccaaaggaaacacgaaacatgccttcccgagcaaggaaacccgagacccgacaaaaacagacttggactcggaccctgcccgtctgaccgctacatacctgcggtcagaccggccctacta

SEQ ID NO: 36584 - DNA, 2030 bp, Oryza sativa
agaccggccctactagccggtcagaccgcccacatgcctgcggtctgaccggccctgtgaaggaaacccgatactttccaaactttggcaattttcccctatttcgtccataggtgccaaatttgggtgtaaacacatgccccccctacctttttggtgaacatacgtgaacctaaaagtatagaacatgttatctcagggcgataatccaattaccagccataggacttcctaagtatcttgccaaatgctcgggaagtatttcttcaagtatttcccattaatcgctctctgaaaacaccgtcttgaagtatcttcatctcctttaaagtcttcaaacgcttgtcgatgacgtcttcaaaattgcttcccatcaaggtcttgtaatcttcaactgacaagtcgtcttacttgaaataccgaagagagccaagatttacctcaactggcaaaacggcaatttcaacaatgtttctttactcgactcggcttatccattagcctgagtgtagtaaagagaagaacttaacaacttaatatcataagattcagcaaaacttctttggacataaaagaagctcctttaacgtttgaggaataccgaatctatgaacaatatgcttcaaaataaagtcaattacctccgtacaagtaatattctcgagcggcacggcttcggcccacttagtgaagtaatccattgcaactagcacgaaccaatgcccttttgatgacgaagaataaatttgaccaatgaaatctaaaacccaacctcggaacggccatagtttaatgataggattcaacacagcggtaggcgctaattgaacattgccgatccgttaacaagcttcactccctctataacatttgaaacaatcatcaattattttcggccaatgaaaccctactctcctaagcagccaatttatcttacgggccgattgatgaatttcacaaatcccttcatgtagtactctcctagaaactttagattgatcattatctaagtaatactccatctatttttcggcgatataatatttgagcgcttgccgctgaatcttccaattaaccttaagtgtaggatctttcaaatatctaatcaaaggaattccccaagctatttctaactcatgggcacaaatgtccgaattcacaattaattcggccttttaatcaattgtaacgtgccccccagcctcctgtctgagatcggtcagaccggccacgcaatgccggtcagacctccctgtctgctcggtcagaccagccatgcagagccggtcagaccgccggtaccactggtcagaccggccatgcaatgccggtcagaccacccctggtctatgactttgccaatttcgtctaaacttttgaaatcaagcatcggcctttagtatataatttttcttcacataatagccagatgcttggtgtatcaaattattagaccaaaattccttctctctagacatatgaaaaactataacatccaactaacatgtctagatgaatactaattcaaatggcttttaaaacaataatcaccatggcatcaaaacacttagccaattgaaatatgatcaataatgaatcaccaaagtcatatgcctcacacacatgaattccaataaactacaaatgtaagtaatcggcttgagcatgtatgtaaaatattagcaatgccaatgtttctaaagaaaacaattgtagaataaatcatcacattgaccattgacattagccgaattactaaataagcaaaactttcatggtgtaataattataaaatctatatcttatatggtgatccataaaaacacatccaatttggctttaaataaatatcgaagactcatgagccaaatcatacttcaaacaaattatatgccaacctaccaattccactacttagaactggcatttacagcatgtatgtataatatcaattcgataagcaaaaacacacatgtgctagatagtaagcaatgttctaacatggcataggcatataatataaataatgg

SEQ ID NO: 36585 - DNA, 16711 bp, Oryza sativa
ggggtcctacatgtcattgaaataccgatggcatatctcaaactttgaaaaattataatggtatggttacaattttcccaataatataatgatgaacacaataaactcataccttgccttagaatctaacaaacggcggctcgaagatgtggtattgtatccatcgccgttcatcttctcttggttcccttatgagcatattaatgtcttgccccctaagcaaaatcggccttcttgatttcacgatttcgaaggcaagatgaataccgcactaacatccatagcatcatgtgaagaagacttatctttaatgaccgatgattcttctctcatcaaattgaatccatcactactccgtgaaatcaccgatcttttaacttttacttctttaggtctccacactcgcttaagtgtcgttcaaggctctaaattgatacatgttttgttctccacatcttcggcctccttttctttttgacctatggctcgaagacgctgtagcctcctcttttgagagcgagataagccagaaggtatccacttcagctgtggttgttttccaggagctaagcaatgattcttcatatttttggtcgaagtggaagctcctatgttgctctcaattttccctctcacctttaatgccccccagtctaatcggcctctgggcccggtcagaccggctgcaagccatcagtcagaccggccagtaaggtcggtcagaccggccgtagactggcggttagaccggccagctgtcttggttagaccaccaatgttgacagtcacggcggcggcttcgatcttctttgcttgcgtggtttccaccgcatctccagtaggtacatgaacatattgagactcctccttgacagtgacgacctccgaagctttggcttctttcctcacccacaccttcttcacctttttcacctttgatccaccggaccgattcttttgtgggaaacggtcttgtcttgagttagaatgacttggtattgtcctaggtgattgcttccatccttgatgacacggcatatgtggttgaggcatccatggaatgtaatacataaaaggataaccaaatgatgacattggatgtggataccatggcatcacaaccggaggtttatatggagttggtatagttgatggctccgattgctttgatgtttgaccaaatctcttcctacgagatgatcttggtcttttcgaatcactagtttggttatcaaatcgttgaccagctaatcctttcttgtacttagccataagcatctcaaaagtgagcttcggctttttagtcttttgggaactagatgacttatcttttgtaactttatgatcttcagccttcgcatttttgatcctattcttgggccgaggatccccaataataacacttttccctttctttttgccaacaccaatagaactaacagggagaggatcactaataattccggtcttaggcatagatgtaaccgaaatagtttcacaagtgaccgatgaagtatcaatcggtctttgctccatcaagcttgcatctttgaaataaccatgaaactcatgctccatttgtgaccatgtagaaattgaattaggagcaaataaactataccatgtagatgcaaagtttgacaaagaaagaggaaacaattttaacttaagcaaatcatcattaccggccttaccacattgatcaataaattggtcgatatgctccattgttgttctagcatcctcacctgtgaatttcgtgaagttgggcacctcaaatccttgcgggtatgggaccgaatctacgtactcaggatacggcctttgatatgtatgcatagctactttggattctatttcaccactatcccgcaagacattgtcatcatcttttccaacatccacatgaccgatttttgattcggtcttaggtgacaatgctatttcattttcgcttgtaatataatccgaaccatcacttagttcggctatattttcaatgatgctattctctaaactagcaatgcaatccgaaccattgcttggttcggctattccattattgtctaaattagtaacacaatacaaaccaacacttggttcgactataatggttgttgcattatcatccaagctagtaagacaatccgaaccaacacttggttcggatataatcgttatgacatcattgcacaaattattaacacaatccgaatcatcgcttggttcggctatacatgatattgcactataatctaagctagcatttaagctattgtcatccactcggctttcctgagccagagcttcatgcaacacatgatcaatatcaagaaatatttggccattcaatttctctttaatagaatcaagaaatccatcatatgcaatgttggccaaatctttgtcagttattttcaaactaaaacatcggcttttaatatatctaaaccttttaatataatcagcaacagattcattgtatttgtgcctaaccgatgttaaattagacaacctaagctcagtttcactagtgtggaaataatcatgaaatttttgttctaattgagcctaggaaaaaatagaatttgccagtaaaaaagtaaaccatgtaaaagcagtaccggacaaagataaagaaaacaagcgcaatttacatgtatcccaattatcctcaccatattgcgctaaaaattgatctacatgctcccttgtggtcctactatcctcaccactaaacttggtaaattcaggaattttataaccacgaggatatgggataatatcataaaaatcaggatacggcttttggtactctctagcacgattccttagctttgcgatattctccctgatagtatttctaaaccaatcctccacagtttcaggctttggtggatctggtggtgtatttggtggcctaagaggtggttattgtggcgcaatataattatattggccatacctagtatcggaaggatatcccctattagtatcattgtaggcattaggaatatgtggaatagcatgtctaacagtattaacaggtgatgaataataattaaaattagtactgctaatcgtggtatgaaaacctggaaaaactcccagggaaccggtctaaccggcccatggcccggtctgaccggtggtcagtggtgcggtcagaccggccacaggaggcgcgatctggccaggatagggcacagtctgaccggctatggtaggcacggtctgaccggcataggatgcggttagaccggtgtcatgaccgatcataccgttagctaggttttgcatatagccgattcctatgtaatcggctgtataatcacacattgacccccatagcattataagcatattgtataggagcaaaactagaagtagcatatgcatctatacaatgatcattaaccttttgaatagcaaagtatgggttgggcgaatcggaggttacctttggtgaaactacaacttgaggtagcgggacatttcctctcacgacgccttgagtaatattgttgaacccgttcccactcgtcatagttgatgaagaaattccttgattaatttcggccatatagctcatagtcgaaatttttgaccgaatagattaatatacggtctcgtaattttcgttgcatactactgtgtgtttgtagcaaaaatttacaaaaactgaaacttcccagtgatagccgatgcaaattgaatcggctttaattttttcttttttaataattcactcggtttctgtgcacagcaaaaaatatacagaaatcaatactactgctgctggctctagatagatcggctttgtacagcctgatcgttttcttttcagcacacgttaaacagcaaactataaataggattggatttctgatttttcagaccgtgtacagcgaggacactaccggtcgcttgttgctgtttccacgcgagaataaaaatcgattccggctgtatagccgaaacactcgattagatgggaaatcgatgaatcgatggcagcaatcagcttgatgaccgaacagtatcgctgccaaatagattgatccaatcaaaaatacgtggcagcagtgacgaattttgggtagattgatttcggccgtttggccgaaattcttgactcgccgaaacgaaaaagtgactagattaaacgaaattcggccgtgatatggtcgattagatcgtttcccagcggagtcgccaaaaatcatgttggcaacttttttgacaagtcgacaagcacgatcacaacacctaaacaccttgcggtgatatggagtcgccaaccacctcaatctagccaaacggccaaatcaagatgggttttgaggaaaaacaactaaaccggctagcggagccgatttagagatcaaaatcagcctctaggccgatttagatcgatacgaggataactactcatctcgtgggcaaaacggaaggttttcaggacaaacctacaaagaggtgtcgcactctcgcagcggcggcggacggtttacggcgtaaaccgataaagatggactaaactagggtaaaatagaaaacatagtaaaagaacgattcaaatagattgtatttgagggttttacaatgaaccggccttgtcccttaaataggggttggtcttgccctctacaggcccttctccatgcccaactcaggatagaaaccaaaggaaacacgaaacatgccttcccgagtaaggaaactcgagacctgacgaaaacagacttggactcagaccctgccggtctgaccgcctacatacctgcggtcagaccggccctattagccggtcagaccgcccacatacctgcggtctgaccggccctgtgaagaaaacccgatactttccaaactttggcaattttctcctatttcatccatagatgccaaatttagatgtaaacaaccatattacatcattgccgggactaacatgaggcatggagaatcgcacaaacatgcaactacgacctacggatcgatggcgcacgcatgtgttgttgtttgggatcgtgtcgcgtggtgctgtaaatattaattattgatcgaattcgttcgttagagaaacagctcgggatgggaattcccttctgtactactcatgaatctggatatttatattcaaatttatcattagaattagatttttatgagacgaagaaagtatgctactattagagagtccgatatggtgttcgcatgacctgcttctctgaatgctaggagatctagtgcgtgtatatgttgtaatggaactatatgaaggaattacatattattatcatttcaaatattaatataagaattcatgttcctcgatatattccacttaatagcatatgggcggttggttctttaaagataatggaataatacatcatgcctttattttagaaaaaagctaatatataatcacttattacaaacatagctcgcttaacatagagatgctaaaaaaatccaaacatgacgaggcaataagtctaaaaactccaacacagaggagaaattaatacatcttatttaattttatttgtaaatatctatccaaagttggtgaagatatgtgtgaccgttgactctaagttccagtatgtaatatgtattagttcattatcctcgtcatattttatattttttagttgtgcggtgctaatatattgccttggaaagtacatcatccatataagatttagttaaagatttatcaaaaccatattatttatactcaaccataaagtccaacagaaaaacatatggttctactaagttttttggtttttgagcatatcattctaaaaaaaaagcaggcacaccaacacgtgcgctgattttgattttatagtatgattaataacaaaccacccattctattagagaaagaaaaggtcaaacggggcaccgcaaagctacagctacagattacacgcaggccaattcctatttgatttaaggcaggaaatgcgtgtattcgatctgtttcgtctatctgacgcataagagctggatgagcaccgatcatcaagacatcaacgtgtgacagaagatcgatgaacagttgtacactactacaattctgcttgcctgtatttaggaacaaaagtataataaatatttgaaaaaaacattgcacgctatctacgtactgactaatattttttcttcttcttattttgcaggcatgcgtgccaaatgagaagtcgttatattagcttggatcaacgggtgggcatgtactggtacgtgcaaaagcccaattcatatttttgtactcgtgatttgtcatcctgatcagtaactactaactagaggcagcagcactacgtggaatccggagacgtgcagtgccagggcatgcatgtgaaaaaaaaaaaatgaagtgcacgccaaattgagcaaccttagccacgtgcacacgtggatggataacgcacgcctgcaagtagtatagtggcaaaattatgtaaaccatctcaattatcactcttgttttgtgatttaatccattacttattttgtttcaaaaacctactcacccaacactaacataggttgaaattgccttatcaaccctcccccaccaccccaacccgcgcacgcgcagtccaaattttttctaacttaaatgtgcgccaagccatatatagcatccagtctcgttcaatattattaatgtaatgaattcaactcgaactcattctatgaaaaaaaaaacagtgttacttgtaggggtggaaaaaaaatttgggctcgtgagcagctcgggcttggctcgagctcgcttagcctggctcggcttgaatgccaaacgagcaagcccaagcttcctttttagcttggttctgaaacgagccgagcctgagctggcttgcgagccgcttgatttggctcatgagcctagcctaggccatcatgtatttatatggatgattttttttctagtgaagttattatttgtcaatatgtaatttatcatctatattttaatgaatttaatatataaagttattttaattttacatgttgatgatttgttattgcttttcttaatgattacaaattatatagcttcaatggaaggctcgcaagtcagctcgagctagctcgagccagaaaacgagctgagccgagctcatgttttagctcgtttccttaatcgggtcgagccaagccaaacctagcttattacaagccattgcaagccgagcctagctcggctcgtttccacccctagttacttctagcttacaaactcttcgttggaccttgagtggagaaatagcctaaggacaaatccgagccagctgatacaaatccgcgtcaaaataaaatgggtcgaatgtgctactcacatgcgtgtacatggcaatttcaacatgtgagtgttgaggtggatgagtttttggaataaaacaggttgtgacgtagaatataaaaaataagggtaacaattagagtggtttacgcaattttgcatagtgcattccatgcttgcttgaatggacttcgacttttgatgcaattacttttctttctctttgattgagatggcatatatgcgtttgggccttgagtagctgtcggcctaatttgtacaggccatttaagagcaatattatccggcccataaaccgattggtgggtccgagctgggcatcgccatccgcaatagggccgtggtaagccagattgggcctgatgagttggatcgaaaggcaaactttttttcttttgccgtcggatggataggatgggagtgggaccatcgacaacgcatgccaccaacgagtgagacctaaccgctgctggcttcctgccaactgtttttttcccaggttctttttttcccggcatttatatctaatcggatatatgcggccatttaaattaggaacttagcctcataaacaactcaatctataattcgcttctatgaagatgtgaactcacgaccttagggtactactcaggtcactgtaaccattaggctacatgcttcctgccaactagacgacctaatcgcttactacgtgattcgtgtataaaaataaatttattttaagatgaagggtataaagaaaacaaataaatggtactgataaatgttatgtgtcatgatatgcttaaaaaaccaccatgggtcaagaaaaggaggaactttgctcccttcaatcacatatttgattttccttcaaaaaaaatatgtatagagatgtaggcactcatattcacacgagcacacttatctatataaagttttaaaatttttagcaatcaatatcttctttaaatatgcaaatcagtcgaaaatcacatacaacatataaaagatttatgttaataattacgtcatatcgctattttagcactatgttatatgcctactccttatgtttttgtattttaaaacctaaacccttctaaaacttttttccataatctgaaccttttaatcacaccagcacacctgatgtggtaaaacaatactgacacgccacactcatcgggcgtgacaggtttgtccggccaaataacattaccacgtcagccggatcagcgtggtagtgttgttttgccacactagtctagctgacgtggccaactagttcagatattgaaaataatttttgaaatgatttatttttaaaattaaaaaatttaaaagttcaaaaaacaaaaaaaggatcactccttattgatatatttgactaactacatcgatgtttaatatagtaggtggctctcatcttttctctatggtttatagtttataaaccatggtcaaattttaaatttaaaacttgattataaagttttttttatcgtagtttattttttagcattagcttttaatatcgcttaggacattgttaaggtaggatattaaaccaactctatgtgcatattaaactttttcatagtaaaaaaaatattgtggtacctctcctttttcaaaccagcattaactcaacaaaacttacctacctcccttagagcaaggataataatatagcccacttcctaatattagcccattctaaagtcaacacatataatagattagctataattttcttctcctatctctatctctcacttatacatttaatgtatttgtcttgaaacttgtgttaagctagcttttgcatgagagccaacaccattctcttttgtttacctctctcctccacatgagcttatagtatgcttatagctcactattatacttgctcttatctcaaaatcaagcaacccataatgtgaattttatccttaagcttcgttcccctcttgcttttccctccctaatcaactggaccgcacagctaatacccttgtcggatcccgactccaccccacccgaacccgctacccgcacccgcacccgcaccaacccatctccttctcctcctaactcaactcgactccaaccgccgctcaccggaatgcggcggtgacaagacgaccaaccacctcctgcgactgctcggatcccgcgacgcggcggcggcggcgaaatacggagatccggcagctggaggcaagagagagagaaagccatggcgagcgacgtgcccatgagccccgacctggaacaggtggacggcgagatccaggacatcttccgcgcgctccagtgagtcaaatctccccctcccccaccgccgcctcctcctcctcctcccccctccagcattccgcccctccctccaccggtttagtgggctgagaagcttctcgaggcttctgcggaagcggcggcggcggtggctcagatcttccccactcgcccaatctgcgctcgaaattgttcgcgggttccgctgctgggtccactgcttttcgtttgccggaatgggttccacaagatggcaagatcaaggacctcaacaggcatctccacggcgctggaacatctcaccgggaaaaagacggactgcacggggggggcctcccttgcctgcctgaacactactgggtgctctggtgatgcacaggctcacgcctgaacccatggtttagtttagcttctccatctgtgcgccattgatgttcctggcttgaacaagcaatttaaatctttttgcatgtggcgcatgagttctgcaactgctctgcctgttagatggagcactaatgtcttgatagatttgtgtaaatgtgatgatttggtgttttctcgcagcttaatcaaagaatttgatcgtattctcaaagaggatgagaaaaagaactcggctgatgtcaacaagcagctaaatgataagaagcagctgatggttggtagtactagttttcttcactagtgtttgtgttacccttactggacaatttagctcacaagtgtaatttgtttcttgtgtgttaaaacagatcaaagaattgaattcctatgtcacattgaggaaaacgtaagtagattttcccctttcgttatgcatgtgttattttttttccttatgttgaattcagcgtttcatttgcatatgtgatcctgttacattgtacatcacttgtggtaatagacatgcaactctcatggtgtttcaggtaccaaagcagcctgggtaataagaggattgaactatttgatactggtaatgatcaggtggccgaggacaacactgttcaaatggcatcaggtggttgtagtttcttatatcattgttaacctgcccctgagaggtaatgtgttcttattctaaccaaagcactttggtaattcttcagaaatgtcaaatcaacaactcatggatgccggaaggaaacagatggaccaaacagatcaagttattgagcgttcgaaaaaggtgcgctagtagattttgctttcatttctttacacacttcaagagcaaattttacaagaatcctttcttgtaggttgttgcacaaaccgttgaagttggatctcaaactgctgcagctctatcacaacaagtaagttttttgggatgataaaattcaacagaatattccttggacgtttcttgttagaaaggtcagtcctgataagtttaatccagcaccctaaaattctctttacatccttttagacagaacaaatgaagagaattggcaatgagctagactcggttcacttttcactgaagaaggctagccaaatggtgaaagagattggtcgccaggttctctctctctctctccccccctgcacacacgtatgttactcgtttcgtcccaaaataagtgcagccctctagttcaaatttgaactagaaggctgcactcattttgggacagatggagtatatttgaagtggctgtgcctagacttacaagattcattgctgcaggttgcaactgacaaatgcatcatggcattcctatttctgatagtctgtggtgtgattgcaatcattgttgttaaggtatgttttaattgcttttgcaaatgtacccatgttgtttaccttaggtgacatcacttgttgagataaaaactgatcctatatcctccgtatgtgcaagttcaactaaaagcccatgacctatggtgaaaatttctgtccagttaattgtagagccagttagtgcacctagctagtttctcgttaactctacgtgttctattatatgttggagataagaatgacgaataaaaggagcaggaatacatcatttggataataactagagctagtgatcagtcccacatttggtgtgttacgtcatgcaatgctatacttaactgattcagttccagaatgtcatagattgtttcatttgtcacattttacattacaagctagtcttacattactatgcaatgaatgaccggtctgccgttcttccagattgtcaaccctcacaacaagaacatcagagacatcccaggactggcaccacctgcgcagaacaggaagctcttgtccatagaatctttcggaagcctctgagcattgcgagtgggaggcaaccgagatgtttgggagaagatactatgcacgtcgtgacaattcttttgcgcttgtatatcatctcatgtcgttattcccttccactgatctattcttttcttgctgtaattggtcattagtgttggatttacgtttgatggttgcagtgcggcttcctgttggctttatgaatgtgtgtatatgtggtagtgatgaggatacaaagatatttgttgttctttttattctgcaagtaatcacgtgaaggcttcagtttgcagttgttccagttttcatatctttgtgaattgtgatttgcttcagtctcgtcagaataaaaaggtaacatattcgtacaaaatctaacgcccaacttggcagggtcagacaaaagcatctgggcaaaacaacgtcgttcaggccaaaacgtaaaataaagatgatagaaatgcaaggatcctagatggatcactggacttatgttacagtgcttgcaaaaggttaccgggcaacaagttatcttagctcttgtacgtcccaggaagaggagcttgtgttaactgattaattaacaagtaacattaaccctcccatggagaggaaggctatgtcatctctcggatcgaactaaagaagaggcagttcaggctgtagagggctgtgcatcctcgtcggacaataataggtcactgaagaaagaatcagtgagacaatctttagcggaatcatacttggctaggcgtttcttgaacgctcggagctccctgtcgtctttggaagtaaatgtctagcaacagttactgaggttagcaatggtggcaaatttgatttgtaggcaataacaaaatcagcgcaaattcaaacgttgtcaggaaagatgaactcacggagtatctcttctgcagtacgatatcgacaagataaattagccatacgacgtttgtctttggaaagctgcaatgacaattaaacagacctcaaatgtttccgattttgaaagtatttttctatcaatttctgattaaaaaaagtttactgtagttttaaatccatgcaaaagtaacttcagctagtgaatagccatacacatagtttgtgagtcggctagaataattagtactttgctattgcaagctaacaaagttggtctgaaactacgaatcctgcaacaatgtcaatgacacgcgtatgtaaatggctcaagaattgttctgtcttatgtagtggagtacttacctgccctcccagtaatcattggtaatctgtttcatttttcggtatgtttctgcctgcatattataagaaacatatattacactagcccaaaatgatttaacatgctactttcaaagtgatcatctgaaaacctgcttatctcgttttggtccttcaaataaggcagggtccgttgacaggtctaaaaagaggatagcatcacctggagagtatcattacaaacacaaaaattgtcaaatggacaaaacataacacgtaaaaggctaacaaataagaaatgaccgtatcactttgctcttgaggaaaaaagaacaagaaccacaaaggtgttacatacatgcgtagcacttgagatgcaaacttgaaatattttatggagctaactgaattgatcatatagtaataccagaagttaacgtacatggactagccagaagatgggcatattcagctaggatctatcagatccaatatgaacttggaggtgcaaatgtaattattactcactccgtcccaaaataagtgcagttttgcactgttcatgtccaacgattgactgttcgtcttatttgaattttttttaagactagaaaaaatgcccgtgcgttgcaacgggtgaaggctattttaatcttattattattatatacggtttagttaaggtgaaatttactgtgggaattcgcttggatatatatatatatatttagaaaatcataagctgcaattaggagttcgattgtctcaagttagcacacgagttttttaaagagattttttatacgactcctactgtatttccaaaagcgaacaaacttaaaaacagactcaaatacggatatgtattttcaaaagcgaacaatcgtaaaaaccgtctcatacacgaatggcataccaaaataccggtaaaaacatctttaatttttataatagtagagatagagaagaaaatatatttttggaaaaaatttgaattgggaatttattttttaaaatacttataaataaatattaaaaattctcagtaatagcgcttgtgctgggtccacccatatatataaacacgagaatggcttggtcaacatgcatgcacgggctgacatgaggacaacggcagattggcccaagaggtagatttgcatatgcacgtgggatgtgttgtgtggactgcaaacttgtgcctgacaggagcagttcatgggctgcccagttagaagcttggcccaggcagggctatttcatacgcgagcgcagttacagacatggaaattaatcgtaatcggatagcaagttgattcgagggaaacgtaaaacacaaggaaaaatacccaagaacgttcaccgactcacaattggtcgacgtacgaaaagctaggcaaaaatatcttgaatttttataatagtagagattagtatttttattgttattagataataaaacatgaatagtactttatgtgtgactgattctttttatttttttcataaatttttcaaataagacggacggtcaaacgttggacacagatacccatggctccacttattttgggacggtagtattcctctgcaaatgttttttgtggctaaaaattttgcttatgatcacaacacaaaagcatacaaaaaatcaccagttttagtaattctagaaattgtaggccacatcaaaatttaaaactacaaatgggtgcagcataatgtaatgaaaaaaaatattaggttcatggagtacctgtattgatccgagaaagcgtaaaatcaattattgagacgttcaaaccaaaagttctagtacacatgtttttcccttgaagagtgaaacccattgtatgattcttgtcttgtgtttcatctcgatccaatagaatgttacccctgcgaaatgagccgcttgtaagcaataatagacaactaaaactgagaagaaagaatatcaacaattggtctgagcagttggggttcccaataggaaccttaaaaacaactcaactctgtccacccattgtcaccacctatattttgacccactttaagtattgttaggattttcccagctacctggtatattaaatccacgtgtacttataaaaatatcaaaatttcacattctaaatattggcccttgttttgcatcctgtacaaacacttaacaaaactaaaaagaataaactacctcatcaatgttacatcatttcgttggagaacactaaactaaggatgtgaatggaaatcatttttgaaagtacaaaccaatgcaaatctcgatgttcaaattcgcacgcgctttcagcaacagctaaagcagcagtgacctgcatcaataagatgatttatagtttatccaaagactttgtagttgaggtaaagttcataaaagcttaggatacaccaggtttatacttgaaccaataaactgcaagcctcattgtagtcaagcaaagcaaatttttcaaggtctctcccaccatcagcttgcacaaagacaatatagcactgcaagaaagttacaaaaagatgtgataaccagaagaaatggtcacgcatgcttcaccacaataactgaacgatgtgtggtttgaacgatcagaatcctacttgttcattcgaaaaatcatttggatgatcattctcagaacaacatttggcatcccaatcttcccaagcacaaataagtgaagggtcatatggaccttgacaaacccaaaaactgcaaaaacagacaaatatcagaagaatttaggccacttggttgttgggtaaagctggcttagtcatttcatacaatttctacaaagataactacaagataatgaaaatcgcatactcttttgtctcaatgaaaccatggcatgaattttctttcacattatcaccccggtctgctcttagattatttagtgttagacaaagcaaaacttcctcaagaacttcttctgctttctgcaaaacagaaccatccaatgactaatgagtacctgaaaatttcagagtggacagcacaaatgaatgaaataaaccttttgggtctctccattaactagtgatgttccatcaaagggaaccactttacagacagtactaccagccctgaaggcctcaccgaatgttccttcaccaagcttcacaatgctgcctggtgtactatttccatgaacatcttcgttaaatgacgaataaagactgcatagtagttaataaacatgtaaggttgaaccacctaccagtaagtggaaaacgcttcagctagggttataggtgcagattgattgcaaaccaaaaggagttgagcaaaggcagtcatagcttcagcactcaatgatggaatgctgctatcatcaggttcttccttaatcttaagctcactaaaggatgtaaaaatgctggttttgtcactgagccctgaagggattgttcttttcataggatttgttttagaccccctatccttttcaggggttctacaactgtcgtgaagactgcaatcactacggactgatggtacaactggggtctccatgatatcaaacaag

SEQ ID NO: 36586 - DNA, 644 bp, Oryza sativa
  unsure (1)..(644): unsure at all n locations
atctgcaggtcattctcgcgcatggcatcggcataggtccgcacggaagggtccggggtggcctcaccggcggcgaagggatcatggcgctccggcgagatgatgcgggccagccggcggcggcgatagtcatcctcgcggtcgatgatgcgctgcgacttcttggggaggccgtcgtcctcggcggcgcgggggatgtcggcggcggcgacggcgtggccggtgtaggaggcgaggcggcgggcggcggggttgacggccgcctcggagtcgtcctcgggcgcgtcgtcctcggaggcggggatggaggtgtcgtagccggcgaagcggttggggtcggagccgccgccgccgtagagatcggtgtcgaaggtgacggaggagacggccatgggcgcgccggcggcaagggcctcctccatcttcttgcgctcctcctgcgcccgcgcgagctccgcgtcgatggcgtccatggcgacggcgcggcggggggagaggcggttagggtttggggggtgcgggnnnnnnnnnnnnnnnnnncgaactcgaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36587 - DNA, 15655 bp, Oryza sativa
  unsure (1)..(15655): unsure at all n locations
cttgccgccgaatcttccgatcaaccttaagtgtaggatctttcaaatatctaaccaaagaatactccaatcctcttctgtttcctgggcaaaaatgtccgaatttacaattaattcggcctttgaatcaattgcggcgtgcccctagctctctgtccagaaacggtcagaccggctgtgcaaggccagtcagatcgcccctagtctgtgattttgccaatttcgctcaaagatctaaaatcaagcaccagctcttctaatatcaaaaatactccctcttcacattatagccagatgcttgctgtgctaaatcatttgccctaggattatcatgcctaccaatatgtctaatagcaaaattatcaaaactggcaataatatccaagcattgatcaagataactatttagtgatccgtccaaacagtaagctccggcaacttgttgcaccaccaattccgaatcaccaaacgcttccacgtgtttagcgccaaccatctccatcacttgtaaaccaaataataaagcattgtattcggcttgattatttgtacaataatattccaaatgaaccgatgcctcataacacatgccattaggtgaaaataaaactaccccgatgccttgaccctctttgcaagaagaaccataaaaataaatcttccaaggtataacttcaattaagattcctcataagcaatatccacatgatggtctactataaaatcaactacaatttggcctttcaaagatttcaatggtacaagttggtatcagagccgaccttgaccgtaggacaagccaactggaaaacctaagagccctctgaaccctttttcatatgcacatgcctttttcacttggatttgtttcgggaaactttggggtttgatcttttgattttgggagaaaatcttggtcgcctatttaatcggatctcttgactagggacagtccagggttttagcaaaactttatttggaatttatttggcagccagtcgggaattgttaggtggtatgcattaagttgtgtctagattcgatgggatgcagtctttatgcgcatcattattatcatgcatttatttcatgcattaagttattgtttagtcagttgcattagtgtcttttgtctgggttcatgaaaaatgttccatgcataaaaatcatcatgcttggctagttgcttgggccatttgttgctttgtttaaatttggatttgagcatgcattgattcctatcccttgtctaccttagaagtcaaacctgttcttcgatcgcaagcgccgctccgagcttcagagtcgccgcccttagctttatcgtcttcttagtctgtttgcgtgctagtttttgtgtttaggtttgttgcttgtgggttagtcggcggtcgatatcatgtgtgagtggtatgacacccttaattaggaattgcgtgcctctttttcagtgttttaatcaagattaagataactgcacttaattttataagaaagattagtttccgagccatctgttttcttcctttctcttatttctacctatcctcatccagatggtgaagacaaggaatgatccccgtgactccaacgacgccagtggcagcgaagagcagacagatgaagctcataccagtggtgcacctggcagcagttcatctccgccgcccgagaacccaacagtcactcagatgatgacaatgatgatgcaacagatgcagcaacattaccatcagatgttgcagcaggcgcaacagaaccagcagtttggtcctccaccatcacacgtgtccaaactgttagactttctccgtatccagccacccactttctcaagcaccaccaacccaatggaggccaacgactggctccgtgctattgagaagaagctgaccctactgcaatgcaacgaccaagagaaagttgcttttgctacacaccagttgcaaggtcccgcttctgcctggtgggataactacgtggtgacccgtccagatgcaacgaaggttacttgggtagagttttgtcaaaactttaggaaggcatagattcctgaagggattatggcacaacagaagagagagttccgtgcattgcaacaaggaaccagaacggttacagagtacctgcacgagttcaaccgcctcgcgcgctacgctcctgaggacgtgcgcaccgatgctgagaagcaggagaagtttttgtttgggctcgacgatgaattgaccaaccagctaatctccggagtctatgaggactttgagaagcttgtggacaaggctatccgccaggaagatctgacttatgtggagaagccgatttgtatccttgagaccagtgagagaaggaccagaaacaaggtgatcaggttttgcaaagttcagtggagccaccactcagaagaagaggccacctcggaaagagaagatgaattgaaggccgctcatccgcacctcttcgccagctcttccgaatctcggggtcgagattccgtttaaggggggtaggtttgtcacgccctgaagttcccctcccttgctctaaattcataaaataaatcgtccgaagaaattgtttaatttaacctagagttgaatccttaattaataaatgcaaataatcatcggaatcggcatgtggaatttttcttggattctacatgtcaaaatatgctaacaggatttttagtggaattttcagagccttggaaataattttaaccaattaaaataagcaaaatgcaatattaaatccctggaaaaatcctttcttctttttctttttctttcctccttttttctctcttcttgggacgtcggcccggcccatttcttcccgcgccagcccgctcctccgtcccactcccgaagttcacccggcctccctctccctctcgggcgctgacaggtggggcccacctatcagtcctttccctaacctccggctgcccacgcccgctccaaccgccgccgaaaccaccgcccacgccgccgcgtatcccgctactcccgcgcccactccgcgccccgcgcccacgtcgctgcgacgccgcccacgccttcccgcccgcgccgcgagcccacaaggggtggattcaaattttgaatcccctcccactctctctccacctcccacgtcgccggcgaaatcgggagcaccccggccacgtccgtctctcccgagccccaataaagcttccccgcactcccctccacctttttcctctttccgccgctctctcccgtgccctccatcactcccgcgccgctacacccatcaccgccgccctcctgccgtgctccggccgccgctagccgtcgctagccaccgcgccgagcctcaccgtcgacgccgccgcgttcaccatcccgtgagccgtcgcgtccgccatccgcccggccaaatccaccgtcggggcccgcttctccccgcgcgccggtgagtaccaccattgccgccgccttcggccatggtttccgcccgtcgtggacaacccctctccctctaatccttcccattttgatccctaggaggtcccggagatcgtccgcccgtcaccgtcgtcctcccgtcgctcgtcgtcgtcgttcgccgtcgtctccactcgcgccggccaacctcggtgaaaaactccccctccccccctctttccctctctcccgtgtgcgccgccgtcctccgcgcgcgcaccgtcgtcttcggccgccgccgccgctttttgcgccgtctgccgtcgccgtccgcgccaccggttgccgtcgccagcgaccgcgcgtgccgccgtcgctcgccacgcttggcctgccggctttgaagccgagccgagccaccagacgcgcccctcccgccttgtgccactgccagtggggcccacatgccggcgcccctccctctctctcttgagccgctgactcatggggcccgcatgccggcgcctccccttccttgctgacgtcagccctggggcaatattgcgcaataaatacattaaggcttttctttaatagtaaaaacacaaagaatcttctaaaaatcataactaattcatccgagctccgtttaagcccattcaagtctcagtaaattcataaaaatgtatagaatccattaaaaatggttttgtttcctgtttcagtagtcttatagcatgttttgcttgtgtgctttgtttgtcgcgtagatttcgcccgtttcgtcgattcgtggtttctcgaagacgttgctgtggttccatcagtgcgagagcaaggcaagtcatacattgcaattgatcatattgtacccaatttacaaatgtcccgcatttctattaaatattgcactgttttacaatatcatgtgggatgggtcctattactcagctatatgttgtttcccttacgccattgataacttgggtatcaaaatgactagatgttggtttaggagatgcttagccatgcttagttcaactaatgcacaaaaggggatcacactaaagcatagactttgattattggcaatagctttggattagtgccaccgcaatggtgttggttaattaaagtacactacatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcaccaaagggggggctgcccgttgcctgctggggacgggggcgaaccctaaggtgtggtgcgatcggttagagagggttatgcgaagggtcctgtcacagcctctttccggtatgtcgtggtggcatgtcggcgcacgggaacgtgtcgtggggctgtgtcttgtgggtatagttgtacacctctgatcagagtaaaactattcgaatagccgtgcccgcggttatgggcggtcgaccagattcaccgtaattagtctcacccctagtttagcttaatgaactggtgtagttcaggtggttggttgggcctgttgcaatgtggcgtagcgttggacagtgactggtaatattgcttaattactacaactgtttttactgttttcaactactggttttaaatgcctgctctatgcnaatgaaccccgtagcctcttntggttatatcntgcatcatacctcctcatcaggtatgacttgctgagtacagtgggtagtactcaggcttgctcttttcccccacaccagagtggaagttcttctcagtgaagatgtctcgaagaggttggtttcgtcgctgccgtcaaggatgcctgtggaatggagtcgcccgctgcaggagtcaagtcttcaggcttagctcgcttttacctttttcgctgcatttgtaatctttcatatttttgtaagacgtggatctgtatgtcaacaattgtcgtttgtgtaccctggctggtcctggacaggggtttaatacacattcagcttagaaattctggttcgtgaatttctgggcgtgacaataagccaaatcatattcaatcaaagcatatgcccacttgccaattctcccacttagaattggcctttgcatcatatgtttaataacatcggcttgccaattctcccacttagaattggcctttgcatcatatgtttaataacatcggcttgacaagcaactatgcatctactagataacaagtaatgccgcaatttggtacaagcatagtaaaggcataaacaaagtctctctatgaagacatacctcgtttcagcatccaaaagacggcgggtcaaatatgtaatgatatactccttgccatcttcctcttgtgtcaaaacggcaccaatgaccttgtcttcggaggcaatatctaaccgaaacggcattccggctttaggcgctcgcaccacgggtggagtatacaaatactacttcaacccctcaaacgcctcttgttgttttgccccccaagtaaaatcggcttcttttttcaagcgaagtataggaacaaaagcatcgatttttacccgctaggttagaaataaatctactcaaataattcaccatacctaacaacttttgaacttctttcttgcatgtcggtgctttgaaatcacgaatcttttctatcttcttaggatcaatctcaactcctctttcatgcaccataaaccctaagaacttccccaccgacacaccaaaagcacacttgagtggattcatcttcaaaccataccggcgcatcctctcaaaagctaacctcaaatcggctatatgtccctccataccatctgatttgacaacaatatcatcaacatagatttctaagataatacctagcaaatcatggaagatcaaattcattgtcctttgatatgttgcaccggcgttcttcaatccaaaagtcatgacaacccactgaaataaaccaataaatcccgggcacctaaacgccgtcttgtacatatcctcctccgccataaagatttgattgtagccggcattaccatccaagaaacaaatcactttatgacccgaggcatcattaatcatcatgtcggctataggcataggatattcatcttttggagtagctttatttaaatctctaaagtctatgcaaactctaatcttaccactcctcttcttctccaccgggacaatactagatacccactctgcataacgacataacctaataaaccccgccttcaataaccgatcaatctcctctttgacccggtcatatagcaaaggattaaaacgacgaggtagctatttataaggcctaaaacccggtttaattagaaaccgatgtataacaagttcacggctaagatctggcatctcatgatactctcatgcgaagcaatcaacatactccttaagtagctcgattattttaaccttataatcggctctcatttttttgtttacaaaagtcggccttggtttagttccatcacctatgtctacttcctccaacggatcggccgatgtaaacccttgaccaagcttttctactttatcaaaatcttcaatagtttcaccaatatcgttttttgtagaccgatatttttgcaccctcttttgcaaccactctaaattagcttatttactcattgcacaaagtgatatggcctagccgtgtgtaacaacccaaaaattagccgtctgctaattttgcatcatgctgattcttatgttcttaataaccttctaaacctaggaaaatataattagcgggacctcctaaaaatgacttgtacgaaagcctctatggtatttaatctcttttgtgtttttcatttaaaaatatgttttggttaaattgaggtatttcttgatttcgttcaaaaccttcttttgactaaaattccttttagtcaattttgcttgaaaacccctttttattatttttatgaattgtggtccaagaaaccttcccaattttgcccttgaacctaaaccaaaataattccaatctcattagaattatttgttaatccatcctttgattttaaacctatcctttgattctcaatccaaatatccaaattcctcctttttgatctagccactaatttaatttctgtggtttgatttccttctcggcacaagaataaaattattacgaatattgtgaataattgctcttgtgctaagaaaatagattatatctttgtcatccaaatttactattagcctcaaacaattctctgaaacccatgccatatattttgaggctaaaaccctatttatccttctccaattatctttttcccaccttcctatttacatattaaattttattcatatatctctcaccctttcatttgagtgcaccaaataaattccattatatactacttctaaaatattgcactcaaataattaggaaatctctctttgaaattatctccaaaataaattcatctcaaaggttagccacttaaatttcttccaaatattaatttggattcaaactccatccgtcaattccctacacaaattagaaagcctttctattcatttgggccgaattctccctctcttccttcggcccagaccggcccaattcagccgagccgccttcctccaggtgcgcgtgccgtgcacggcgcacgccgccgccaaccgtcgtcgctaagaaatcggcgacgtgcttgtcttctccacgtcgccgcagccgtgtcttcgtcgaccttctcctccgaaccgcctctctccaccgccttcgatccctataaatagacggcaaacctttccttttctcccccacaaaccaagctctctctctcttctaccatggcagccaccaccggctattgccgatctccctcaccggagcattgccggacaaaccctcgcgccaccgggcttgccttgatgaggtgaacccatttttctagtttcccctctcccttagccgtcctataagccactatagccacttcttttaccggccggagcaagcttttgccgccgccgttccggcttcatatctcacttccactgccgacctctgccgtccccggatgcgcgtcgacggggaacatgttatgttgccgacgtcgccgcgtttcggccaccggagggccggcgccccgctcgtcctctcttctccctctctcgctgccaacggaagaggagaagaaagaagacgggaggaaggagaagaaaaagaaaaagaaacactgacaggtgggcccctgcacagttcactttcataattttcctatttaattcaaaacccaatctttagaagctcatatctcctaaaccgtagatccgaatctagtgaaacttggacctaaattcatctaaattcaaaccctatattttgataccaaatttgctattttataattttatttgaatttattcaaataccgtttgaatttataattgccttttcaaatatttccttttaatccaaaataccctttagccactaaaaagccgctggttgaaactttacgcctttcatggagacgtttgcggtcacctaggccccgacgtcgaaccattggctgtaaagcccggcaaaactcaaacccaaggtcgaagtgctgctcctagcaccctacgccttgatgcgtataatgatcggagcttcactatcccctcgacctccacagcacgccgcacagttagctctctggctctgtgtgatcctagccgctccgccgccactcacggttgtcggagtaacacttccaccccactaaacctacacaaatctcctattcctctagtcgttatcctttttgttgacaccggctagaaaagataccaaatctagctgttatactgcccgactctagcaatgactagcaaacaaccaaaccctagccgatgccttcctaattaaattccagtcatcatccaaattccatacccacccatcgagcatactctctgcctaccagaacctatacataaactatagagcctagttgatacgctatcctattccataatcaacttaactataaccaaaccctagatattatactacctaaacctaccaccagccaatactagccacatactcacttaaccagttatatcctttattctccaagcaaccaaaacccacacatgaaatatagcgacattagttgcttgatcccttctctaccttagcctccaaccctcgagaacctccacacaaaatattagcccaataatccctatacccaataaaaaggagatatttacacccccaaacccagcctttctcgctctttattgttttcttgctatttcatgatttttattgaatttggttcttcgtctttcttagtagagtctattttattttggatggcaacctgtattatttcgaggatcggataatcaggttgcctatcacggatttatttgcattggagcaaggcaagttattattcctctcctttgaacataaatgccctatattctatacctttattctatgcattagtcattcatgatttcgaatgcataaactgaatatagcaaaccagatatgctagcttttgcttagccatgccagttagactgcataaaatataatgaacttagattggaacagtacggtaaaaaatggttgatttccgggtggctagtactattccaaccgacataagactgcccaagtacttgtgaagaacgaacgagtacgaccgcagcttctagaatggggacagacctagatattatgttaattaacaatgtggtacctctgtacagtggttccttttgtaagtcctcgcgcaggaggcaaatttacgccgcgaagggcgattgtaatatttactgaggcgcaggtaaatatttgagataaattatgatgactagtctgtttgtgaaccctgattgcgatgacatggtgtcatacgatcagttctctctaaagaccccgggaacgccagaactcctctcgctgctgataacgttacgttcagagcgcatggggactagagttcatggaacaagtgccacaattgttaataacctaataataggccatgactaacctaatgaattggcaagtcgtggactgcgggtaaagcgtacatctactgcagtagaatattcatgaaactattcgaatagtcgtgctcacggaattgagtaccgggactcatatggtatttgattagaaacctaattcaagattttactaaatactgttgcattaaagtcattacaggctttcttcttctacatcctctgctttctgcaattaaatctagccctacttaaatgctactatttcatacattcatattgaatataatagcttgctgagtacgttgtactcacccttgcttcaaccccacctttttcagagtcattttggagttcttgccaaagctgggagttcaatcacataagttagtttcattctaacttaattctcaagtctagattagatagatggtttaggtctatagccaaacattagagttaagtcattctatagcttttgctgtattagttagccacaagtttttaaatacccatatattttgtaataatatatcctttggagtcttattcaaacgtatgcaatgaagatccagattgttgaacatgtaccaatttactaatccagggcttgatacagtttaaacatgtcggtttccgaatcattagtttcaggacctgacaccgtgctacactagctggctttacagagataggtacaaatttgccatcgaaaatactaataaaatcatagctagaaagatccatccccgataagcattgaatattcccatgacgccactctaatgtcgcattggccattgcaactttggccgacatatccgcttgaacaatttcaatatcatcaccgtcccatcgaattaaacattgatgcaaggtagaaggcacacaacaattggcatggatccaacaatgacccaaaataacattgtagttaccttgcacatcgacgatgaagaaagcggttggcaacgtcttgtttcacacggtaagctccatcaaaaagatacctttcgcctccgtaggttcaccattgaaaccattgagaatcatgttagtcttcttcaactcatcatctccatgtcccaacttcttgaacaatgagtacggcatcaaattcacggcggcacctccatccaccaacatcctagagaccggcttcccatcaatatgatctttgagataaagaggcttcatatgacgatttgattcatcgggcttctcaaaaaccgcatctttaggacctactaaaaattgagcaacttcggctttatccatagcacaaaactccatatgcaacatacacaccatgtcaacgtccatgtcgtcctttggagatgattcgtccttagtaaccggttgttcttccttccccatttgcacaacaaccaattcttctccccctatggatttacgcctccacacctttgtaggcggtggtcgcaactcattgaatcttctatctctttgctcttcggcctctctctctctctcttttaattcttgggcccaaagacattgcaaccttcttttttgagtagccgttaaatccttaggcatctaccttggtttcggctttgttccaggagagaaataatgccccctgttgattctacctgaagacgatgaagcccccgagctatcctttgtaaacctctcatcaaaccggcgctggagcccggtcagaccggacgtaggccgtcagtcagaccagccagagacgccaatcaaaccggcatgtggccggcggtcagaccggccgtagggctgtggtcaaaccggccgactgcgatgaactgatcccggcttcggatttgttacttgaagactcccaacctcatctccagaacgtattggcacattatgagaccctactttgatagtaatcacctccgaagtccttgtctccaccttaacatgctttcattccctctttccttcatcaacgaggtttttagcacaaaaccggccattatttggtgaagacaaatgctcatgagctggcctccttggtcctccctatccttgattgtattgcattggaggcatatgattgaacattagtggtgttgcccccatggcatgtaataaggaaagggataacccggcggtggcattggataagaccctcatgacatgtcttgagaacaatgatatgtaggtgatcccgactgtcttggtgaatgaccaaatcgctccctaggaggtgatcttggtctttttcctttattgcgagctttctcaccaccttgcttctcatgcttatccaaaagcatatcgaaggtcaccgccgctgtaggtgccgccgatgcagctcgttgcctgctgcctcccatcttgccaccgctgactgtgcctctgccaggacgccgcccaaccgccgagacgagagagagagagagacgagacgagaagcaagagagaggaggcgagaaaagacgagaggcaagagagagagatagagataaagactcggcgatattgactcatataggctgacgcgtcagcctggatcggctcggctcggcttggataggtgctggtttttttaaaaaaaaacgatacctatagtttattattggtgccggttctaaagaagaaccgacacctataatatcgttgtcggtttttctttagaaaactggtacctatattatattataggtgtcggttcttctttagaatcagcacctatagttgtttaaaggtgtcggttttatgtgttttcagtccacggaggagataaaagcattataggtgccggctttagctgatccggcacctatagtgccgatctctatgagcttttttgtagtagtgcattctcattggtgtgggttcgtcacttaatgtgcaattgaatgctctagtactaggactctagataatgaaggaagttcatgcgtaaggctagagtagtaactaataacttagacgtagtgtctaggttagaaattaccttcgtttgttgtgtgctccatggaaagtgaggtaggcagcaggtggtgacagctctatttgtccttcgtattcctccacattcgggtacatcatagagcttaaggcaggacacaacttggcagaccagggaagagtcggttcctgaagcattcgaatagaacaatatgtgttacccaaaagtttcgcatacgtgactaacagtactgaagtacagtacgcatctgaaagttttacattttggtccttattgaaaacttattttataaatagacccctagaaaaacttaatccaggaatagtctttttggtgcaccagagaggctggcgccgttaccgtgccacctcgggagaagggcagacctgtctgggctgacgtggccaaggggggcgtcagccacactggcgtcttcccacataccatggcgccagcatggttggtgcactctccctgggtgggccgcgcctttaacccgcgcggggcctacccctttctcctcccccactcattttcgcccagtgctagccccaagcccgagtgcagttcttctccctctctctctctctctctctgccccctcacctctccatctcaaatccactcaatttgaaggtgtttttcacgggatttttttggaaatcaacgagaaaggtatactcctccatcccccccctctttttttggttttaatcagttgaatttgtagatcgaagggtaatcccagaacccctttttaaccaaatttgtgattttcaatattttttcttgggatttgcttattatagtgatacatgtgtgcaatgtattcggtagtgccatgattttttgaattatatatgtggtaatgtgaatttttagatggtttggttggacagatgatgaaaaaataaacttgaggcaacgttgaattattaatttgatggaccagaggctttaggttaaatttgtaggtatgaattatatgaatgggagccgaattcggtagcattatagaaatttattattgttaattagaagttggttgggttgtatgacggagtatttgtaatattttgatgtttaatgaactagttaacttgttggtacttttggatgtggattaaatacttttcgtgaagtagtagctttgggacaatttaagttatgcattggttataatatgtcagtttggactacgtttaggaaggaagatgtgattttagttataaagtcacaattttttttggtgtagatggatagacttgttcgtgtttagtacagtggtagagtggtggaacccttacgttggtgcacatgttgagtttgagatatgtcattcaagaccattttgtttcccgcccgcccaactctagatgaactaaggtcacaagtgaaagaagctcttgaatggaccgaggataatgtggagattcgtttttatgggcgatacgatgttggtaaagggcataagtatatattgaatgtgctaggtcagttggaatgggaaatttactttgatttggtaaaagagtctcagtttggatccctataggtgctatttgatttccctcgcttcgttttgtaattgttttgttaattggtttttcaaatgtatgtacactctaggctggcaggctcttcggtgtcaatgcaagaagtaatttctacgaagttcaactatttctcatgtgttaacttgtttaatggacctgtggacttgtgaacttatggtctatgtgatggacttgtggacttatttgtcaacttagttaacttgtggactacgtgatgtttgatgtggaacttgttttgttttgtatgtttactgtgaaatggtccaaatatttgcattgtatgtttactgtgaattgtcaacgcttgccacctaggcgccgtgttggaaggggcggcgccaaccagcaggcagagacagaaggaccaggaggtcgaggggttgggggggttagcgccagccaccctagcgcggcggttgagtgggtggcgccagatggcggcccgaggcattaggtcttggggggagggggtggcaccaccaccgtgcttgggggggtggcgccagtcggtagcccgatgcataaggttctagggagtgaagggtagcgccagccaccctggcaccgtggtttgggggggc

SEQ ID NO: 36588 - DNA, 33107 bp, Oryza sativa
cccttctgccgaggtggcatggtgacggcgctaggttagctggcgccaccatcactactagaaaaacaatttttcctggcgttaccctttaattttcgctggcagccatatgcaaaaaccgccagcacaaatataatgaggggagggggttacggaccgccagcgaaaactgattttcgctggcggccaagctaggtaaaggggaccattgcgaaaaaagttttgaggcgaatatataaacccaccacactagccacctaccgcccccacctcagtctctcctcctctccttctctctctccttcctccaccgccgcgggctgccatcgccaccaccgccgagggctgccatcgccaccaccgccgcgtcgatgggggaggccggatctgccgctgcgatgacaggggtggctggatccgccgccgcgacgacgtgggtagccagatccgtagccacgatgacgggggaggctggagccgccgctaccacgacggggggtggccggatccgccgccacgacgacgggggagcccgatagggtagggaggccgctgcgacgacgacataatcactactgggccgcgggcagccgatccggccacgggagagccgtgacgggctcctccccgctgttgcgacgagctcctccccactccatgtggcggcgacgtcgagctccatgcggcggggtccggcggctgcggtggagtgcagcaatgacctcagcggcggcggcagctagtggcgataggtgcggtggccgttgtggagtgcagcgacaacgacaatttttttttactttttgtgatttgtgaatgaatgtgagtttaatttgtgatttgtgaatggtttggaatgtttgtgaatgaatttgttcaattgattatgagatttgtgatgaatttgtgattttgtgaatggattagggcgtccaaggattttggatttggggtgggggatttttgggtaggggatttgagatttggggtgggggattttggatttgctggtgtgattttcactggcggttctctttaggtagccgccagtgaaaatatattttcactggcggctaattcccgcttgcgaaaatacgctattttcactgggttttcttactggcgactgcactggccgacagcaaaaatataaaatagccaccagcgaaaagctttttcattgtagtgcatgttggagggtggcgctatcccctccggcgcaaccaaaaaagagcattgttaggttaagttttttgggatctatttgtaaaataagattttgaaaagtacacaaatgtaaaaattcagcatcgaattcagatgcatcgatccgtctccacacctaacagagttaataagctagcaattaattaaggtgagtagcaaaagtatagctagctagctatctgccaaaggaacgtgacgaatgagatgaagtagccgacacagaaataacaagcggctacgagatgactttattagctagacttttgtcatgttgtaggtactcaccgatatgtgtttcttccttgttgaattgtctatgtctagctcgtgggagaatttgaatgtgctcgtgttttacttttacaatcttcattccaaaataaaatatgaaatattttaattaagtataagtacaggtattaagaaaagagataagattaaataagagaggattttcattgctcgagaaaacaaaatagatgaaaaatttaaatagcgatgaaactgttatatatattatgagataaatttttaatattaaatgttgttatattttggaaagagttgagaagcatgctgggcatgtgtcccgatcgagaggagatatagttgtacagtagctaatagcttacagtaggtaggtagattcgtgtacgtgtggtgcagctagctagggtgaagttagatgacggcaatgcgtcgcagcctctcatatgatatcgatcagctggagagctggcctggtactcttgcgcagtagggaaaggaaacggacggagtagctcacgcaatcgctgaccgcatatatgcaccccgggtcactagctacctttacctttttcgatctcttctcttcatctccagtgtaaagcttttttgactgcttttttttttgtgtgtggggggagtgcttgtaaacaagtccatcgatctcgttaataaaattcgtgaagaaatcaattaatttaattattgtcccacagggccgggcggcatgcacagtaaataaattaaattaagaaatggacaagagcatggtagccagacaaagacggacggacggacggacggaggacctttatttaagaaagaaaagggggcccctgctgccctggctcatgcatttgctagctagctcatcgtcgataccaatggcgactaccagggccacatcgacgctgctgctgctgctgctgctggtttcggcaacatgggcggcatcggcgccgacgacgagtcgggcgaggaacgtgataacacacgtgaaggggttccaagggaggctgccgttccacctggagacggggtatgtggaggtggacaacaccaataccgttgagctcttctactacttcatccagtcggagcgcagccccgccgatgaccccctcatcctctggatcaccggcggccccggctgctccgccctctccggcctcctcttcgagattggtacccagctctatcttaattatttcttcattcattttcgatcgcccaataaattaaccactgatataggagttttcatcaatctactctagctagctagcttgtcacacgtacgattaactatgcaaagcatcattgattaaagcaccccgcccggtatatgcatggtggtgaagcgccgtacatataattaattaattccacccttgcactaggattcaatcccaatatatactatcaacgaatatttcatacatatcaactagctaggatattcattttagtgagactaagtattggccgttagtcttcgtttctctctctaaatacgtacgtattaatcaggagactgttaatttctcaggtgtgtgtacctatggtggcatgcatgtcttcagtgtaataaaagaactactaatatatatatatccaactatatatatctaacaagcttatctgcgaacagcaaaaggttaattaagtatatatgtaagacttggcctttatataattatatatacatatatatctgccggccagtactgccaccatgcaacatagtagtttacaaaagttcaaattaacttgcaatataatattgctggtctacggaaatgacaaagcaattgagttagaataatactacataatataattaatcgatcttctcaatacaacttggggctcgcggcgttatcaacaacggcttttctttcgttggaaatatctcccctgtccacatcatacaagcatggcacattgtatatagatggttgccgaagaaaaactgacgatgagtcaagtctttatttggcctcaaatttgttgaatgctccttccactattaattaaagttgaaacctgccaagttaatagactccttccactgtatatatctatccgttctgagaggtctttcacaatattgtggatattttgccgtgtaggtattcccttgctgtattgccagtgacctatcttcttagaaaaattctactccctccttttcacactataattcactttgtttttatcctaagtcaaccctctttaagttaaccaagtttaataaaaagatatggcaacatctataataccaaataagtttcattaaatccaacatttaatactttatagtataattatttggtattggtaatattatcctattttcctatacacttagtcaaacttgaagagatttgacatggaacaaactaaagtaacttataatatgaaacagaggaagtacaccttaggctgcactcgaacgagtagtttcggaactcatctcttatgcacggaaaacaaggtaatttattagtgcatgattaattaaatattagctaaaagaacttgaaaagtgaattaatatgtttttaaagaaattttcctatagtatttttttaaaaaaacatcgtttaaccgtttggaaaatgcacttacgaaaaacgagggaacattgaacacaaccttagtattcacactcctatatacttctataaaagttggagcattcccaattaggctgtgttcaggaggtgaggttggaaactcacctcccgcgcacgcaaaacggagcaatgtattttcttatgattaattatttttttgaaaaatggattggtatggtttttaaagcaacttttgtatagaaacattttgcaaaaaaaacatatcgtttagcagtttgaaaagcgtgcgcggaacacgatagagatgagttaggaaaggtgggggaagaacacagccttaatatattccccctacccaccctggccccaataaaataattaattcctatatatgagtctctgtgtcctaaacagaatcgatttctggctatgaacattttttaggtgaaggaaatataccagaagttagagtagcttgtcaatgacattcaagaagggatttggttttcctgaatggttttatttaaattaatacagaacgaatatgcccaagattgggaacatcctgaaattaaggccgtgtttagtttccctccaccaacttcaaacttccaacttcccatcacatcaaaaacttttctacacacataaacttttaatttttttcaaattaccaactttcttcaaacttcccactctttccaccaactaaacacagcctaaattgaattgactaagcctcatttaactttccaattgctcaaaataaagtagagcagaagccattagctagctgggctagctgctaatacatcacaactatttgtctacgttcatttcagcttatggactatacatatataattacaagcggtaaagcgatatagcattttacaatataaaattcgagggttggtttaaaacgggtggaataaaattttattcacttttgactttaaaatatttaagggcttaggtaaggttatgaaagaacctatgtgccttagacctattaccacccatatgtactatgcatggttcttaagtactaatataattgctcgaaaagcattacatatataacaataattgattacatgggcttgtcttagctgagctatttttagttttatattatactatgtctagatttaaatgttgctatattttagaacgaaggtatatagtatgatattaatttcatactatgaacttggccactctcgaaacatgaacaacacctatccattgagtggcctgctatactgacttagaccgatcagccggtcttggtgataggtggataaaaagagagagaaaagaggtgattgtatgataatttaatttgaagacaccattcattgaatatatagtttctacacatagtgtctatatgacatggcaagtatggaaactacttgataatttctgggttgggaatggccttaatgcatgacgcactagtgtgataacactagtaagtactctgtctaagactaaatccaacaattaataaatcctttggaaaatgcagatctagggaagataaaatgaaattaatgcttttgcaaggtcactcagagctcgtacgtgatcgctcggccccagctaggatagcacaagcggcaaccagcactatcgccatccctagccgtcgtcccctccgcctcgccaccgccgcctgagctatcgtgggcaaagccgggggagggggcacaaggacaacggcagcaagctctcttattcttctcacggttgcgatagtccgaggcactgccaagatcgaagggaaggctgtcagtggcggtatcagcggccaaaccggcatcgttgggtctcggctctagtcctcttctgatctgccgccccagcagtcggtgatggggaggatgcacgacgaaccagcaaggaggagaggagaaactagattgcgcaagggtggaggcacgacttacaagggcgaggcctaggtggtagcgcctgcaggtggccagtgcggcaagcacacaacgaggaggctgacaaagcgtgaggaggtggccagcgactcgtgaggaggaggctggcagcacgcagacccacgacacgtgtggccatggccgggaagatagcagagcaaggcggttgttggtgctatgaggaggtggcagggggcgtgcgaggagatcggcgatgcgtgatgggagcatgaggtgaaggccggtggtgcacaaggccatggccgaggaggaggccgacaccatgacgaggtggttggcagaactggtagcgttgaatgtggctggccagcaaaggattgctagcgtggcggagaccggttgagtggtggagtgctaggttgctggtgacaaatttggagagggatctacatgcaaaagccatgcttggagttctctgggccaacaaccacgtctagggttgttcccccctttagggcattttcgagctaacgcctcctcccctggtaagattattcgggtgaaaatgaagcccttttgacagatgatagtggtattttcagcatcatgacctcgttggaggcatcatcctcaagatctcgtcttcctattgacgcggacttctctcagtttggttttcaatgttttctcagttgtcatcgccgggtaggtgtgaggaacaagcggatcttcttttgtctcgccctttccctctccaacccttctccatgaggatgactgggagcccgctgatgatgttttgttttggagaaggtgttcggtggcgcatttccagcccatgtagactagcagcaatcggtcctgcatatcggcgctggcttcgtcctagttcttttttccaggagtgtatttggaattgttagcacggggtggtggtgtgtttttgtttaactttttccttattatagcctgtatattttttctgctatatccaatgaaattggcacaatcatgtgccggttcgtttgaagaaaaaaagaattgcttttacaagtgaattagtgaaaaggatttcaattagctagccagacaaaaaggccagtgcgtatatatgcctaccacagatggttgctgaaattagctcgtgatcctgtcggttatataattaataggagtataattttttttgttaggaaaatgattttcaaaggtaatgagtacacgtgcatatatacaggccctctcaagtttgacgtagctgggtacacggaagggttccctcaattgttctacttccaagattcctggaccaaggtactagctaatgaatcaagtatgtggaatatattttgcctaaaaaaataaattgcatgaataatgaagagtgatatatgtttgatgttaggtgagcaacgtgatatttctggacgcgccggtggggacggggttctcctacgcccgtgaggaacaagggtacaacgtcaccctcacacagacgggacagcagctggtggtgttcctcaccaaatggctgggcgatcacccagagttcgcctcgaaccctctctacatcggcggcgactcctactccggctacaccgtcccagtgacggcgctccagatcgccaacgacgacgacgcccgggcgcggctgaacctcaagggctacctggtgggcaacgctgccacggacgtcaagtacgacagtgggggcaaggtgcccttcatgcacggcatggggctcatctccgacgagatgtacgaggccgcgcggagcagctgccgtggcgactacgtgtccaccccgaccaacgccgactgcgccaacgcgctgcaggccatcagcatggcaaccttcgccatcaacccggtgcacatcctggagcccatatgcggattcgcgctgcgcgggcgcgcgatgcctgagacgacgatggaccagcgcctgcgcctgggcctccccgtggagtgcagggacaacggctaccggctgtcgtacctgtgggcggacgacccggaggtgcgcgccacgctgggcatccacgagggctccatcgcctcctggagccgctgcacggcgctgccgctcttccggcacgacgtggacagcgccatcccctaccacgcggagctcacgcagcgcggctacagggcgctggtgtacaacggcgaccacgacctggacatgacgttcgttggcacgcagcagtggatccggacgctgggctacaacgtggtgaccgcctggaggccgtggtactccaaccgccaggttgccggcttcaccaccgtctacgaccacaacctcaccttcgccaccgtcaagggcggtggccacaccgccccggagtaccgccccaaggagtgcctcgacatgctcgacagatggacctctccggccggcgagctctgaattactttactatactaattcatcaccgtccgtatatatgtccgtttatgggaaatcttacccccttcataatttatctacttatcttttatcatgtcttatctttctcttttcttagcctatactacacacacttacttacaaaattcggagcatttgtgtggtctgtcgttcttttcccactcggtttccatttcgagagtgacgaggccctcctttttttcctgcacggcaaatttcttggatttgtccctcacgcacgtgtagctcttcacgcgtctgattccattctatttccatacggaaccaaactcattgtgatggacgcgcgtcttcttaatccctagaacatgcacccactttccatgtttcattttctccccaatttactgttaaaaacttgaatgggccttatagggacgattcggtccagaccaggttgcaagctcaagcctcatttttttctcaaacaaaccaagaaaggatataaaaagaggaggagctcgttccaagcaaatcgaacataatctttaggctgtaacagcagtggcgagctggtggtcacttggtaccttgtcaatcttattcctacctacctactctttccgtcctgaaaagagatgatttctagcgagaagagtttgtcccgtaaaaaggcgacttctacacaaaaacaagaagcattcaaccgctgctgattacgaagtgactgctcaatcggctcattaattagcatcgatgggtgagaaaaaaataaagacaactacgttcacacttgttcacacttgctggatgctagtactactccagagcactagtactactttgcagagaatcttggtttgattttacataactgtcaattaatggcagtactttacgagggtatttgggtctttagctacttgtgctaattttgccttggccttccaggagtcgcttctttctgagacggagggagtacttgttgatatgcgggcgtagtataagatctattatgtagtagatgagttcttagatgatcagaacatgagatggaccgataggcacatgggttgatgagatcaatcggtatatgtgctggtgacttcactggaatgtctggtactcaccatggccgagcgcgattgtgttcatcggatagtccgatgtccattggaaccgcacgccaatgagaaaagacaagccaatgagattgcctcggtttcggcataatttgattacgctgttaaggttttcacatggcgaatcgtagataagatctatgtaccccgtgacctttttagggcgctgccctaaaaaccgcggggggcggctccccctcgacccttagatgagatctattctggttgatcgccataaccacgggcacgactattcgaatagttttactctgatcataaataatcgtgcccgcgattatgggcgatcaaacagattcaccatgattagactcgtctataataatttgacttaatggaactggtttaatttaggtggttggttgggccttatcgcaacgtggtgtagcgttggacagtgatgattaatattgcttaattaactacaaaagttttacttaactacaaaagttttactgctttcaacttatgcttttaaatgctagctttatgcaaatgaacccctctagctctccttggttatatcctgcatcatactctcttccggtatgacttgctgagtacagtgggtagtagtcagtcttgctctgtctcccatcccatagttggagtatgcgtcagatggtggctactcggaggagcaggctttgtccgttccatcaaggatgcgtgtggaatggtgttgccccgctgttagcatcaagatctagaataagctcgcttttattttccgttgcatttatgtaagacttttatatgtgtgtaagacgtggatctgtatatcaactttgtcgtttgtgtaccctggctggtcctggacaggggtttaatgcacatcttactcggaattatattcgggaatttctggacgtagcatatgtgtaagtaggcttgcccgtcggatgggctggctatgcggttctgtagggaggactgttacaaatggtatcagagctgaccctcgtggttgcacatacgggtcaatgtgtgggcatatgaagcatggcacctgtgggctctgtgtgaggcacatggcatggcgtatggcgccggcactagacatacagacatgcgctaaagagggggtgtgttcctggacatttgcctatatacctgtgtagctacatgggtaagttgggccatggggacgtcgggtcctttgagggagggtgtatgtgacatcctggcccaattaggatttggcctgtgtggcccatgaatttagcaaggttgaaaccaatttataaggcatcttccctccaaccatgtcactctcaggttaacccttttacaggaagcgagaacgcaagtgtaagtggagtggtatatctgtcggatgaactgactacgtggttctggaggaagggctgttacaattgggccttcaatatactgtgtatcttgtagggagggattttacaattggggtttcaatatactgggtatcctgcgatacttgagagatacagtgattctaattggatctctaatgtggatgggatcaaaatcactagtggatatgtcttcaaaaaagctagtgctgttgtttcatagtggtcttgcaaacaaactattttgacgaggtcaaccatggaagcagagctgacagcactagatactgctactgttgaggtagaatggctgcgtgatctattgatggatctgcctatggttgaaaaagtgatgtattaattgatctgtctgtggttgaaaaaccgtgccagctattcttatgaactgtgacaatcaaacggtaattgtgaaagtgaacagttataaggataacatgaaatcatctaaacatgtgaaaagacaattgtagtctgtcaggaatttgagaaactccggggttataacattgaattacactgaaatagctagaaacctggcaaatccatctacgaagtaactatcacgaaatgtgatagacaatgcatcgaaggagatgagtttgaaacccatgtgagttatactatggcggtaacccaatctatatgatcggagatcccgtgaattagaacctgtgaagaacaagccattagtcaactggaggagagtaccaatctaaatcctctttaagtgaagatgcatgtactctcatgagctgcaaggcaggttggctatatgccttaatgagttctattagctttaattagcaaagatgctatcctgtagagcattcttaaaagaacacacctttgtgagcttgactattggttgtactcttgatattttaggtgaatcttctaggaagcttactaagagaccaatgagtatgacttatacactctacccgaggagcagtctactgacggtctagtaccagataagactctgtgtgaaacttgcttgcacaagacttgcaattcaaggcatagtccattgttcaagttgtgagtaagtgtagcttgaagttctaggtggatgttcaatcttaatcggtctccatcaacagttggtatataaacagtacattggaaaaaggcaaatctcagtaggattttgagatttggtggggaattattagaattaatagatgggtcttaacccattcgaagattaattctttggaaaatcacaaaagcccacctgggatggcatgcacggggactttagtaccacctttcatattctagaagaggaagacctccttataagggaggatactcgcctagccacttgaggcatgtgaggtggagagaacggggggaacacacacgcgctcgctcgcctggcctagcatggcggcacccgtgcacaacgtacgcgtcgaatggtccccaaaattggttcctcacccttgcacagatacgatctcctttcgcagttttgttttgctgcagaaatttcgaattcgttttttggaaacccttcgaataatccgatgcgtgaaacgacgtggagtccggataagttacacgagacttatccggttcggttacgcggagtgaagattgtgcaggtgccctgatcaagcgtcctaatatttctatataagttgagcggctgcctccacgcaatatacgtgaaatcaatctagggtttgcctcctcctctgtactgcgccgtcgctcatagtctactccatcctgctcgctgacgtgcaccggcaatcgggagagcaggtctccggaaccttcgccttcgatgtcttgcactgggagaaggcggcaataaggtttttggaaaatgctttgcgcgactgctccctgtttgtccacaatggctcatcttcctcttcgctggcgtgttgcgcgccatcgtcaatgcacggtaccctgagtccttcctgctgagcagccagttttccaaaaccctcggtatgcattcgacatattccgcatattcaatctgttcatactttactgtctagtttacatgtgtagatcgtatgatgtgattatgtcatttgcaatgtcatgatttatttatggaataaatgaaataattatgtgctaatattttcaacaatccaaaaaccttattataggcattgtggttttactatgactagtttttcccatgctctaaggccggataaattcatcggtgtgcacttcaagagatggaagatcagggttactctgtggttgatggctatgaaatgcttctagattaataatggcaaacctgaaggagttctcattgctgaaaagcagaaagaattcgagaagaccactactctctttgtgggatggattcgtagcgttcttatcgatcgtctagtcgaggtgtatatgcacatgactgacgctaaggagttgtgggatgcactgccaaattcggtgctactgatgctagcaatgatctgtacgtcatggagcagtttcatgactacaggatggttgacaaacgttttgtacttgagcaggctcatgaaatacatgccatggctaaggaactcgaactccttaagtgtgtcttactcgataaaattgtggccgggtgcattattgataaactacctccatcttagagaagttttggtactgcacttaaacacaagagacaggaatactccgttgagggatttatagcgtctcttgatgttgaggagaaagctcaggaaaaagacgtcgcgtctaagggcaatgatgggcagtctaatgccaatgttgtgcacaaggcccaaaacaagaacaaagagaaatataaacctcagcagaccatcaacttcaagcatcagaagaagaagaatataacaacaatctgaactagcatgagagaacttattttgtgctttttttacttcaaacattaacaacatgacctaaatactaacctacctatgccttaacctgctccaaccgagcacaagcccagctggtctaaccccatactcagagctatcgggttgcagcaaaagcagagccactagctttcactgattaccctaagtagttttgaacagtaacatggtcttcaaaacacaactttaacttcttgtttttataaaaatatttattaaaaagtaatatatgtatacttttataaaagtatttttcaagacaaatctatttatataacttttacattttcaaactcaacaacttgagagttattcatgatttatattcccaaggtttgaattaaacattgtcctaaacgacttcctttacgagtacggagcgagacctaaccaatatgcatatgacaaggaaaaatattatctgctcggtttcaaaaaaatatattatctgctatatgaaaaatataaatcaatatattatacgctatattgtttaaatgatttttttaaaaaagagttaaataaatatttttagacttcgatacggtcttcaacatgctactttgaccatttttcctgaaaagttataaaaaatgtctgcgtttagtttgttgctaaatttggtaaatatataaaaaaaatcctgtcaaaattttggtaatattactgacttactaaaattttggttttatccaaatttaatgaggtttattttgactgtctgaacagacctttaattataagagtgcgggctgcggcgtctactgtgctgggcaagcttaattaattagtggcatcgaacgatgctacgtcacgttcccactcccaccaagtcaaggatatatactctttttctcgtttcttttagaaacatgcaagggaggaaaagacaaataaatttctgagattcagaatttttattaattttgtaccttaaaaaattgataaaaagttaaatagcaaaacccaaaaaaataataatgccctcgtgatcgtacacatcccatccatctacccacggcctgtttagttggagggagtttttagaagggattgggagtttagagggatgagactattaagtgttttgtttggttgggagatatgggaactttggtgggatggggatgaggaattgaggaaggaactccctcctttttaatacctgggtaggggcaggtaattgggagggaattcctcctctattttatctaagcaaatctcagccatccgtttttattaatgatataatctctaactaaactccctatcaattttcatcacctctaccaaacaatgtattggaattaaaaatcgaattcctatcttaatctcatcatcaatttcctcgtataaacttccaatcccttttcatcaagttaccaaacaagccgccatatcaatctgatttgggtcaacgatgcaacaataattagcaagtggaagacaagtaattaaggaggcaggagcagcatggaaaaagaagaatagaagattactagatattgtactgctgagcgaagaggacagacaggtaagctagctaggcaatcaatcatattcgctctccaaaatgaagggatcgatcatctcacaaacaaaaacgtgagggatgaaggacaaggacaagaaataggtgaagctatctacttctcgatgcatctatgtacggaggcggcggtaacacggcggcggctgctgctgcttcttcttctcctggtcacctgcagctgcctgtctgcgagagagagaagcaatagcagcagcagcagcagcaggagagtggtgaggcatctcccggggttcgatggggcgctccccttcgagctggagaccgggtacgtggaggtggaccgcatcgccggcgtgcgcctcttctactacttcatccgctcggagagcagcccggccgacgatcccctcttgctctggctcaccggcgggccaggctgctcggccttctccggcctcgtctacgaggtcggacccctcaccttcgatgtccatggccatggacatggacaactgccaaggctcttgtacaagccggagtcgtggaccaaacgtaccaacgtcatcttcctcgactcccctgtcggaactggcttttcctacgctgacaccgacgccggattccgcaccggcgataccattgctgtccaccacattctcgtcttcctcaacaactggtttcaggaggtgcaccccgatttcctctccaatcctctatacatcgccggcgactcctactctgggatgattgtgccggctgtcaccttcggaatcgccacttcatcacccaaaccatctctcaatctcaaggtactagctacttttaaagatacaaataggagtacaacttactgaaactgataccctgccacatcgtcatcttcagggctaccttttgggcaatccagtcactgatcacaacttcgatgctccatccaaaattccatttgcccatgggatgggtctcatatctgaccaactgtatcaggtaattggcatccatatatcctacttcacgacggatttttaccagcatcttactatatactacgtacgtatataatcatgtatgatttctaggcatacaagaagagctgcagtgtcaagcacaacacccagcagcaaagcgttcagtgcacaaatactcttgatgccatagatgaggcatgtacttagtaggattacttactctgctttgttgttcagtttcagtgatgctgaccactaataatcaatggtctgtctcttgaattaattgtgcagtgtgtcaaggacatatacggaaatcacattctggagccttactgcacttttgcaagcccgcataatccgcgcatcgataagccattcacttcaggggtacggcagatactccaactccaagactttcacttgtctgagatttcttcagaatgcagagtcagtggaccctaattattttctttatcaaatcttcttcgagtactagctacccctcccgtcccaaaaaatctgaacagccttgtactaatatatcctatctaattaaaatatatcctccgtcccataatatacactcaaaatatcttataatatgggactgtgagagtatatgttagtgggtagtattggttagccgaccaaatcttaccatttggtatttcttcatgtcatgcagacggcagaatatacaatgtccagaatatgggccaacaatgatacagtaagagaggccttggaattcaccaggtatatacacatctcttcatcatcattcaattgaacagtaatttgcatgcaggttcgatcattctgtcacacagcataacacaacacaatgcaatgatccactgtattcattctgcaatgcagggaacagttccttcgtggcaaagatgcaactacgacattctgtacacttatgacatcaaaagttcagtaagataccatctggatttgacaactagaggctacagaagcctaatttacagtggtgatcatgacatgattatccctttcatcggcacgcaagcctggattagatctctgaatttctctgtcgtggatgagtggagaccatggtttgtggatggacaagttgcagggtgaggacacacagtattcatcgataccatcaaattaattgagtacgtgtgcgagtactgtgtctgtctctgaccagatatattatccgtctgtcttatgtgcagatatataaggtcatactccaataacctcacattcgcaactgtcaaggtatgtgccagcgttttagcttccttcaagggatgcaacacattaatatcttggtacgcatgatctagggtctgtttagattgtagccaaaataaatattatcaagttttggcaatactaaaattctggtaagatggcaatattgtcaaaattttggcagaatttcttatgtattgaccaaatttggcaacaaactaaacgtagatattttttttataactttaaaaaaataatatggttgaaaatggcatcaaagtgaacaggccctcagtaactaaaaagagtattttggtgttaatttgtgtagggtggtggacatactgctccagaatacatgccaaagcaatgccttgctatgcttgcaaggtgggtttctggcaatcctctttgacgatggtgcatatatgtgtaagagaaaattccaggatggagatattacatcacaagaaatttatgattttgctaaaattgtggcgacatttttttccccatcacggttgaatgcttttctcttgggttgcggcggagactatactcgcgcgtgtattatatatgtctgtttcttcacgaagtgcatgaagatttgtcccatgtgtaagatctggagagtgagaacaaaacatggttcaatacagtgcaaatgatggatcgaagagcatactcctacacgtcaatgtaaatagacatgtaacattttattacgccgtcagtgtggcccccagttttgtacaccggaaatccaatgtgttttacgatatcattctctgaatcatcagtacttatttgtataaagctagatttcataattcattttacaaccctatgacttagcagttttaactgaaaacaatgttaagttgaaatcctcgattatcaacgagggttcatccaccttccctaagcttcacttcatccggtttacccttgcatccagttttccgtattcttcaccattccaaccttcccgcacattaggcagggtcacacaatccctcccaacactattcaaagcaagattaaaatttataaggctattcaagagtaatacaagtcccgacgcttaatcgcgagcatgactattcgaatatatttgtttactcacattgcaagggatgtacgcttttaatcccgcactccgtgacgcacacaacacatgagacttgtcacaaccctatttttcagtcacccttgcattgcgacacccactgcaaggactcctggtatttcgaggtactaggaggattacacaatatatatacttaggtgccttttagatttttgtcatggcatttgatcaatcgaacacatcttccatcacaaacagtaacaactgcagaactaccatgacaggtgctgccccactcaggttacctaatgcatcaggtctatacccactcaagcaatggaatcatactctgattgtttcctgcgtagcttcttgactcggtcctttacttactacaatcgatggcttgttgtttcatagaaccacacatattgtatccatgtcgtcccagtcgaaattattttgttttattaagtttttggtatttgcaaaagtcttatgttgcgggtgatgctcatgtctccacccgtctttcaacaatcactcacatcgactgaccaacacattcacatccatataccaaacatggagtgtaaaattgtctaaacaagcaatactaagttatgttaataattgaccatgtaataataaatagactaagacagcaaggaatatgaataataattttaaggtggctcagaatcaagtttaggtacgaactttataactactccctccgttgcatgttataagactttctagcattgcctatattcatatatatgctaatgaatctagacacacatatatgtctagattcattagcatatatatgatgtgggaaatcctagaaagtcttataatatgaaacagatgaagtagcatgcactttatttgcaatcaatacatctattaacttattaaaggaatagaaaaaggagcctccacgttcgctctcacgatctagaaattctcatattaatcggagaaaaagaaaaatagagttcatatagaaatacaatttagaaataattgaaattcgaaggaatattggaagagaagactagagtccatatagaaatacaattaagaaataatggaaatttggaattaaaaataaggaatattagaagtagagtatagagtccatatagaaatacaattaagaaataatagaaattcggaattaaaaatgcggaatattaaaagtagagtatagagtccatgtagaaagccattaagaaataatagaaattcggaattaaagataaggaatattagaagtagagtatagagtccatatagaaatttaaaactaactcaaattccaaataaacataataaaattaacgtagagtttagagttcatataaaactacaatttgcaaataaccaaaattcgaaattaaaagaaaatatgggaagaagagtctaaagtcaatataggaatacaatttagaaataactgaaattcgaaattaaaaattaaagaatattgaaagatgagtttagagttcacatagaaatacaattagaaataataaaaattcagaattaaaaataaataatataggaagaagagcctagagtctatatagaaatacaattgacaaataacgaaaatttggaattcaaaaaagaaatattgaaagacgagtctagagtcgaatataatttacaaataactaaaatttaatattaaaaataattaataactaacacgtatataaaatacaatataaaaattacacattagtagtttcataaagttaatacaaaatttaaaattatgttgtcattttaatatatttgaataatacattgagaaaacatgtatgttattatatgagagaaaatataatgattttagctgcacaatctgcgcaggtcaacatactagtttataaaaatatgatcaacatgctaaatgaggggagcgtagagactttgaagtttgaacagctcttcgtcgattactgcggcttcgtctacgcaaacgtaaaacctgtttggcgaacaacgggtcaaaacccggttttcctattttaaagcaaaggggcaaaatcctagaaaaaggagtaaattttacaaaattacaaatactttgatcaaattatcgcaaaactacagatttaacaagatgtatcacaagactacagatttaacactaattttatcacaaaactacagatttaaggtaaaatatcacaaaactacagatttagtaataaagttatcacaaacatatatgtttaatgtcaatttaatcacaaaacttggatatttataactcaaacattacattagtgcaaaggatttaaatcctaaaatttatagttttgtgataattttattctaaattatgtagttttgtgataaatttgttgctaaatatgtagttctatgatatatgaccttaaatatgtagttttatgataatttagtcaaagtatatgtagttttatgaaatttactaataaaaaaaaggtaaatatatgtcatgatatctgcgctgagcctacgagagagatgccgacgaatttgatggtgcgtatcattttgaagcgtaatccactcatcatgtacatttgccttgctcagttgctgtcgtgagcccagcaggcaaatcagacaacgcaggatatgcagtgctctgctctgatctgatctgaactagtactagtataataaataagaaagataatttgtgtgtctctcgtggcaagaagtggagtactcctaggagagatcagtcgtcctggacgcagaagatggtgggcttgacgggctcggtgatctcgacggtgccctcgagcatcttggcgaccttgcccatggagggcctcatgtcggcgcggtcctgaaggcaccacatggccgtcttgaccatgcgctcgacggtggcgaggctggcggggtcgtcgtcgtaggcctcggcctggacgatgcgagggtcgatgatgtcgtcgatgcggcgctcgacgtagaccttctcgaaggcccacttggggaagtaccagtcctcgctgccgacggagtcctggcggaagccgtagttgcggcggccggagacgatctcaagcagaaccatgccgaagctgtagacgtcggccttggcggtgatgggctcgcggtggatgacccactcgggggccatgtacccgcgggtgccacggatgcgggacatggtcaccttctccttcttgctggtgagcttggacagcccgaagtcggacaccttggggcagaagtcgtcctccagaaggatgttctcaggcttgatgtcgcagtgcagaacccactcgaggcactcctcgtgaaggtacgcgatggcgcgcgccacgcccagagcgatgcggtagcgggtgtgcaggtcaagcagaggccgcttgttgctctcttcttcgtctccttgggtgccggtgcctggagcgaacaggtacttgtccagcgatccgtttggcacatactcgtacaccagcatcctctgctccttgtccgcgcagaacccccacatccgcaccaggttgaggtggtgcatccgcgcgatgatggtcacctccgcccagaactccgcctctcccccgcccaccccgtccagctgcttcactgccaccgcccgccggtccggcagctccccgcggtacaccttcccgtacgccccgcgccccaccaagtccgagaactccttggtcgccgccttcagctccgcgtacgagaaccgccgcggcccgccggcggggaggtactccagccccagcgtccgcgccatctccctgtactgcgagtacttgcgcaggaacgcccagaacgacagcacccccgccagcagctccaccgcgaacagcgccgtgatgatggcgatgttccggatcgtcgtccgcccctgcttcggcggcaccggcagcgccagccgcaccgggcacaccgtgtcgatcatcgtcgtcatccccgtgaagttgttcgggtcgttgttcgactccaccacccgcaggtaggtcgacatctccgtcgccggcgaccaatagccgtccaccagccgcgtgtagtgcaggcacgtccggtccccgcccaacttgtagccgaaggccacgcaagaggcgttggcccggcacttgctctggcagtccgccaggttctgcggcgtcaggctggtcatgtacttgccggggacggacactccggtgtcggcgccaccggagaaggaaacgaaatccatccgcacgaacttgtcgtcgttgcccttgccgctgtagttaagcttgggggcgcagcccaggccctgcgggcggtaccccggcgggcagacgcaggtggtgttgtcggcgccttgggggacgcagatgttggcctccccttggcaggcgccccggatggtgcagagctcctgcaccagctgccataccacccgccactgccctttcttggactgcaggctgtagaggcgcaggttgccgtcgtcgtcgagggtgaggcggcgcaggcggcgagtggagccctggtcggaggcgatgagctgggagggattgccaccagcgagttgcagcgtgccgtcggcggtgaggttgcgcagggcggtgttgccggtgatgttggcgtaggcggaggagccgtgctgcagggtgagggcgttgaacagctggaatctgccgttctgggactgcagggtgatgctggtggtggtggtggtgccgttgctaatgctggggatggcctgcgacgccatcagcgtgtccgtcggctccccgaagctggaccaggcgccgtggtcgaggctccccgagtcgttcagagacaaaggggcactcgtggagttgaagttgcgggaccaaagggtggtgctgttgccgttgtcgctccacgacagcttccccgccgcgtcgatggagagcacggaattggcgtcgccctccacggcggagtggtcgtcgttgtgggcgtaccatatgacgaccggcctggactcgttggcgttggcgctcacccagacggcgaaccagaacttggctggggaggagggggagggccggaatccggcggcgaagtccccgttgttggagacgagggtgcggttgctctcggcggggctccaattggtgtcgttggcggagaaggtccgcatctgctgggcctgggcctgggcggcggcgagggccggtaggaggaggaggaggaggacagcggccgccatggttgtgcttgctggattggggaagggaattggatttcttgcttttggatttgggatcgaaccgacgactctcctcacctcgagtctagtcaacaacactgtagccaatttgcccatcatgtaaattgaatattcattgccttgactgtggactggaatttcttcttcaatcgcgcgcgtaatccatgtgcctttcctgttgcccacggcggctaatcacaatcaatattaacgctttctcaaatactccctccgtttcaacatatttgacaccgttgactttttaatatatgtttaactatatgtatacataaaagtatatttagcaatgaatcacatgatacgaaaagaataactaattactttaatttttttttgaataagacgaatggtcaaacacgtactaaaaagtcaacggtgttaaatattttgaaacggagggaatataattactggagtactactaaacatttgtaatacaggtaaacagcgatatagtaatatattaactgcatctgcatgctttcgtccatccgtctgacttgcttccaaattcatgctactataactaacttaaacctctgttactctccatttttactgcaaaataattgccactcgctactccggtttggtggttacattattgagagagatgctctccgtggacttgtcatatagtactagtatgtgtgctgtgctgtgctgtgctgtgcgtggtctggtggtggcgatgaggacaatgctgcaggaagctagatttagacttggacacgaaaccgttgactttgatcggaccagtcagcattgctaagagcacccgcaatggtaaagtaaggtgctatctataaaacatgtacatctcagcaatagactagattaataagtaaaccatctcaatagtatgtctacataggtatctatagctctctaatacattgtctcgtttttctctatagactatctccaggttagtagatagctttgctctctctcttcatttaatctcttccaagtaggaaaatatgctgacatggatatcttatagagagcctatagataaccattgtgggtgccctaagcagccaacctgaccgctgtttcctgcctccttgcgtgatctcaatcatttcccctttgttaacactacatgtacgcttacattttacggttacccaaatttaccggtgaaataaaatcccaacaattctgaatgtttgggataggaagattagacagcatacgctcagagaaattagatgggtggtccgcgcaattacgctgctagcatatatataaaattatatatttttaatatgattttacttaaaatttattaaatagttgtctcattgtcttaagattttgaaagaccaaaacttagcatacttgtgtttctaattttatagtttttaaaagtcacaccagttactagcccttacttctgttatattattatttatttacttgctcgatcaaccactgtttctattcattctccttgaaacctttaaaatttggatataaaaacttatagtttttagagtttattgtcatgttgggcttcttttttataatttctagaagtttcgtcaaacgctaccattataatcctctacgaccgtccactgcatcttctctttattgtcattactattttaatagtctaacataattatcgtttacgttcatttttttactttctataagttccgccaaaacgtcagcgactttgttattgtcctcccctacgattcacacgttgccgcccttctttaatgtcattgagattttaaaattaaacatgattatcattggtttttttttactttttagaagcccaaacctttaaaaatggaccttatagtttttacagttttttgtctcgttgggtttctttttttttacaatatttagaagcccgaacctttaaaaaatcctatcaaacgctaccactatactcttctacgacccgttcgccgcatactctttattatcattgggattataaaaatcgaacataactattgttggaattcatattttaatttcaagaagacccaccaactattggtggctctgccattgtactcctatacgacccgcccgctgcctcatattttaattgagattttaaaaataaaatatgattatcattggggtttattttttttactttctagaagtcccgccaaccgccttgaccgattgcttcatgacctgtccatcgtccttccttttaatcgtcatttggaatttctatttggtgttttattaatagtttttagatgtcccatcaaccgccaccactctgctcctgtataggcttgctacttaattaatctcatcatgtgtttcagatggtcttttctttcaataatctttattttttatcactaattttagttataaattgtatccctagttgaaatctttttttctttttctcattttagaatttagtttatttacatattgtgttcttttgatatttttatttttttatttttaatttcagttgttttaaaattgtattcctactttaactctctttttaatttgcctaattttggatttcattttatttttttattccgaattttaattaatctactattgggttcttatacatactcttattttaatattgcttatatttaattccgaatttcagctaattttaaattgtactcctactttaactcttcttttcttttccttttttctaattttgattttttttatttttatttcgaattttaattaatctcgtattggattcttttatggactcttctttcaatatttcttttttaattccaaattttagttatttttaaattgtattcctacttggactctttttttttctaatttcggattttattttatttttattgctaattttgattaatctcgtattactttcctatttagactttttattcaatattgcttacttttaatttcgaatctcagctacttttagattatatttctacttggactcttcttttctttttctcgaattaatgttggaatttctagcctccacagcgaacgttgtgcctcctttcaaggtttgctaatttcagattttattttatttttattccgaattttgattaatctcgtattactttcctatttggactcttttttcaatattgcttacttttaattccgaatttcagctatttttagattatatttttacttggacttttcttttctttttctccaattaacatgggaatttctagcccgcacagcgaacttagtgcctcctttcaaggctgttttaataatataatagatagataaaaatagagagcagaccaaatgagcctaaatcgaattgcgtgaaaaaaacgaagaggaagtccaactcagcagataaggcctggcttagtttcctaaaaatatcacaacgaatctttgacacatgcatagagcattaaatatagattaaaaaactaattgtatagttagaggggaaatcatgagacgaattttttttatcctaattagtccataattagccataagtgctacagtaacccacatatgctaatgacggattaattaggctaaaaagattcgtctcgcggtttccagacgagttatgaaattagtttttttaatcgtgtccaaaaaccccttctaatatccggtcaaacatgtgtgtaacacaaaagtattcttttcgtgaactaaatgggccctaaaaacatcatttcttgtatatggcccaaaaaaagatgattaagagtttttcttacaacgcacgggtaaatataatttgtagcatgcatcgaagtataaccaatcaatcgaccacggcagcgtaaggatacacagaagaaaaaggtaagccgatggatcgagataattaataaagaaaggctaataatgactattttcagtttttccaccacacaaaagcgttgttacgggtgaaatcaattttaatctttcctattaatccactcaaatgtgtcattaggagaaatgtgtgggccccatcgggagaagaaatatctcctccggctcggctcggctcgattctaaaggtgccggtttttctgaaaaccagcccctttaattaatataggtgtcatttcattaaaaaaccgacatctataattaattaatggtgtcgttttactttaaaaaatcgacacctttagtataggtggttttttttacagaatcgacacctataataaaggtgtcggttttttatattttcggaccgtagaggtgggaaaatgcttataggtaccggttttaacacttccggtatctattgtgctaacatctatttgatattttgtagcaatggtacaaagagccatagaatgagtggggcctaacaattgtagcccacagtcatataacagagcaatcaaagatttcaagacacgtacgcacgtagttagtaattagtagttggacgataagttagaataaaagaaagccaaatctatatctctactattataaaaattaaagatgtttttgccggcactttggtacgttatccgtgtaagagtcggtttttaagttcgttcgcttttggaaatacggatatctatttgagtcaggtttctagattgttcgctttgggaaatacataaggagtcgtataagaaatctctttaaaaaaaactcgtatactaacttgagatgattggactcctaattgtagttcatgattttctagaaaaatacatatccaagcgaattctcacagtaaatttcacattaactaaaccgtataacaataataaaatttaaataaccttcacccgttgcaacgcatgggtattctttatagtctatctaactaaaaaatacgtaaggtttccataaaaaaatttccgtctgttttttttccgattcagtttttcccgtgatttttcgctgttttcttttttttccgattctttttttcgtgttttttgtccgcctcttttttttctgtccctttttttttatttcttcgtttcttttttccatccggctttttttctgcctcattttcatccgctcttttttcgttcgttttttatctaacccctagcgtcgctgccacgttaatctgggttcagggtttaggttcctccccatacattccctcctccaattgactgaaaaaagattcttcactactccctcattattttccccactattgtttctttcaattccgctttaatttaccagatctaatctccatttaaaagtcaccatgtaatctccattaaaagttcatttttatcctgaattttatggattcgtttcgattttgataaaaacgaaaatagtacgagtgtatcataagtccacaatcaattttgggagatcgagaaaaattcaatctggggaggatcggttctaacattgtatggtgacgaaaatatctttctagagattgaagacggcagtcgcatattgatggggaggatctgtctttcagagattgaagacgacagtcacatattgatggggaggatcggttctaggatggtttggacacgagattgtcttccagagattgaagacatcagtcgattaggcgagctaggcttacggctttacttgtaggctagccaaagagaggcaagccaaacagacggaggtaacaggttagactgggactgaaaaggaaatgagtttttcctcagaataaaaagtataatgtaaaaaatgtttttacccgttgcaacaaatggacattttttctaggtacttactaattaagcattgatttttcttttgatttttcgcaattttgttttctaatttttcaagccttgacgaggcattgaacctcccggtcccagcccgacgccagggctaccggccgctcccagatctcatttgaagcattgagcagttaggtctaaccacacggaactttccccgatgtgaagaggattggaaaaataggaagagggcagcctccagcgacaggaagttcactttagatctcttaaatcgtcgcctggtttttgtccttattcgaaaaaccagatacaactcatcacttaacttacaaaaccgtgcaaacgagattcctcgatattattgtctctggttttgactaacgtggcgtctttaaccatgtcttcatcacacgtggtattgacgtggcgcttacgtggctatttgatgaaaaaaaaataaaaggaacaaaataaaaatttggaaataaacaaaatatacggacgcacatgtcagaataaaaaatagtgagacccacctcctacacctcaccctcttcccctctcttccaatcctctgcctccatcctcatcctcccggcgacaagcacggcggtacctagctgtcgtccgcgctgagatcgtgcatgagctctcctcctccgcttcgtcctctcccccgttactccaatcctaggtaccaactccaccgccacatctcgccgccgcttgcagcctcgcccccaaatccagcgccactcactccccactcacacgctcctcatgttcttcttctatcgctagagagcaacagcaaggacctctccatccatcggtggctttttacccataggaggggagaggggaggcctggccattgacgctgtcgcgatggagcgcatggccaagcactgctgggatctgtgggacgcaggcagcgacgccggcgttagatccagctggccggtagctcatgccagtggcggaggggtcaagccgtcgtgggaggaacaggtgttctcgcaggacgcagcggagcacctcggcggctgcttgtggccgccgtgctcctacatgtgcagcttctgccggtgggagttccggttagcaggcgcttggtaggcacatgaacgtgcattgctatgaccgtgctcccctccggcagtgcgacgacgacatcgacccgattcaaccaccaatcggcagcatctgcgagccgcctactcttttaccgtcaacggtagtagcagcagcagagtatcctttttagataatggaagtttttatttaactcagtcaattacatcgagatgatacaattatcctaagaacactctcggcctatgcatatctcctgctacaaatatccagccctaaatccacaactgctcatcatcatcatcataatcagcagctgcagggcactaattcttcgtctctgaattcctgcataacaaccatcatcaagaagagcaggaacaagacaagatgaagagaggggagattggaagagctgaggaagatgaggaggggagtaagaatgacatgtggccccaccattttaaattactatctttttgtaactaacgtgtgggtccatgactattatttttcaaatcgaattgtcatgtaagcgccacgtcaatgccacatgggacgaagatctagtcaaattagtcacataggcgccacatcagccaaaaccgccgtccaaaccaccgagggacctcatctgcactggttttgatagttgagggacccgttatatctggttttgcggttgaaggacgaaaatcggattcgttgacaagttaagggacctcaaatgaacttattccctagggacatgtcacgcccagaaattcccgaatagaatttcaagcagaatgtgcattaaaatccccgtccaggaccagccggggtacacaaacgacaatgttgacattcagatccacgtcttacaaacatcataaaagtcttacataaatgcagcggaaagaaagagagacaacaggagctaagccttgactagaaccgcagcgggatcaccactccacaggcatcctcgacggcacggacgaagcctactcctcggagaaaccttcatctgacacatactcgaactctggggttgggaaaagtagagcaagactgagtactacccactgtactcagcaagtcataccggaatagaggcatgatgcagggaatcatcaaagaagagctaaagtggttcatttgcataaagcgagcatttataaacagaagttgaaagattaaacagttgtaataattaattaatattaactatccactgtccaacgctatcccacgttgcaacaggcccaaccatccacctaaactatccagtttcaaaagattacactagggtgagactaatcacggtgaatctggttgaccgcccataaccgcgggcacggctattcgaatagttttactctgatcagaggtgtacaactgtacccacaagacacagccccacaacacgtttccgtgcgccgacatgccaccacggcatatcagaaagaggccgtgacaggacccttcgcataaccccctctagccaagcacaccacacctcaggtttcacacccactcctcgcaaggcagcgggcagtcccctctcgtgcctaggtgaatccggaagcgacagaggccgtcgcagggcccgccccgctccatcacgcccacccttgcctggatgcgtcgactagaggaaagctatactacaagcccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaagcggtgtcactaatccaacaaaaccattagaaccaacagtctaaacgttaataggattttccccaatgtgaactagttgaactaagcatggctaagcaatccctagtcctaactctaatcatgttagaaccccaagttgacaaagaaacaaggtacaacaatagcatggctacgacaataggtaaacaacccatagtaacattataaaacaatgcaatatttgacagaaagcaatagagcatttgcaatataggatcaacatattcaagtgacaagcatgacttgccttgctctgctgctggaggaacctcggcgactatttcgaagtacaccggagcgtcggaggaaccggaatgtagcgacatacaaagcaaacattgcaaacaggctataagactactgaaacagagaacgaaaccatttttaatggactctacacatttttcttgatttactgagacttgaatgggcttaaacggagctcggatgaattagttatgaattttagaagattcactgtgtttattactatacaagaaaaaccttaaattattcattgggcaatatattccagggctgacgtcatcaaggcggggcggcgccggcaagcggggcccactggtcagcggctcaggggagagcggttcaccgtgg

SEQ ID NO: 36589 - DNA, 9062 bp, Oryza sativa
gcacgcgcgggcgtggtctacgtggcccggaggaggcgaaggcgtggacgcgacggcggttgcgggcgaggcggttgcgggcgcggcgtcggctggaggagggagacgggcccgacaggtgggccccacctgtcggcgaccccgagagaggagggaggcgggacggcctggatgggcctcggcctgcggccggcccaacagggaggagggggaggaaaggagagaatgggccgacggcccattcgaaaaaaaaggaaaaagagagggaaaaaaaaagaaaaaggaaaaaggattttccctggaattaaaatattgcttgctcaattttaattggttaaaattatttttaaagctctgaaaattccactaaaaatcctgttagtgaatttcgacatgtagaactcaagaaaaattccacatgccaaatccgattattatttgcattactttcttagggtttactcttgctttgcacctgtattttcttggggtcatttataaattaaatttaggcttgggaggagaacttcggggtgtgacaggacactacacaagtcggcccataggtcccatatttcctttcggcccaataacgcccaaaagttactgttcttcttttccacacactttttttttgcgaggattcttctccatgcacttgcattcacgaagaaaaatttgcgtcgttctgctgctgctcggggaggaagaatgatgcctcaggaaaatagggatggggatatttgtgatgccgcgcagctatggcaaccacctcatgcgaggcccacatgtcggtctctcttctctcccttcttcttcctcccttctttctctcatccgtggcaccgtagagcttgaagcggtaggtacatggcagttacggatgactttctgactttccagagaatatgaagaacgatgtggtagcagaatgaggaggtcccatttttgccactttcggcggagaactgcatggttgagggctttctatgaggtgggaagcgaggaaatggggaaggagtaggcggcctatatgcaagggcaaggggcagatgacgggatgaggagcggcaccgcacgactaaggtcgcagtggctggcggaggaggtcgatcacgatagatgaaagagagcatgcgacgtgaatgaggatgagcgatgcctacttgagctgagcaacgatctgtacattatgggtgggcattgtttgtggggtggggggggggcggatctggggcgcggggttggcatgagattagcaagagaggcgcgcaacaccgagtccggaccaaaattgttgtgcgctggcggaattgatttgatggcgggacgaggcggacgaaacctagatccgacgaacagaaaattacagattttttaagtaggttagatttgtaacaagtgcagagtttaaaagaggcgtcatagtggaacagtcgtactctgcggtttttcctttctcttcgggggcgcaggtcccggctagcgtccctctcgacagtataatgtcgatcgtgtaaaagttgtaataccctctttcttcttaataaaatttggcgactcatccttcggccgtcctggcaaaaataaaggaattaatgcaagtgctaccaggaagaggcatcgatgataaacagattgaaggctgcagcctacttctccctactccgacctcttcctccttcctgctgatttcttctctccaactatgttctttgatttcccgttctctacttctcttcctaatctacttgcttgttccccttaattgtattcaatacttgagcagtactctctggatcggttattggtgcttctccttctggtgttgattttttgaggatgaattgagaacataacactaggcagctgacgtgttagatccacgtgggtttcatgctgactcaatcgattcaacctcatcacattagttgaaaccgggcatagtagtgcactagtgcttagatcttcgtgcatcttttggtattgtaagttgatggacgcgttatatctggtaatacgttttaagaaactcaacgttcaaatggcggacctaaagtgaacttattcctgtgtaatactctgtagcaagaattgggcccgatttgattgtgcaagtagaagggaaggcccaaagatagttggctttgtgatatatgaagtgacgacgctaagattgggatggttgttgttgtgatgtgcatgggatggaatctgctagcgtggctgtggatgcgtgcgatatgatgcagcagggagggaaggagggagcgagcattggtggaggcagctgagccaagcgcagcccatccatattcctgctttttcccctatcgatgacacacatacatgtccatctaacaagtagacgtactagctagtagtaggaacgtgaggaacgtagccgtcgtcccagtcacacgaacacgcacacgcacactttcattcgtgtgtgtgtgtggctctgcttgcttctcgttagtattgtccatcggatcggtatatatatataagttgctgaggaagaagctagctagtaattaagaagaggcggagctggatcgatctatcgttgagttgttattgccacacaaacacaaacactgacgcccatggcctccgacggcaccgatgtcgtggcgctctacggcggcgccaatggcctctcgcacaagtccggtagcttctccgtcaaggtgggcctcgcccagatgctgcggggcggcgtcatcatggacgtggtcacccccgaacaggcgcgcatcgccgaggaggccggcgcctgcgctgtgatggcgctggagcgcgtccccgccgacatccgcgcccagggcggcgtcgcccgcatgtccgaccctggcctcatccgcgacatcaagcgctccgtcaccatcccggtcatggccaaggcccgcatcgggcacttggtggaggcccagatcctggaggccatcggcgtggactacgtggacgagagcgaggtgctcaccctcgccgacgacgcccaccacatcaacaagaacaacttccgcgtccccttcgtgtgcggctgtcgcgacctcggcgaggcgctccgccgcatccgggagggcgccgccatgatccgcaccaagggcgaggccggcacgggcaacgtcgtggaggccgtccgccacgtgcgctccgtgatgggcgacatccgcgcgctccgcagcatggacgacgacgaggtcttctcctacgccaagcgcatcgcggcgccctacgacctggtcatgcagaccaagcagctggggcgtctccccgtcgtgcagttcgcggcaggtggggtggccacccccgccgacgctgccctcatgatgcagctcggctgcgacggcgtcttcgtcggctccggcatcttcaagagcggcgaccccgcgctgcgcgcccgtgccatcgtgcaggctgtcacccactacagcgatcccaagattctggcggaggtcagcagtgggctcggcgaggccatggttggcatcaacctctccgaccccaagatacatgtcgagcgcttcgccgcccgctccgactagctagcaacgtagagtgccatccttcctttccgtcccctgccaccactgccaccaattccttcctcataattactgccatatctgtgatcgatggttgtcatatattgaaaataaacaacaaacatagtgtatatatagtactatatactccctcctttccacaatgtaaacggctgtaattaatatgcccctaacatcactaaaggaccatgcacatctatctatctatttatctattatattattaaaacagccttaaaagaagacaccacgtttactgtggggattagaaattcccacattaatcggataaaaggataaatatttacaccgttagatcgtagttgtactagattttagtggtatagattattcatgacaatattgagtctaaatagaaagcaactttgatctaataggaaatatgggagtcggacatgttgaatgaatagaagtcggacatgttgattgattaggagtcggacaggttgtctgagtatggatgctatggtcttatggacagtaatcagacaaattacattaatctatgtttagatggtaattagagtgcaaattgaactatagtgatctacgtttcatatgtggctggaaaatatacgtgccatacatacatggccattgatagtaaagagggagaacactgcatgcatgtcatgccgtatgcacatgccaagatagcagagacattgggcggagatagcccacaatcgatctagaagcaaaacaagtatgctacgaagaaatcaacatagatatacattattttataggacgagactaccgatcgggcgccccatccaagcatgaaaaaatcggacgctaacgtcagcataacgtcagagccatgcatgcgtgcaaaaccactttaaactattttttctcttaaattatttatccaaatcatgatccgattacatcattaaattcgttgcaattaaatattcaaaacaagaccacacatggatatattccggcgaaatttttttagcttattattaaatcgggcgttatttcaccttatataaaaataatactttagcaaatagcggaagaatgtttcagttcactgcaacattagatctatacatagtaaaacattgtgagtacacttggtggaacattttttgtggaacataaaaacgaattcccttaatagagaattttcaaaatatgtgggtgatttgttgcaaaagaagtttcgtttactgcaacattagatctatacgtagtgaaacattgtgagtacactaggtgaaacatttttagtggaacaaaaaaataaaacgactttccttaatagagggtttttaaaatatgtaggtgatttattgtaaaataatattttaattcactgcaacattagatctgtgaaatattatgagtacattaagtgaaatattttttgagacacgtggtggggccaggggaacgtgcgcacggggagggggggagcgctcgatcctgctccacccccgtcggtcgccctggcctaagcatatttgtattttataagacatggcaaataaaatttaaggtacaatatcttcgccagtatgatctatgcatgtacaagaccatctaaaacatttgacgagataaattaagtagcaggcctacaaaggagtagagtggtggcagttaatacgacatataaaaactgttaataaaacaccaaatcgaatcctaatgacgattaaaaggagggacgacaggcaggccgtgaagcaaataggcaaagcggttgccgggacttatagaaagtaaaaaaataaaccccattgataaccatattcgttttttaaattttcaatgataataaaaagtagaagcagcggacagggtgtatatgagtatagttacagagctgccaacggttggtgggacttctagaaaataaaaagtaaattctaacgatagttttgttcgatttttagaatcccaatgacaataaatagtaggtggcaaataggccttagaggagtatagtggcatcgtttgatgggacttctaaaaactataaaaaatgaaacccaataagacaataagctctaaaaactaccaatttttaaggttcgtaacttctaaaaagtaaaaaaaacaatgataatcatggtcgattttaaaatctcaatgacaataaagaagggaggcagcggacgagccatagaggagtacaatagcaaagcccctgacggtttggtaggacttctagaaagtaaaaaaatgaacccgaacggtaattatgttcaatttttaaaattccaatgacattaaagagaaaagacagtggacgggccgtagaagagcataatgacaacgtttgacgggacttctagaaattataaaaacgaaactataagatccaatttttaaaggtttcaaggagaatgaatagaaatagtggtagatcgagcaagcaaataaagaagtatatgacagaagtaagaggtagcagctggtctgacttttaagaactatatagttggaaatacggagatgataagatttggtcttttaaagtcttatgataacaagatagctatttaataaattttaatatatagttggaaatacggagatgataagatttggtcttttaaagtcttacgacaacaagatagctatttaataaattttaagcaaaattataccgaaaaatttataattgtgtttaggtgctaagcgcgcaattgcgtggtccacccagctagttatagaaatgctatactgtttatcccgcccgaccacacgcccacgggttgccattttcatcaatgtgcctcaaaggtgatggtttttaatgggaaccagcaccaataataaaagtgccgaatattttaacaaaccaacacctgtgcatgagataaaagtgttggttttataaaaaactgacacctcatcggagctgagccgagccgtgctgagcgcttggaccgccaggttttttaagtccggcactcccttgtttccttcacactatcattcttctctcgtctctctcccgccggcatatctaaggctggcagtggtgcggctgcggcgtgcccgccccgtggccgctatgcccgcaacaagttagtggtgccgagcagcccacatgcaagcccgcaaacttctggcggccttgcccacctgttcactggttctactttgtccagattaaaagaacatgcatgatcagataatcagcttactatttgtgtgctagtgtttgtaagtagtagtaaaccacagtggcatcaattacaagaaatgtttgagaagaattcagactaagcactcaatcccaaacaacgatatttcctccaagattttgaagatggcaaatagaatgacagaagtcacagaaccgttgcattgctcactgaatttacaatattgatatgagtggaataataggacattatgaatatcctaatgaagatcaaactaacgattgtatcaataacacaagactgtgctctacttcaatgcctgatggtgttgaagcttgcaaatcttcagattctggatattgacaaatcatgattatatatgagtttttcatcaggaagcactacttcgtgaatatttgaaagaacaaaggatgcatgttgcttgcactagttcagtcgaaaatatggccagcaaaaaaaacaagatcccaggatattagcaagcaacctactaaccataaagaatcagaagaatctgcaggcaccaaagagagaaaacaacctgcaatttctacataattgagttctgcataggaagtttagaatggtataatcaaaacttggtaaaaaaatgtgggcaattcatggcaaagaatataattttcttacgctggcaaagaatataaaataaatcaacattcagacaatttggaggctgcattcagcacataacctcaatgttcagactttctccaggaacttctcaggaacccctgcatatactgacagaattgcataacatcgaattccatgaaaatataatccacttaacgcaaagaaagaaatacaccaccatctgtctgtcagtaaaggtgtgaatacatcaccatctgtctgtcagtaaaggtgtgctcccgtctaagcaaaatgtaagcacacagtcatatgcacatctccaaactgtcttctgtcataaaaaggaatttgacagccaagcgactgcattatataattgacatagcttaaaatctagggggctctaaaactcatgaacaaaacagataattattttagtgctgaaacttagttatccaaggctaatcttgtgtgttcaaagtgagcgccgaaagtagttacacagtcaaaaaaaaaaagaagaagcagttacatgtaaattatttttttaacttgttttcatgtgtgaaaaaaaagcagtgtgtaagtaacgagtttatacataataatgctgaacaggaatcgaacagcaaatagaacagtctattcatataactcaaaacaaagtcagaaagatataagattaatgtacaagattcaatgatgtttctcaaacaggcatatcacatatttacatcccaggtgaccatcaagcatgttatgtaaaggcaagccatcaaaactgcacattgttatgcacgaaagcaactaatcacaaacaagcaggagctaaataatcttctttttttagtgaagtgatgcgtacatccttacaaaattaaatatggtttgaatctgaaaattacatccttgctttctggattcatcctactcagattcactgcatctgcatctccctttcactgcatccacatcagggaaaaaaaattcaagaactcacatgcatagaggtcgacaggattgaagcagaagctggtctagcaccacccacagaaattgacaaaacaggtggagtgggtgcgatgagctacgatgagtgcgccgccatgagcccatgaccggcgatgaccacgaaggtcccttggaggacgcattggaagcggcggtgctggaggaagtctgcaagatcactaggaatggcggcggaggtggagatggcagcaaaggcggcggaggaggaggcggtggaggcgtcatcaaatccatggcggcagcggctagggttcaagccgcaacagcgacgaacttgttcgttcccctcctctttctgatgctccctcgatgtgggttgtggtggcgccgccggacgtggtgggcttgccgcatcagcccacttactcctaagtggttaggcctaagtgggtaagtggtgcgggcctgcccagcagctgcatcagaccacgcacgccaatgccagccttaggcatatctccccagcgcagcagcgggtcagcagctcctcgagaccttgacatggcgacggcggccaacggcacagcggggccgtgtctcaccggcgcagcagcggtcactggcacgatgggggactgggggatgtgcctccccagcgtgacggcggagacggccgtgtgttcctcctccgtcctactcgcccctccctctcctctcatgtcct

SEQ ID NO: 36590 - DNA, 10446 bp, Oryza sativa
tttttattatttatctattgaaatttaaattaggatgaaacttatcgaatttctagacagcaacaacatttgagcaacgtccgaacattggtttttttttttttggaatctaaccgtatttcatgaaccctagtcctgtcccgtgaggcggacaagaaggcgtgggggcctgatctggcccctgagcttgggacctccatagcggcgaggaggaggtctggtgaggagtagcggcggcctcctgctcgcccctccctctcctcttaaattagagaaaaatcttaaaaatttcgggaaaaaaattcctaccattggttttgacttaaattggacacgttattttcaatctattttttcttaaaaagaacacccaagtcctccttccctccctccttctcctcccctttgtggtatatgatgcatctgacacattattttaggtcgttagattagttatttagaaaaaaaacatcccaaacctccctccctccctgccccgtgtgcaacgtgtgtcattcttttctctctatgttttatctccttgataattaaaattaaaattatctatatgggaaaataacagaaacatacctccatctattacttatatcacattaggcatttaacgactttctaccaacctaattaatttctcttaacatgcatattggcgctatgtacctatacaaattgttcttgatacttttaaaatgatctttttaggagataaataaatgttcttgagaaagatgatcatagcatccaaattacacatatgatccatgaagtcactaataaattagagaaaaaatgtaagtgatatatcattttcttaataataacatgtactcatgtagcattatagacaacatattgaaaataaaggtgtggtctgttaaacatcataccgataagcatatgggttgcacctagaaatcttaacaatgaaacaaccttagtaatatatcaagtcgattccatataggaattaaagaccatatcctttctttttaaaacttgctaacgtacattgtaaattctttgatgtggaacaatctagaaatgtatatttgttataagacaatccagtttagtgataattagctaaaaacacaatgaccattacttcaatatttcatgagagaaaagttagaacgtattgcaaatatcaaagcatttcatggatgattcatagaatagaaatcttcaaaaagaattaaaaaatggacttgaaataaattgaaaattgaacaaatgttgatgtatttaaaacccattcaaaatagaaaaaatcaaacaatttacaaggacttttagaatgaatatatatatatatatatatatatatatatataaataatagaatagaataaaattttaatattattggatttgttttggggttgtaaaatatccttatggggagtcaaaatactctaaattttttcagaggaatttcatttcgatacaatattttgttttagaatttatatattgcaaaggtaattatcagaaaataaactagctttcaaaggacacaaaataagtttaattttagtttagaatatagtaaaaaaatattttaatgaaaattcacctgtacataaatatttataataaaaattcacacacattatataaggtgtgcatattatctttgtgctttatacatcggctctggcttacaacattgatggagtctttgtgctttatacatcggctctgtcttacaacattggtggatcacttgttttgaattggcactgtggccgagatcaagaacttatcttgccttaagagcagtacaatagcagactataagacagctataaacatatttcgagaatataaaacaggagagagaagagtagcgggctacaaatttatagccagctgcggcacagacttcaagatgcaaatgtaaatgacaggtgggaccaactatgacttgtgtagtatatatttataggtaactattatataaatcagcattaaattgactatagataatttggagcccgtaattggctatactattaaacttgctctaaccctccaccagttcactgatcccttggaaagtcactgaacgtcgtaccttctttcatcttctcaagaagacacaaggtaatgatcaatgacgtttttagtgacgtagtgtgcacaaaggtcaatgagatgagaccacaaagaaattatcaaccagtgcataagagcagttaaagattttcaagacgtactcagtccacatctccatgttgaccgtggaagattatcagaaaagctctcatgcgagcacacatttccttttcgtttaacccggacatcatcttaggaaaatacaatttaatttatctgcgacgttttaggcaatggccagtctagacaaaaacgaacattgccataataaaactcataattaaagtactcttaggatcctaccagaccagacctcaggtatgatctccaaatatgactttcattatgttgggcgtggtttctattgtttttcttttcatatatccctgatttgggaaagattgttgtgcatgcacttgtcagatatgttttcattcagtaacatacagtaatcaacatttatagaaaaaattagtatcatctacaacaccaaaatgtcttgttaatctaacattgaatatatttgttttgtgttaaaaatgtaactatgttttctataaatttgattgaactttaactgataaaaaaatcaaagcatcttacataagtaaagaaacggagggggtagtttgtcaaccccatgacaactgctacttagaccaaacgggcaactagcaagatactccgactgccctgaacatagctcctaactcactctatatgtacagtgacatttgctcgatacatgaaacttgaaatatttactctattattatttcgttacatcatgcatgtgctactaacaaacagactgactatgaaataaacaatgtgtacatacaaaatccagatccttggggaaaatcagaaaggagttgatctctgagagagccagtcatggatggcaaaacgaagggcgtggttgggggtgattggagggccattgtccatcaactcggaaatggcgcgcccttcgtacgtcaacccgtccgcccccacctggggatcatgcatcacttcctgcacaaattagaatgaaaaaaaaaacacattactaccgcattattattagtagatattttgggttacttatgggcttctgccctatcgatgttcttaggtttcgttcttgccttgaggatcgggcacaggaagaaggagggcacttgtctattatccctcatcaggtggagctgttccagatctcgcacagtttctggagtcagcagctctggacttgctgcctcactgcacttgagccccaactctgctaaccttcgagccacctccagaggccactctccagctgttggatctaacaatgaccatagctttccactggacattgcacgccttacttcgctgggaaggcctgcagcctgcttcccagttagtaactggagtatcacaatcccaaaggagtatatgtcagatttgggtgtcaatggtttgcttctccggtattccgggtctgcgtccttggcatcttccatgaataattgagaaataccacaatcagctatcttgcagtgcaggttggcatctaaaaggatgttttcaagcttcaagtcaccgtggacaatcatctgaggtttacaggaatgcaagaagaatagagcacttgagatttcagcaacaatacgtgcacggattttccatggcaactgaggaatgccgcacttgctccaaaggcggtcgtgaaggctcccgtttggcacgtattcatagacaagacacaatgcatccgggcatgccccaatcaaagtcaccaggtgagggtgcctcaccttgctaatgaggtggacctgccaaaaacaatgtgaaataactaccttctgctaaataactgctattgctatatgctcctaggtttttataaacacttagcacgataagttatgtgataaacaagacaagcaagcatatacttggaatgattggcccacatcatctcctgcttggtcatagtgcaaagagataatttttggtttttattatgacaaatgacacaacaagtaatctatctagataaatagaagaaaaaaaacaaatcctacataattcaacaagccccatagagtttcaagtgatatgtggagctgcaaaataacttttagcagtttcattgagctatgtatcactaatatatcaaccagcatgataaacagggtaacagagagtacctcttgctggaactgcatcgaactctgaatgatacacgagtgcaacttataaatcattacacttctgttcataatctctcctttataaacacatccaagacctcgtggcagtacttttaagctgtctgagaacttgcatgttgcagctttaatatctgacaaagtcaattctctaaagttgtacaagtcatcagcacaaacagttgaactgcaatttggtaacataatgtggttatatgcacacctttcaacctggtcagtatgtacaagttctagcttctctcttttggaaatttcctgattgagtgttcctatggaagattgaatcaatttcagctctgccacagcttcattcatccgaaaagctatgcttttagcacgtgcatctaggatggctagttttctcatcgaagagtccaacccttctgtagccttttctttattttctgcaagatcttcatgctgcttttttgtggctgtcaacaaagcttcaagttcctcccgcattttcatttcttgtttttgagcgaactcagaagcttttgcctgctcaagaagcacaagccagatcaacaaaggaatgcatatgtaattttcaccacattattcaaaatcaatgttaaagaatctaaaacttccgtttggtttcccaataatgttatactgcagaggaaccgtgcagtttaaaatacaagataggataagtggtttgcataccctggcaataacaccggctactcttgactctgtatctttgcgcttgagaagctcaacaaaagcatccttccttgatctctctgcttctagaatgacctgcttgaaatttttatccaagatttcctgacagataataccatcagtatttaaattgaaaaaaaggatcatcctttaattacaaaattatcaatgaacatgtcaatgtagcaggagagcacctgaggatataacactaatgattccatgtctacagaagaaccaggctggaatgttgagttaaatgcagactgtgcattttgcaaatttggtacaataatattgcagaaatggttggcatcaacaagagattcataatcattcggttgaccattatctgaaatggtgatttcataacgatcagcaggtgtttgtgcctcgtatgaaatgtatccttcatcaagtatggattcagcattgttactagtagagctgaacctgattcttttcctgatcataacatcatcttcattgtaaactgagatattgttgccaatggctgcagctgcttctctggtccaaatgtgtcttcctctccaaacaaaccagatttcacaaaatgatggggcattccttgccataaaagatgctttgccatagctcgctttcaacttgaagcaactgcattacaggtagagagagttcaaattttcagggacacccaccccgaaataaaacaaaagaaagggaatatagtggtcactatgggatgtcaatatcctagtacatatcataggatcccacaaacactacggaaccatctgcatacatatcattacagttagatgatctatttcttgggatcattataaccatacattccgaacaaaattgtaagattacgttagatgatactcatatcaacaagttgatgtgacatgtaattgacaatgggtttaattgtattcaagtttgctcactttttactgaaattatgtggattcatgaggcatggttaaacaaataatgatggatctaggtgagtgagcacgggaatacttgacataaggtggttgaggacagggttttcaattttgatttcatccgaaatttcgctcattttggttctaccgaaattcctgaaaatcaggatttttggcactttttggaccgatttttttttaaattttagcataatttaactgaatttgattaaattttgaccaaattcacagaaatttgagaaaaacaaaaaaaaaacggccgatataatcacttgccgcgtgggggggggtccggaattaccaaaatttcgatccgaaattgcaatcctaggtgaggagcatgtggtgcattgtccagttgatgttggttgcaagattttggtgctacatcaagttggggcagacaatgttaacatcaagttgggagatcaaagtttcaaaaccatcgaggtgctgttggaagatgccagtgctggaaattgttactaagaatggttacgagcaatgaagggtgtagaatacacacaaaaaatatctagtctatcgagcacctgagatcaagtttttttgtttcttgttttccttcatgctccataagttgataaagagagtattagattaatttgagttattagtattatttccaatttctgttatgttcttgggctgaacttttctagcttgaagtagatacttggggactagactacctagttttccaatactgatagctgctttgttcagtattgaaattttgatgaagaatacacatgacaaccacaagaacagcaagttagaacgggtattagtaacaacgtaattggacccagaggcggattcacctcccgggcagcaggggcggatgcccaggcttcacagcgatgaacccatattatctagcgctaatccttggctgaaacagattaattcctgggaaagatttgcatgttattaattaaatacggcaagccatgctgcaggaggcgattgggccttgggcctcagctgcctatggcctgcctgcccccacaagtactagactcactgtcgttatcaaatcacacggacatttacttgtattgaacatgtccatgtagacacaatataggtgtattagtgggtacgtttctctgaatatgaatagtatttgttattttcttccatgttccattgatattgataaaagcttttacctagtaaatttatatttcagcgtattagtgaatcatcgaattaagcttggacgttctcgtcgtagtatcctttcatccataaacatatttacaagtattttgggtcacatttctataaaaaaaaatggtagaaaattttaatggtgatatatggaaaatgaacatgttttgagtgtaatagtttcagttagacccgccttggcttcacaaaactcttggcgccgccactgattggaccatcagctaggggccaaagatgaaacttcaaatcatggtagtaggacctgctgttagccatatgcccgtgaccattaataaagaatgcataacatgacagcatgtggggactgaaaacggctggtttgaagcaggtttgtaagaacaggatacacgaattttagcagcgatatatttgaactaacagtagaattccttgtgtagaacagagagtttgaattgttttatagagatggcactatcaagaagggtgttttgttagcacgcaattgatgaaaattgaagtagtacatacgtatcaggtgtagaacccatgacaagctttgtaatcccatgatctttgaccaaagtgataataccatcatggatttgttcattctccgtgacaagaagacttgcctgaacctgtggcagagcaaaagcccgattaattagcgtcgcacacccataaaaattgaatctgtgatgtttctcctagataaaaaaaaggttggagaagaaggtgagtagcacttacctgtgccctgtgacagaaagtgaggtaggtgaggaggatcttgttcatttcgtccttctcggatttgcgatgcgacagcacgagctcttcggtggcttgagcggcaggaatcttgcctactgaagaagaagaagaagaagaagaagaagaagaagaagaagatgtgatgggtgagccgtgagcggcggagaaggaagaatcgagaaattaactcataaataaataaatactccaagaaagaaagaaagaaagaaggaattgaaacactagaatcgtacagagggtagggatgagcggagaaggttggtggacgtgcacgaggacgacttgggcgcaggcgaagcggcggaaggcccatcgcagcaggcccaacgtcttctccggcgacctcccgacggcgacatggacccgcgcgtcgacgttgtcgcggcgggggaaatgccagccggcacctctgtggatgaaggaatccatggcggagccggaggcggaggcggaggcggaggcggggccggggctgggcggcggcgacgggctaagtatctccatggatggatggatcgattggctgggcaatttgggtcaattttctcggtggggattgcaattgctaatgggagctttcctcctcaattaattgcagcatgtcaaagacttgcgcgccggcaaggcacgcaaatggcataaacacatggatattccacagcatccacagtgcttgccgttgactagttcatggtcaactcctgctctttcctctccactctgacacgactctcagattcagatgagtcatttcttcctctattttccctttttaatcccgatcgatcttttttttctttatgcgacgctatgcaaagttgcaaacccaaccccaacccaaccaatctactggtggagtaaagttctccctaaatttaacatctacacacgaaatagaaaactatgatcgattttaaaaaagatctgaattgccaacacgagaccgatctgaccgtcgccatagggctggtctaatcagcagcatgtggctggtcaaaccgactgactccaactctaaatctaattttaaccagtctcaggttttcttatttgggttaagtttttcgaattctaattgatttctatccgagtaatccatgaaagggttttatagaagacaagatcaacctctttataagattcatgactggttcaattgaggcaacaatagacttcaacacaattaaccaattgaatcgctcttttgatttcgcatctactttttgtctagtttttagctagtttgttcatcttcatcagtttgtgctataagccgtgcgtactcgttgcgagaacgcgaatgttcatcaaactagctcagtgccacttgtattttgtaaaatttagactggccattatatacggctaggatgttcttggactagtatctttttgcatactatatagcttaaagaggcatagttctgccaaaagtaaaccttatcttcctcttcccccgccccctacccaaatgcccctagcccttatcttcatctgtccatctacttgcaacacaatcactttcatcagaggcaatcttgcaagtgaagaaggaaaaggaaactttgctaatctttggcacgatggagtagagcctggagaggcatagctccgccaccaggttcttggacaacatctcctccaccctcttctgcttccatggcgtcatcattgtccaacgctgaacctaaaacctaaacccactgtcgctgccctccaccagcctagttccactttgcacactccaagcccgtcctccacttccgacgagaaaaggtcccccatgacaacctgttcagatgcacacaacccaatgttggtatcttcaaggcggtgagacccctccccctctagccacctagtcctccacgatgccatgtttcctcaggcatatggaaaaggagagaccacgagagaggtaacgagagaaagaaagaggtaggggatgatgtgtggggcccaaatgtcagtgaggtgggagagaagagatgtagaatgggtattttgggcaatttgaaatacaatagcttgcatttggatacaatggtgtccagggtgtagaaaatgatatatgtatgtaagagagaattgtaatggtatgatccaaataagtgatagtaatgttccaaataggtgaatagtaatggtagatctttaaattgtggaattcgtagtggcaccgattaaattaaccatagataatacttgggagaagtttagtggcaaggaataatctccttagagaagatgccaaattagaatccttccttagagaagcatgtaaaattggaatccggatccagaggttacccatcaactcatcaccgatcatacagaacttgatcgaattaatgtttgatggcgacaattcaatctccttggtggtggaaagagaaaagtacatatacttaaaattattcacttctcaactatca

SEQ ID NO: 36591 - DNA, 43619 bp, Oryza sativa
taaaagcttagttgggcataaatgacgaaggaaatataaacgtataaataacaacatgaaactataaataactttgccgggaatgataattcaatatcaggaaaattatataacttaatcatattttcaaatttagctataaataatttaatatagagaaaactatatgttacaataatttttagtggatcaaatagtgctaaatctaataatataaatgaaaaaaacaacttaaattagttagaaattgaaaaaaaacttattttagcccacgtatgaaaatctgattcattaattctgaacgggtgcttctttcattgatataaaatagaatttttcatgttctattcatactccatttgtcttaatatgatgtgagtggtccaggagcatggttgggtagactaagaaggaataatgcccaacagacgttgttcattgttttccctagctcaaggcgagaaacaaaagaggagggaaggtgagcgtcggtgctccggcgaccaaacgacagtaaggaaagtggtagtacgtatcccacgatgtgactcgttcataaatggtggaggttggcaatgaaaaaaccggaacaagagggatgtaggggggcaacgaggtagtcccgtgatagattgagaaatgacaatgatgagctctagtggtgaacacgaccaggtgagtgtgtcaaaactcgttcctaaacgagaggattatgttttccttgaacaagcaggagaaaccgactaatattatctatcgtcttccctaaccaacacaataaacaaaagagaaagggagatggacgacggtgctccagtgatcaaacagtggtgagtaaggtggtcgagtgtgtttgacaatatgactcatccatagatggtggcggttggcaacgaagaaaaccagaacaatgggaatgaggtcgacaacaacatggtcctgatagagagaaacaacaacggtgatctcttgtggtaaacatgaccgagtgagtacttcaaaacgtgctcccgaacgaggaggttctgtttttcttaaatgcgtaagagatagggaatgcaggagagaggagggacaccagggagaagagatgtcgagggggagggggagcatgtgtagcgaggaaaagatgtgggggtgtgccgggagggaaggagggaggcgggagaggaggggcaacgccaggaaaagagggtctgcgggggagagggagagatgggggcgccaagagggagggagagaggcggaaggaggaggggcaagggagggaggggggagcggacggatttgggggagggggagagatgggggcgccgggtgggaggagggggggcaagggagggaggggggagcggacgaatttgggggagggggagagatgggggtgccgggtgggaggaggggggcgacggaaggaaaaaaaggcggaagccttaagtattttttaattaggtatagataggccagattttggcatacatacatacatacatacatacatacatacatacatacacacatatatatatatatatatatatatatatatatatatttgaaaaccaggaaatattattagtagaaacatagaacatgagttattttacaattgatagaagagagagtctagtagggtaagcaatatgagaaatattttgacagctaataacaggatttgacagaagacttgttctagatttccatgccacctgaagcaaattttcaggaatgtctctttgaatttggctccataaaggtctgaggcttcaatggcctggttcattgctgaagtctattttcttgatcgtatccgctattactgaattatcagttaaaaaactagtacctgcaaagttgaagaatttggcaatctccatagcaagttgcaatgctgccaattctgccagcaaagaagattgagccacctcacttgtggctttaataaaaagagcatttgtgtgttgtcggcatgtggaagaaaataccaatctttgtgaattgattctcccaagctgcatctatataatatttattgccctccggaatagtctccattcttcttttatatacctcctcctgaggctccacctgcaaattatgatttatagagaaaagagtatatatgaatttatcatagcttctgccgcaaaacacacttgggtcggctcctttaagatgccctgaaatttcagatcattcttggccttccaaagctgccacacaagataatcaaagatttatggagatcaattttattagaaccatttgaggaaatgtaagcaatgatgtgagccagggaaacattatcagagaaaatgtcagtactcagtagaaagatttgcttcagaaattctccaggttagtctgctaaagaaacaaccaaagaaaagatggaaatctgtctcaggttggttgcaactacagcaattggctgaaatatcagaaattctgtgatttaacctttgcgctgaaggcagagcttctccaagcaaaaactttgaccttgggaggagtttggtaaggcatgtttatttcccaaacaaaaatttttatgctttaacatcgaatgtttggacacatgtgtggagtattaaatgtaggaaaaaaaccaattacacagattgcgtgtaaattgtgagacaaatcttttaatcctaattgtgccatgatttaataatatggtgctacagtaaatatttgctaatgacagattaattaggcttaataaatttgtctcgtagtttcctggcgaaatatgtaattaatgtaatttattttgttattagactacatttaatacttcaaatgtgtatccgtatatctgatttgacaaccaaatctaaaatttttccccggctaaacaaggcctaattgagttgtgcctaaaccctaggctacagcgaaaccagcccgtactaattgtttgggcagcagacgtacacgttgttccgtttgaatttaactacgacgaagataaagctagggtacgcaaaatgataaaattattaacatgtgattaattgatttttaatcattacaaatttaaaaaaatagatttatttgatattttaaattaatgtttgaaaaacacgctaatggaaatcgaggaaaaaatccgtatcttttagctacaaaagaacaccaccgggttagagcaagtttaatagtataaccaactgctagcttcaaatcatctatagccaatgtaatagccaattcatacaactaggaaagtagcccgcgcgaatgcgcgggcatgcgtcgtacactatgtttgagacacttataagagtgaaatattaactggagaacatatgccacaatttttctattgttttcattggcattaattgtttttataattttataacctattagctttatattacatcttatttaagcgatatttataagcaactatttataatcttcttcatcatttgaaaagaaggtagactaattttctttagaaaacatgtcaccgaaagtaaaagtaaggtaaagtaaaagtaaggtttttttctaaatgcatatatattatcatgatttattagaggatgaattgggtgggacatgaagctccactaaattctatatagcctaatatgattgatgtagtttgagaggctgtccatccataaatattttatgtacagtgggtaagaggttatacgcaacctaacatgaatacaataatgataagatatttatatattttgtttaatatttttaataaaatgaatggtcaaacattattaaaaaaagaaggaagtaatatatttttatctttctcttacatggaatatcctaattccatatttcttttgcaatcatacttgggaaaatatgtagtgatgtggacaaatctcatgcgttcatttttgatccaatggtgattttcaggtttccactacgtatgttgtttgtactgtatattttttccatcatactatacgtaggtaagtttgttttgggttttgggctataacgtttttcccccgtgaactgtatgtacgtggtgtactttacgtacatacttattttctatcatacattttcccggtgaactttacgaaagcatgcattttttttctgcatacgtggatggagattagggagtagagatcacttttttagtttttttaagtatgataatataatggtctaaaatattgggtccatcaacgtaagtaaaaataaatatctataattttctctaattaattagagtgtcatgttgtgatgtaggaatgtttgcagagtaccacgtgatggatacgtagcgtttgtaaaaagtttaataaacttttagtatataatagatacatggattataatatgttagttatctaatgtttgattttaattaatattaaactttgctaggtagaaaattaaaagatgaaagtatatataacagatgataggagatagatggagggactgacgtaccaatgttacttaggtgatgatggagtgagggtgcctaggaggtggtggggtaggggtgggatgggatttatggatgggttgttggattttgtttaaagatggatctaatggtgaaaaataatagatccactgtattaattaaaaatttaaggtcggatgttttctttttttcttggaatttctttgatttctctaatttattaaagtgtcgagtgacgatttaggagtgtttgtagtgcatacgtattttctatcgtacgttttccatgtgaactttacgaacatacatattttatctcttacgcggctggggattaggaaggatatattacttttttattttttaaagtatgataatctaatggtctaaaatattgggtcggtcaatttaactaaaaataaatacatttttcttagaatatctatgattttctctaattcattggtgtgtcatgtagtgatataggtgcgtttatggaataccgcgtgacggattggtggcgtttgtagaaggtttaataaacttttaatttataatagatagatagattataagctgttagttatttaatgtttgattttatttaatcttaaacttataatataatatgttagttatataatgtttgattttatttaatcttaaattttgctgggtagaaacaaaaagatggaaagagtaatcgatgataggagataggagacagagggagggacggacgcacgaatgttaagtaggtgatgacggggagaggatgccaaggaggtggtgggttaggggtgggattggatttatggatgggttgatagatctaatgatgaaaatttcttcgacttctctatttagtagaacatttgtaaaaagtataatggatttttttatataatagatttaaaaaatacaacaggatcacaaattagatactctctctatcccataatataaatcgtggtgaaagttggcatggtcatcaaaactaagttttagcttataatttttcatatactataaggttaatagtaacaaaattataaccatatgaaagtaattttaaatttcaatctaatgatatatttttaacaaataaaatttattttatattatacaaagtgttagtcttaaaatatgtgcgcgccttatattgtgggatagtgggagtatattttcttttacaaaattaaaagatggtttaaagaatgttgattggatattttaaatttttttattatatatcttaattttactacatatttatatttgtgaagtaatatattttatttttatattataaaaaataaaatggaccgttaatttttttcctccgggcagcagaaggaaagcttcgttttaaacagtaatgtacgtactcaaatttttgtttccaatcatacgtacgtacctacgtaggggacagcagtcatgtttgtatcatatatacggtcggaggaagttattattttttaataataaatttaatctaatggtgtaaaataatgggtccacaaattaagcgaaaatcaacggtacggttaggacgggtccaccaatttaagtgaaaatcaacggtgagattagatagtgccatgtgacggcttaagaacgtttataggagtgacacatggcagcgttagagcgtttgtaagaagtttaatggacttttagtatataatagaagatagatagatatagttgcttactgtattattaatatctagtcctacctatcatatgcacattatgttttggagctggctataaatttgtagcctgttgctgctctatctctttctttatttttttaaaatatgtttatagctggcttatagtttttattgtacctgtatgtaaagatgctcaagcacgagctgcagcgcaggtggtctgtgagaagtagcagcagatgaggagcgggccctacgttatctcggagcgtggacacgactacgccacgtcggatagcacatcatgatcggcagctaacccaacgtagccgcaggctggagctgtgttggaaagggagagtgatgaatccatgaacgaaccattagcagctagctaggtcgcgggctgagggctgactaatcatggagcaagcagcgaaggccaccatctcactgtcgccgccgagttacgctggatgttgcatggcagcatgtccctaccgatcaacgcggcacctgcgcagaggaggcggctgctctgctcgctccatctcctccctccggcatgccccttctgctcgtgtttacgccgcagccgcagccgcagccacgccggagtccaagtcgacgaaagagaatgacctcgtcttcatcgcgggagccaccggaaaggtgggatcccgagctgtaaggtacacctcctcctcctcgatccgttcgtcctccaggccggctagccagtcatccctcgatcgatctgtccctggaaaaatatactccagtatgttaattactgcagagacacgtacgcttgtatgcgcttgcagggagttcatcaagcttggcttccgtgtccgcgccggcgttagaagtgcacagagagcatcgtcccttgtgcaggtaacaataatccatgaatcttgctaccagctacacctatgtaaatgttggagtacagtacttttcatttatacatcttgaccatacatacgatcgacatttcaatttcagagtgttgagcaactgaaagtcgatgacgatgcaacttcgcgtgagtcgtcggcatagatatattaattcgagtttccggttaactgtttgtgtctgaactggatcaataatctctagaccagccgcagaaaggctcgagatcgtagaatgcgacctggagaagcaggcgcagtcagacatcgtgtcggccattggcaacgcggcgattgtggtgtgctccatcggcgccagcgagaaggacatcctggatgtaacgggcccctaccgtatcgactacatggccaccaacaacctcgtgcaggctggtatgtatatataatatactctagctagcttaattagctttaatttgttcatcattaatattactctataagcagaaacaattaataattgaaactcattaactacgtacatcattgacgtacgtgcgccagcaactgctgcaaaggttgagcacttcatcctggttacatccctgggcacaaacaggattggcttccctgcttttcttctcaagtaagctagatcgatgtgtaattaattaatttccttgttcgatataattattggccctgttttagtttgaggaagaaaaaaagagatcgatatgtatgcatatatatgtagacagcccagccctttaggacgtacaaaaacgaaatgaaatttatgatgcatatgcacgcatggttacagcttgttttggggggttctgtgctggaaaaggcgagctgaagaagcgctcatcggcagcggccttccttacacggtacgctttctttaagataataaaaatggtttgcatcttcagcttctaccaatgagtttaggtgtattgtcaggtatatatacactatatatatgcaattaattaatgggttaattagatccatgctattaaaaatatgctgattttgaaatataccattagtattcaagtattttgaaccatgccattataattttatacatatttgatatatgccactatttatcacttagatgcatttaaaaaaaaattggacaaaattgcccttcttcttccttcctccacttcttctcccttcttcctgttcgacggcagcggtggagcggcccggcggcaagtggcggcggcaggagcggcggtgcggcgggcggcggcgagcggtggcggcgacggcagcagcaggcagcggcgcgacgacaagcggcctcttcaccgtcaatcttgccggcctcttgaaaccagccacgcaccatgacagtgtcaccatccccggcgttcaactgctcccaattccccacctcacacactgctgaaagacgcggcggcggatggacttggggtcgtcgtcccaggggtagtcgtgttcgagctggaggatggacttggcggagcggcccggcggcaagcggcggcagcagcaaggagcggcggtgatgacagcagcagcgagcagcggcgcggcggcgagtggccgcagcagcagcggcggagcaagaagcaacaagaagagggggtagaagatgagggtaatttcgtccaataaatacaaaatacgtatcttaatggcatcgttacaaatatgtaaatattaatggtatattttaaaaccagtaaaattttaatagcatagatctaattaattactatataatttctcatcagatcgtccgacctggtggcatggagaggccaacggacgctttcaaggagacgcacaacctggtggtggcagttgaggacacctacgtcggtggactcgtttccaaccttcaggtggcggagctcatcgcgtgcatcgccagcaacaggagaacggcctactgcaaggtggtcgaagcgatcgcagagaccaccgcgccattgctgcccacggaggatcagctcgccaacataccttcaaagcgggtatacccatgcctattattagcatttaatttctccatttcatattataatttgatatttttcacagtcaatattttttattttaagctcaatcaactttattagaaaaatatagcaacattttcgataaaaaatcatatattatcggaatataatttaatgttagtttcgacgaaactaaggctgcattttttcgcttagatttgagagagatttttcaatgcacgcaaaacgagaaagattattagtatatgattaattaagtaaataattataaacttgaaaaatagatttatttaatttttttaaacaacttttgtatataatttttttttgcaaaaaaacaccattgaacagtttgaaaaatgtgctaacaaaaaaaataagcaagttaaagtttggagttgatgaaaataataatcctaagttgatgttgctatttttttaaaaaaaaatttagttaactcaagtaagtttaacttaaaaaaattaaaccgacttataatatttttattatatacatatgaaataatgtgttaaattgatggcatatgtatacccatatgtgcagcaacctccgcccgaacctgaggtagttcagcagggagagacccctccaaaaccgatccagcaaagccaacgaccactctcaccctacacggcgtaagtataacgtgcacctacatatacagtacattctactccctaaattaatcctattttttctataaaaaaactagtgtagaaactttttcccttttagagatggttgccaagagcatgctcataatcaggactgaaacaaaatatctatctatctatctatctatctatctattatctattatctatcttctattatataagtccattaactttctacaaatgctcctaaatcgccacgtgacactttaaaatttaaaaaaattctttaaaattctgaaaaaaaaacatctaaccattgatttttattaaatctggtggacccattatttataaccattagatttatctttgagaaaaaaaacatctcctaacccgggtccacctggcatgtaggtacgtacattcctgtacgtacgtctccccatgttccctcaaatccttggttcctcctcttttttatcacaaaatataacctgagaagttaggcttaaccagtgacacatgtgtgagggaagtactactatacatgcatggcttttttgctattagacatgcatgtcttttttctctcttcttataaagttttctcacaaattacttgtccgatcaacaattagattacaccatcgtattcgttgcaattaaatctttacatcaaagatcttacacgattatattacgatgaaaaaatatttatgtttgtaaattaattttattatatacgtaagttacttttatcatatatataaattacttttagatttgactaaattacttcttatacattcataatactctaaattgattatttttattattgttttaagttaatttaataatttatggactttaaatttaatttttacatagaccatatttttctctctacagcaaatttacttctaatgttgtaacaacttattttcattttgtgctaagttatttttatgattgatgtaaattacttttagactttattaaatttatttttagactttattaaatttactttcataaatgcatttacttaaaaatattctctacgctttacttgtgaatttactctacttactgtttcatttcaactcagtcacaaatgtaattacttctactacaaaaagttactcctgttagatagctaagttatttctacaatttcaatgaattgcttttaaattaataaattgtttgaatatattcaacgtgcatcttgttttctcacatgttttatatagagtacaatgatgcaaatagatcttgaaaacaatatgtgatttaaaatatataagttattaaagaggttaaatctaaaagtaatttatatatatgataaacgtaacctacatatatattaaaattaatttacaatatagatatttttttcagaatataatcatgtaaaatcttattgtaaagatttaattataacaacacaacggtataatcgaattatggatcggataagtaatttgagagaaaattctataagaagaaaaagaaaagcatgcactattgagtctagtagtagcaactaaagtgaggtcgcagaatattatgcctaactagcgatggttttgtcatagtcacgtcccttttttttatctaatcattctcttatttttatgccttactctctccgtttcaggttataagatgttttgactttggtcaaaattaaactgcttcaaatttgacaaagtttatagacaaatatagtaatatttacattaccaaattagttttcttaaattaataattaaatatattttataataactttatcttggttcgaaaatattactattcttttctataaatttgattaaacttaaagcagtttgactttgactaaagtcaaaacatcttataagttgaaatgtagggagtattagttagaaaaccaaaaattttgcgattttgctaaatatttatttacagatttttttttggctaaaaatcactcggtattttttaccgtccgattcattgatgatttctgtgcttcgttattagccgcacagtttctttgcgtgtcctctttccttttccctgtgttgtatgcacatatttattcgttcactacccgtgattggttggctatcgtttgagagatagaagatgcatattctctatttactagctgctatatgactatgcgaatggcttctgctgttcttttgtgagactagcatactacttttatatatatatatatatatatatatatatatatatatatatatatatatatatatatatatatatatataaatacatatcagttacactataattatattatatttctaccttagttgcatttgtatgattttagtggaaaaatctgtcgagcgatacatagatagaccaaaaattttgtgttaaataattgagcaactataacatataaatcataaaactaatttttatctacttacatctttaaattatttatgaataaatttagacttgaagaccaaacttcactataattcaactttgaatgtcattttgggttatactttttgatttttgagtgccatcaagcaattattaaaaaaataaaatataataataataacaatatagatttcattatcgtaaacaacttcataatagtcaaattagatctataatcattaaagtaaaatgataactatgagtaatgttcccaaagtatattagttagaaatcataagttatggctggaaataagcaactataacatctaaaccatacaactgatattttatatcatctaaatcatacatataatatttgatccacttatgtctttagattattttacgttcaaagactcatatccagtgtaatttaactttgaaaagaattatgtcactttcgggaggtgtattttctgaattctgtgtgccattcaaacaatttaaaattataaaaagatagtgatttagattttatcatcctacataactttataattattaaattagacctatagtgataaaatttgaattaacctaactctgagtaataatgaaaaattactcccaaattctaacattataataagtcaaaataatattattagatttgtagtgttcatattttgaatatctactatgaatatgaatataccataagaatagatgagtaaaaacttttattctatttttatttaataaagtaatagcaactaagatactattacccgtgaaaaaaatataattatctgcaagcgtacattctccccttcggctctctcttcctctcctctctcattcaattcctccgtgttctaatttttaactaattaataaaagctatcaatatttagaaagaaaaatgattataattcttaagtgatatcctatttttattttgtgaattattgttttatttatagttaagtaaataatttaagatccacattaccacttatttctgcataaaataaaaacacgtcatttgaacatagacacctatgcttttgcatggtaaccaaatagcaaaaagaacataacattatcacaagtacatgctctgtagcgcacttaaaatgtcacgtttccgtcttaaacaaaaataaaatcatagatattgtaaagaaaaaatcatctgccttgtgttatgtcttaaaaattaaaaaaaagatattagaaatgtgagaaaaaagttggatcatcggttttcacttaatatcatttagagaaaaaaaccacccctccgcttcagcctcccccacacatggacacaatacaatactacatgtctcctccctgtccttttatagtttgcaataataaaaaatattaaaatatgcataatttttaagatactcatatgatttctaatctaactattgttgtattcacaattaaaccaacgatatgaagatccataacgcctaaattttgaactggtataaaataaaataggaaacaaaaaatgtcaataaggactaaattgaactatttggagaaaatttaataagttcgtaaaagcatttgtgcttaatttttactaaaattggaccaaccattgcatgtcccatttttataacaatttgtaaatgcttagtttctcgatatactattgcatatataagccacgctaaggttgttgtatatagtttgttgaaaagttatatttcttactattaaatttaattttttggattcatgttaacaaggtattttctttgaaaaagagaaagtatataccgcaaatatcacaaggaaggaggtatacgacatctctttgttaatttatatgcatgtatgtaacaacttgtgtcaatctgaaccaactaagtaggactagcttacaaataatacacattattaacaataatagttctttagggttttaaaaaaagcccctatgaatttaattaaacaagataaaacaccttagttttaagtgcatttacacttagtttgttagacacgtttatcaaatgttatatattttaaatgctaacaaatagtttggaaaaattatctaagcaataccaatgaagaaaattcatagagaaataatacttttgaaatatggcatcttacaatgggttgatattccgcctatataaatttttcaaacacaatcaataatatacatgtccgcacgaatgcacgggctatcttcctagttgcaattaatagttaaaaaaatgttttttacaaaacatatttagggtgaaacattgtctgacttttaatataattttgattgaaccattattatgaatgtttgcatgcgggtgattttttttcttgaaatattctttgattctactctaaacctgtttctgtcaataatttatttgggattgttttcatagtggttatgattttcttctaattacccttctaacatataaattgtaaagtagaaatacttgaaatcgtacagtcctgaatttatgagaatttattgtagtggaataatggagtttctaaactttaaatactatttgttttttttgtatatatagtattttctctgttttttaatatataacaccattgattttttagactattcatcttattaaacacaattaactaatgctatgagagagtatatgtatgaagagtgccgccatttatagatggatttgttcggtttgtttggtttgtttgcacatatgtggattaatttagttttgaatatttgtaaagttgtatatttgatttcataatatatacgaagatttttagaaatttctaaggttgtttggatcacgtgtaaatgatgtaaatgaggtagatatttgaactaatgacataattgtaagcacatattattttacatgtaagaacatataattggatcatgccactacaaatatgccattttagataaataccattactattcacaatatcggctcatggcactgaaacatggggaaattggaatagtgccactccatcatgttttccgtcaaaaatttccgttagccctaactgcacattggacctagctagctgtcagttccatcttcccctcactcccctctcttctctttcccccttcctctctcttcaccaccgtcgtcgaccaccactgtcgcaaccaccatcatcgactacctctgctgtgggaggcctcgggagccgccacaaccaccaccacggtccttgatgccatccgcgacaggaggcttgggagcagccatcctcgaccccatccatgcaggagggctcgggagctgccaccgccatcatcgtcgttgtcctcgtagtagttgcggggatgcatggaggaagagatagggaagaaagaagagggaggatggtggaagatggaagtgatatgtgctccccacgtctaggggtctgacggaaaacatgatggagtggcactgttccaattttccccaatttcactggcatgtagccgatatcgtgaatagtagtgtcatttatctaaaataacatatttgtagcggcatgatccaattaaccctagtcaatatatggatgtaaaaactattaatttaattgtgaagctagactacaaccattcaaatggatcttatcaaggtgtttaaaagtgtgcatacaaattatattagccgttttttgacttgaagtccagcaaaggaaaaacaggctaagtgccctagctagattacttaacattttctatcatcaatcataccatcaaccctcttatggcctctaaatataggattaggcttattggtttcaagttttaagttaaagttttagcttatatatgatttataattagtggatttaaagttctaagtttaacggtggagtcatacatctgtcttacataagctaaaaaaagtttctccaaccaagcttttgatttaatagtataagtttggcttatggctttaaaaaaaccaaaataattgcttgtttgtttaggtttaaactttttggctcataataaattggcttataaatctaaacaataggcccttagctaggaccaagcatccattgagtttatagattttgattgcacatgtgatctctgttcacaccaagtcgatgagatgcacggatgcatgcaagcgcctcaaacatttatgccataatttttatggaaggatatgtttaacctataactcatcaatagagataatctatgctctaattggttcacacgatgctaccatttgcacatataccgagcaagacatctaccccttccagtccacattttggacaatgatatgatatctaaaatatataatatatacaataaattattttttctctttttattatagttcgctgtaagataaatctatatatatattgttctaataactctaaattaaatattatttgagttattgatagtaaaagatatgaaagttacctaacctttttcaaaatttcagagggagtaaaatgctaaattaaattatttactataaatttgtcatagtagcttgtgattataaatgcctcacacagtcacatgattgcaatgaatactgaattaagcattgattacaatttacaagtttggtagtttcttcacacttctttccctaataattcctaccgtttcttatttttcttctctaattgtaagatcatttatggatttttggtgtgcatatgtacgcatatagatcattcacaactgtgtggctatctaactagcataaaaaacgatgcatgatttgcttggagagagttgggcatgtacgggaggcagtcaggaggcggtacgtacagactcatacatatataatatactaggtgaaacccagcgcattgctgcgggaatttagtataataacaataaaaaaaataatatgtaaaatagctagataatattagattaagtaaattaatgtggtttatgataatttaaatttaaatagtatgtagaatggtgattcaaacgtaaaaagtaaggtagaatgactttatggaagaagaaaaataggaagatagtttggaccgtagattaatcatctaaagactaaaaacaattgatataatatgacttaattagagggaaaaaggagaaagataatttgtaccatagattaatcatttaagcactaacaagtaaggatgaactatataagtatataggatatcataaaacataataaagatatactttgaaacattatgtgaattatgttggatgataatttaacatgtttgtatttgaaaagctcttaaattataaaaactataaagatatagcatgtttacatgatgtttaaatgtgatgattgttagtggatgatgatgtgacatcttgttaattagtggactagtggatgatatgcgatatctttgcatgttaagcttaaggagttagtggaggataacttagtaagataggatacctacaggaggcagggtttaaggaatttattttttaagattgatctaatggttgatactaatgggtccaccgatttaaatgaaaatcaatggttagattctttagttgccacatgacagtttgagagtgttttgaggagtaccatgtgacggcttgagagcgtttttaggaagtttaatggatttttagtatataataataggtagattggggtgctaatagatagatagatatattaattatattatactctctctccactgttcacagagaaaacgttcgatcgcttcaatatcgaaatcctaactcattagctttgtactgattttgccataacttcagattacctgttggcaatatatagctttgtgctgatgattttggccggtctggcatggctacagatttgtggacctgaagcctccaagctcgccatcgccgtgcccaccatcagcagcagctcctgctcctacttctacagataccgctgcggcaggttcatcgtcaacgttgaactccagcgccaccggcacccccatcagcgtggatcaaccgaagcagcagcagaggcctctttcaccgtacactaggtactatatatacttaagactaattgattaattgatgccatttcatttttggtgttgtctattaatgaattggttaattaatttgttgaatgcacggtgcaccgtggatgtaatgatttgttctaagatatgaggagctgaagccacccagctcgccgtcaccgacgccgccatcagcagcttcatcggcttctgtttctgcttctcctgatacacctcctgcagcagcagcttcatcggcggcgttggactccagcgccaacggcactcccatcaccggcgatcaactgaatcagcagcagagtcctctttcaccatacacaaggtgcgtactgtacgactatatatgtatatacatgcttgtccattcttgtactaattcgatctttttgtgaatgcattattcaaggtacgaggaactcaagcctccaagctcgccaaccccatctacccccaaactatagaagcaagatagttagcatataaggctatattcgttttttgccttggccaatcatcactcaagatccagttatccactactagttaattaccttcatccaggaaaagcgacttgtatttttcatgtccaaattcaaaaaaaacaaagagtagtattggaattggaagtcaacaaattaattctctctaagtcttacaatgtttgtgcaccaagacccaggaataatttaaacggcatcaatcaatatgacatgcacaatatgcacacattatcccacaatgcatgcatcaatttaaaacacaatgcacaattacacccttagcatgcacatattttcccatgctgtattaatttaattgtactccgatgaaatccttgtccatgcagttatatgatgatcaaattgagaaaatttggttttcaatatatgatgatcaatttgggcaagagtgagtaagtcttaaccataaatactccatccatcccattttaaacatcacataagcaaagaacacaaagatcatggacaactaaacctttatcattctgtaattaattctcatcagttataagagcatctccaatagcctctccaaatcggactctccaaacacccatatagccaactctccatcttatttggctagtcaaactacttactcgctccaacagcctctccatctacccactctattttaagtctatcacagtgggtccccacatgtcagtcgctgcttcttcttcctcctctcccctccttcctctttctcccgcaggtatcaccgagcgcctcttcggcgacggcgaaggtggaactgtgcgcacgcgaggcaaaggcatcggaggcggcaagggggaagggggtgggagaaatccgtgtgcgcgaggtgggctcgtgcagcaagtagacgacgacgatgaaaggggagaagcaggcggcggcaaatccgtgcacatgcgagtcgacggcgacggcgagggatgacgaagactacggcgacggcgaaaggggaagccggccccactgccgcctcatttcctatctcgctagcgccaccactcccttcacgccgccttgtctcccttctcccacctcgacaccgtcgtcaggctgcgaggtgacaggttgcagcgagtggcggggcgggcggaggcggggtaacggctgcggtgagcggaggcggcgggctgtagcgagcggaggccggcggctgcggcggcagggcggccagaggatgatgctatggcaggctgcggcgagcggcggggcgggcaccgtcttcacctgccatagcagtgctcctccccgtgctcctcgcctggttgcctgtgctcgaggggtgggaaagagacggatgcgagagagagagagggggggtatggaggagactgtcagtgtggggcccaccattggccagccaaatttagccagtgaggaggagggtttggcggccagtgagttggagaggctgttggagcatgttttttgggtagaatagccaaaatttaacttggagagtcaatgggagaggctgttggagatgttgtactacgttgtttcgtatcccatggattacatcaagttttaaatattgcatgtagttgaccaatagaaattaatcttggttggttgcatgcggcgtattcaatgatgctcatttactctttttgcacaaataaataaagatgtgtttgttagaggatgatcattttgggaagatctcaagaaccttacgtgctgatcaaattaggatagagggagtaccaaatttcaggaaccaaaaggctttcttcttccatgcatcaaattcagatatacatttccagtcctagttcagctacaacgctcttcgcgggagcgattcctcggacagcggggagtggagaccccttcccaggtgtgaagattggaccaggggtttgtggtgcaaggcataggaaggtatctaggcaagatcggatctgcggggcctgagctccccgctgagcaaaagatacatgaatttatacccacccggaggtgtaataccctactcctgtgttggtttcgttgtcttcccaagataaggtaagtacaagggaggcctttccaggcaacaatgtgaaatgtactgatctaaagaatccaacccttcatccgtagcttgtcccctcccttttatagtccaaggaggggctcacattattacaaatatactctttgtcttgtcttatcagccgtcttgtcgttgtcggctagttctctaacacaatcttcaagaaacccattgagatttgaaacctgcattatattaccccgggtacctgggcttctgttcgacacagctgggttgcgacaactagcccaccacgtggcaagtggtgggcctggaggaacccgggctgcctgaaacagcgccacggttcctcttctgcccgtttggccaaattaggtggtgtgaggcatgttcgacacgcatcaaagacgccaccagttctaatgactcagcgctggtatcttgtccacgtcctttcagctccagactggctggggctccccataaacatgtttcatttatggtggagaggtccacttcacaacagtccatggagtgcgcccatctccccagccggtcctgatgttgcgcccttgcgctttttgtgatgataattcatctattcttaggcgagcttctcgaagatgtcgttgatcagtagataatgtgcttattttgtatgtttagacgctcttctttgcagatgaacttggaaactataaggactaaggtgagctcggggcccaggacaaggccgggcctaaggcagacctgagtctacttcttaagatgtagatcttgtatgtctctacgctcctcttattgagtagcataggacttacaaagactaaggtgagttcgggacccaggacaagaccaggtctgaggcaaaccttaggttacattcctcttcatagagcagtgtgtaacctagacgtgctaaggtgaacctgggacccgagacaggactgggtttgaggcaaaccttaggctacattcttatccccgaagacaaacaaaggactcaccaaggtggggcccctagccctatcaccctaggagtagctttttatttttaagaatgatttaagcatgtcatttattttacttctaactattttgttagagaaatgggtaccttggtttccatttcactgaaagtagcccccagcctcgggctgggctagagagatgaacgaggccgggcctggggcttctctccgaaggaaaaccgaagtcaaggtctcgggtccaacttgtcagggttcaacgagcgtgacaacactctgtcatgtcgcacgtctcatcattctgtgggtcagctgcgggagttaagccacgttcacacgccgccttaacttcccactaccatcccgtttttcgaggcgtcgtgggcgtggagaccgaaatgtctactcggggtttcttcttttaaaacctccctttcatccccattcgatctttccacgccctagcgctcttaccctcgattcaatcttgccgccaccgatcttcactaactccggtcatctttccccgccaccttctttctctccttttgcctgcaccatgctgttgtccaaccgcaacacactgtcggtgccggttgaatagaaaactaagtccatttgaaaatcattaaaatagttagaaataagtagaatgcattaaatatatgtttggaacttttaattttttaaaataattaaaataaggataatacatggaaaattatatttacaattattcgagacatataaaatttatatataattaaccatatctccgattaagtccatttaaaactcattaaaatcgttagaaatcagaagaatacattaaaaatgtgtaccatcggtttttagtttaattttgatgttttaaattattatatgattatttaatttttttcactttcgtggacttcctttacatttgttatcttctgatgtagatgaatcggcaatggatgttgtcatggttatggataccacatacttaatagtagttgactaaacttgccagggcccaccgcataccatgtcttatacggaaacaaacctcgtatatagaaggagttccggataatgaaggataaatagagttctatatggaaacggcaaggactactcggattgtatccatatttatctccctagtcttacttggacaagagggcatatatgagtataaatacaagccccccaggaggagaggggtcacgccacaacgcctcaaagccacaagccaacacacgtcgccagatatcaacatcagatataagtctagacataccccatccgactcctacggaggctggcaagagggatctagcaccatctctgatctcgccgagtacggattcgaggaggaagactaccctgttgtcgactacgggttggttatctagccgcctagtcgacgacggctagatgagttatcccaattattgtacttgtgtgattcagatgaataaaggagcaacaccagctgcggccaacaggatgtagggctattacctgtcagataaggggcccaaacctgtataaaaatccctgtctccatctcttttacctcaatctggcatataccctggtaccaacgatccccataccatctaaataacgtagtcgcaatatcaaacgttaacagtggcgtgctaggtagggggattttggtgcttcaaggttttgacgagatgggttcgagggatggattctccgacaacaaaatactcgatgacttcggctataggaagatctaacccgaccggagtatgtcccccgcagagatcaatgacttgaccaggaagcctccgttcgagtcgactgcccgggaagtgacatcgtcaattaattttgattctgttgggacctggattatcctcacccctaacacatagtgagaacgtccatcccgacaagtcgtggcgaggagaccgaatacatcattattcaagaccatcacgtactatttgctcctgacatgtgcacctacatatgcatggactcaatacatgcctaggtgtgcattgatttgacgacatgtacatgcacagaagacaattcagatcggctaccaaggctaattaaggtaattagtagattaattaaattgatctactaattccgtagatatattcggcatgtatctacaaaggtacgcaatattttatatacaatttatcgtacctattttccgatctatacaatattgttagataaataatttattatgtttacctagagcatgttttctatacaatatttattgtgcaagtgtttccggtgttaggccgactacggtttaatgctgggggctcgctctattttcttctgtataaatcatgtttgtttatggtttacataatgtccgatatttaatctgttcattatatcctgataatactagaagatccatgcagtcttttgagtatatactcgatattctctgctatacatcttgtcttctagaaaatatttttcaggaacgattgagcactcgagtaggatgtggtcgagtacaccgcattatcgagaacattctcgaaaaatgttgagttgtcgcacccaacctaccaacgaatattgacaacttatctcatgtatagcatcggctacagctagactatttgagaaaatgttgttaatggataattcctcgcgaacattgtcggcttgatcacccgacatgattgcgaatagacatccggatatgctatatgttgggtatgtgagtcatactggccacatgagatgcacatgtaatcaccaactctagcgcctctccaggtgatcgagatacgcctacacctagtcctcgaccagtagatcgtagtgatctctcactacctaaaaattcgttcgagacacgtctacacctagtccttggctagtagatcatagcgatctctcaccacctaaaaatttatcttcaggtgatcgagatatgcctacccctggtccttgactagtcggttgagcaatctctcgacatctaacgcgacaatcaacattgtcgtgatagcgacaaccaagaccgactagatcatcgttgtcaccaggacgacaacgtccaggactaacgacatcaggacgacatcagacaaggttaacgacatcatgacatcacacgacgacgacgaaactcgagatccccagacttctagagggcccgaggatgaggtagtaggtataggagccgaacctccgactacgataattcctcattgtcttcgtcttcatcaagaggctattctcgcagttcacgagaatgtcgtccatatattactctggattccttacaaatggtcgaggtaccactacgattggtcttcaatcgacaacgtagcgatcctcgtaccacaacttccactggttgaggtacgactacgactggttttcagccagcaacgtagcaatcctcgcaccacgacttctaatggtcgaggtacgactacgaatggttttccaccagcagcgtagcggtcctcgtatcatgacttccaaaggtcgagttacgacttcgactggtcctcgaccagtagcgtagcagtcctcgcacctcaatttcaaacagttgagagactcctactcctggttctcgaactagtaggtcgtagtgatctctcatacctccacttcaagtggtcgagttatgactacaactggtcttctgccagcgatgtagcgattctgccactacctatgcgatttgttgtgcacaactatacagttggtctttgcccagtgtggtggtcgtctgatcatctacgtcaaatttatgtaagtgcttgtatgtgcaatatttgtccagagatccattaccacgataacacctattgaccctttacgccgttccgacaagcctccaagagacctacgagaatttcagctagggacgcccatagtggataaggtcttgtcagactctgagagccgaacgaccatgtaagacctggtcatgtaagagtgctcaaaaggtgtattaactaagccgtgtaatcagaaattgatttttccaacttcacggctgggggctaggtaaatcgcattttcagctaggcaagttacaggtcgttgagccttctcctccgagaacgtgcttcttcgaggacaaggctgggggctaggaggagtaccgaactccgtttgctgagggcaactctagcgagagtactcttttattgtcaaacgcagattcaatttattttcaatttttcatacatattatatcatgttaccctttgagcgttcgcttcggggctatttctatttaatattctgttctgagtattgatttcaggaaagtaagccatcagaatagtcaagtcagattttcaaggctttgtcgctgaatttacaccttcttgattactcaagaacgattgatggagctcgacaaggaatatggaatgaagcgatggtgtacccgccgagatgaaatttcttgacttcaatccaaattctcgattacagcaagacgggagacttagtcgcatgatccataccttctcggtcaacatcaggacctagacaaacccagtatggtgcctgcggaggctgataaggggtatctagcattatctctgatctcaccgagaacggtcaaatgagcacgacaatagtttttcaaagtcttcggtcgagaacatgaacatgttcatttgcattgaagtcaggggctactgtcgtggttacctaatagtagttgactaaactcgctagggcctaccacataccatgtcttatacggaaacaaacctcgtatatagaaggagttccggataaggaaggttaaatagagttctatatgaaaacgacaaggactagtcgtattgtatccatatttatctctgaaagtgcatctaggcccctaatgattttggtgattaattacaatgcgattagaaaggactaacatttttatttaagcaaatgtgaaggttgttatgtcctcaatgagttagcgtaatacatatcccgccgaatatgttgatgtgatgtgatgcggcaaatgagcaaatggtattttgtacgttttcgtttccttgagttaataggaaagccgcactattaagagggatgacgcattgacatacgaggagtgatcaaagtgctcaaaatctatttttaaaaagtgtttctcctcagtttggtgtgttctggatttttttggagttttccgaaactcattttcagactttccgaaaacacacaaaaccagatttttgcttctggaaattttcggatatgtccgaaagtgattttcggactttccaaaaatgactgcgagggcaaaagtggttttgtatattttcggacttgtccgaaactgatttttggattttccgaaaatcatcagtagagtcaatttcgcttctgtatattttcggacttgtccgaaagttattttcggacttttccaagaacatccagaacgatgttgttggtactggaaattttcggacttgtccgaaaagttttcgaaatgtccgaaaaatccttcgttgactttgctgttggtgctgagctggaattttcggacatgtccgaaaatctttcggaatatccgaaaatctcaattattgtgcataacgggcagaatctgggctgtggctataaatagccccctcccctcacttgtgagggctgctggttccattccaatcatttgtgcccttggcttgctctctctcactagcacttttgagccttactttcttgtttcccctctcactggtgttcgatttggatttggtgtgtgtgtgagagttgtggattcgagtttgtgtgagtgcttattgttgacttcgtgaagatttgtgagcacttgcatcatctccaggagttttttgcttcatttgttactcttggaggttgaggactcctaggcggctaggtgtcgctcccgagccaccgatctacttgtggttggccgggagaagtttgtgaaggtcagatctcacctccgaataggaagagatacccttagtggaaggaggagtgcttagtgcaatctcttgaggaaagggttagctaagacccggctcttagtgagctcctcaacggagagtagaatcccctcaaggattcaaacttcgagaacaacctcgtgagcttcatctttggtgactttacttcctacctctccactagctttgcttgttcgagccactataggtctagttgctgtttgtgctagcatattcttgttgtaggcaactatttctaggatttactttgctatttgtgctgactccaaaaattttcggatatatccaaaaatttcggaaatatccgaaaattactgcttccacttttaattgatttttgaattagcctattcacccctcctctaggcctaattgacactttcaattgtatcagagcctaatctcctaattaggcttaaccgcttggagagatcatgtcgggccaagcgggggatgggaacgatggtggtaagggagctaatatcccttatgactatccctctacatctatatcttatgtgagtacctatagcggcaaagctccgtacttcaatggtacggactatgccgcttggaagcataagatgaagatgcatttgaagtctattaacccatctatttggagaatagtcgaaaaaggctatgttttgtagaatcccgaagatcccaccaaggaggacgacgagaacaagcacaagaacgctcaagccgctaatgcaatacttagcgccttgagtggaagtgagttcaacgtgtgatggcattgagagtgccaaagtgatttgggacacgcttcggaacttgcatgaaggcacggatagtgttcgtgagtccaagatggagatcctcaaggggcaatttgagagatttgtgatgttagatggtgagagcccaagcgacatgtacgaccggttgagcaagatcgtcaatgagatcaagggacttggctccaaggacatgaccgatgaggttgtggtcaagaagatggttcgagcaatcactccaaggaactttaccttggtgaccatcattcgtgagcgtccggactacaagactctcacacctcatgatttgctcggacgcatccttgcccatgacatgctcgtgcaagagtccaaggatgtcattcaatacatcaaccaaagctcaaccgcaagcatcaagaaggaagacttggctttgaaggcaaaggaagaagaagaagagaaccgcaagagcaagagcaaggcggagatcgatgatgaagagatggctctcttcgtcaagaagttcggcaaattcatgaggcgaagcggcttcttcaagggaggatcttccaagcactactctaacaagtcaagtggaagacactctgcaagagtgtgctacgtgtgcaaagagcccgggcacttcattgcggattgcccccacctcaaggatggttcccacatcaaggaagataagaagaaggatgagaagaaggagaagcacaagcatagcaagagcgaacattatggccaagctcaccttgggatgatctttggctccgactccaagtcaagctcaagtgatgaagaaggagttgccacgttcgccgtcaagccctcatcaccaccgagactcttcaactactcaagtgatgagaatgctaaggtaccttctcctcttaagtcatttaatgttgatcttgttagtgatgaggaggatgaggttgaggatgaggttatggatgacgaattgttcaagtccataactaaggaatccctaccacacttgagtgagttgcttgggagaattgaggaccaatatgtaactcttgagaggcaagagactttgctcattcatgagaaagagcggtctcatgaactcaagagtgagcttgctaaggagagagagaaaaatgaggcattggtacggctttacaagcaaaccaaagagtctcatgctaatcttgaggtggcgaacgctcaacttcaagagagagtggatggcttggacaaagcatacctcactcttgaagagaagttcaaaaccttaaagaatagtgtctctctccctagcgagccatcttgttctaaaattgtcccaagcaatgaaccatgtgtgagatgcaaagatattgatattgaagcttgtgctactaactctatttccttgagtgctttgcaaaagcaaaatgagaagcttatgggactccttcacaatggcttacttaagtgccatatggatagtaaggccctaaaggagtacctaggctatcaaagggacaacttctaccatcagggtcttgggtatgttcctccaccaaaagaaaaggtggacaagagtgtgctgatcaggaggccccaaggtcttagcaattttgttaaggccaaaagtatccttcctaatgattatgcttcacattgttcttttgatgcatcttatgttcttaggaagaatgctagttgtcgtgttgttgctaagtatgtaggcccaaggggcaagaatatttctatcaagagagtactttgggtgcctaagacacttgttactaacatgagaggacccaagcaagtatgggtacctaaaattagaaattgatctcttgtaggaatatgtctccggtggaagaagttgggtgattgataatggatgcacaaatcacatgatcggagaagaatcaatgttttcaactcttgatccaaatggcacttaacaagataacatagttttcggggacgatggaaagggaaaggttatgggattgggtaagattgcaatctctaatgatctttccattgccaacgttctcttggtaaaatctctaaactacaatcttttgtccgtttctcaattatgttctatgggttacaattgtctttttaccgatgttgatgtgaccgtctatagaaggaatgattcctcggtagtctttaaggatgtcctcaagggaaagctttaccttgtagatttttcctcaagtaaagccaaacatgagacatgcttagtggctaagtccaatacggggtggctttggcatcggaggctagcccatgttggtatgaggaatcttcacaagcttctaaagcacgatcacatccttggacaaacaaatgttcaatttgagaaagatagggtgtgtagcgcatatcaagccggcaaacaaattggagcacatcaccccgtcaagaatgtgatgaccactacaagaccattggagcttctccacatggacctcttcggaccaattgcttatctaagcattggaggtaacaaatatggtcttgttattgttgatgacttttcacgcttcacgtgggtgttctttttgcatgacaagagtgagacacaagctatcttcaagaagtttgcaagaagagcacaaaacgagttcgacctcaagatcaagaacattcgaagcgacaacggcaaggaatttaagaacacgtgcatcgagagtttccttgatgaagaaggaatcaagcacgagttctcggctccatattcacctcaataaaatggagtagccgagaggaagaataggactctcattgagatggcgaggaccatgttggatgagtacaagacatcggacggtttttgggccgaagccgtcaacaccgcatgccatgccatcaactgcctttatcttcaccgccttcttaagaagactccctatgagcttcttaccggtaacaaaccaaatgtctcttactttcgtgttttcggtagtaagtgttacattcttaataagaaggctagatcctctaagttcgctcctaaagtggatgagggattcttgcttgggtatgggtcaaatgaatgcgcttaccgcgttttcaacaaaacctccggtattgttgagatcgcgcgtgatgtgacatttgaagaaactaatggctctcaagtagagcaagttgattctcatgtgttaggtgaagaggaggatccgagcgaagcaatcaaaagattggctcttggggacgtacgtcctagggagccacaacaaggagtctcttcctcaacacaagtggagccacctacatcaacccaagccaacgatccctctatctcaagcttggatcaaggtgaagaaggtgagcaagtgccaccctcaccgatcaacttagctcgcccaagaatccaccaaagtatccaaagagatcatcccaccgacaacatcttaggagacatcaacaagggagtatccactcgttctcgtattgcaaatttttgtgagcattactcgtttgtgtcttctcttgaacctctaagggtggaagaagctcttaatgatccggattgggtgatggcgatgcaagaggagttgaataatttcacccagaatgaagtgtggaatttggtggagcgagctcggcaaaatgtgattggcacaaagtggatcttccgcaacaagcaagacgaggccggggtcgtaataaggaacaaggcgaggttagtggcgcaagggttcacccaaatcgaaggattagatttcggtgaaacttttgcaccggtagctagacttgagtcgattcgcatattgcttgcttttgttactaacctcaattttaagctatatcaaatggatgtcaaaagcaccttcctcaacgggcctatgaacgagttggtatacgtggagcaaccaccgggcttcgaggatccgaagtatcctaaccgcgtgtacaagctccacaaggcactctacgggcttaagcaagcccctagagcttggtatgagtgtcttcgcaattttcttgtgaaaaacgactttgaaatcgggaaagccgattcaaccctttttactaaaagacatgataatgatatttttgtgtgctaaatatatgtcgatgacattatatttggttctactaacaagtcttttagtgaagagtttagtaggatgatgaccaaacgttttgagatgtccatgatgggtgaattgaagttcttcctcgtccttcaaatcaagcaactcaaggaaggaacttttatttgccaaacaaagtatttgaaggacatgcttaagaagtttggaatggagaacgccaagccaatccacactcccatgccatcaaatggccacctcgacttcaacgagcaaggtaaagacgtcgatcaaaaagtataccgttccatcattggctcacttctttacctttgtgcatctaggcccgatattatgcttagtgtgtgcatgtgtgcaagatttcaagccgctccgaaggagtgtcaccttgtggccatgaagagaattcttagatatttagtgcacacacctaaccttggtctttggtatcctaagggagcgaggtttgatctcattggctatgccaatgtggattatgccggatgcaaagtggataggaaaagcacatcgggtacttgccaattcttgggtaggtcccttgtttcttggtcttccaagaagcaaaactccgtcgtcctatccaccaccgaagcggaatatgtttcggcggggagttgttgtgctcaacttctttggatgaagcaaacattgagagactatggcctcaatgtatccaaaatcccactcctatgtgacaatgagagtgccattaagatagccaacaaccccattcaacactctcgaaccaaacatatcgatattcgccaccatttcttgagagatcattccataagaggcgacatagacatccaacatgtgagaaccgacaaacaattggcggatatctttaccaagcctctagatgaagctaggttttgtgagttgaggagtgaactaaatattttggattctcggaatatggcttgatcaattgcatgcatgtttgcttggtagaataggtttgcataccactttgtgacaaaatggtcattcaattcatggatggacactagtcacttttttgtgtggagattttgaatctatgtgtatggggatctcatttttcaatgaatttaggtcctagcacaacttgaaatagattcacacattccctctctcgagggtgaattatcttgtctcatggtaattccctctcttttgatcccttggatcgtccatttgacttgtggctattgttttgtgtgattgattgtgtgctagtcacaagttcaaatggagcctctagtgctcgtccatcccttccttcctaaatcctatcacaaatccttgtaaaaattgtttttatcaaaatttccggtgcttgtcccttgcaaaattcctttaaaatgtttgaaaaatagtttcatcaaaattctcggcgaaatctcattgcaaaactgtgttttccaggaattttcggactttccgaaaaattttcggacattctgaaaatctctgtcctgtcgctctttcaattgctgcaatcccaggattttttggactttccgaaaaaaattttggacatatccgaaaaacatcagaaccgtgcgcaactcttctgtatcctttcggacatatccgaaaatttttggaaatatccgaaaatctcggggttcttatatatcaccccgtggactcccttctctctcctttccacttcttttccccacgggttgactccctcctccctccccccggcgacctcctcctctccggcgacctcccgcgactcccctcctctccaacctcgagggagcacgtttggggcacttcttgggccctacattgtcgatcttcatcgcattcttcacgtgttcttcgtgttcttgaggtatttgccctaaaatcaaatccctagattcctcaagttttatcttgcgatttcctttggtggagatgttcccctagtgccataggccctgcaaattcaatttcacaagtttttgttggcggatttgtgcggcatctgagttatagggttcggccagaatttttcggacttgtccaaaaattgtcggatatattcgaaaattcctggccgacccctatcacttcggatttgcatgattcttgccctcactcacttgtttcttgcctctttggcttccatacttgattccttgtatctctattgcttgaaggatgcctccccgcaagcaaacctcccacaagtccaagcgcccgagggatcgctctcccactccatcctctcatgatgattcggacagtgattggtccggtggagaagatgcggttcctcaggttgcgtgggtggctcggcggtctactcaagctcatggtggtggtggcgatggtgagggctcctctcgtcaaccgcaaacgccgccgcaccaacccaatgtccccattgggcctctccgcattcatacccccgagagggatccggcggtgattcaccaagtgtatgattggtggcgcaagtctgaggttgttgctcctcgtcgggatgaggatctgcgctcctttcgccgcaccgccacggatctgcggttttggaccctttttcagcaagacttttatgagtctgtgattaagtccaaaactcatcccactgttcccatgcaatggatcaattgggaggagttgcaggcacacaatgatccagtgattgactctgtgattgccaattgtgatctcatgggtatccgctccttcatgacgttgcagcaaaattggtgcaacgaggtcattgctcagttttatgccaccgtctactttgatcgttatcgtgccatgcactggatgactcaggggtcctggtattctgtttcttatcagcagttggctgagatctggggcttccgtcttcgttctttgctcaaccttgatgaccttcataatcttcaaattcttgccaacacagaattgcttcccctttatactccaaatgatccaaatgtggtgttgggcaaggtcgacggcctcaagccgtactttgcctacttgaaccggatgtttcgccggtcttttgtgcctaaggatggtgatgccagcagcattaaccacctctctaggaccgtgcttctccggtttgatccccctcctcatcgcttccatgtctatcactttgtgtgggaggagatccgcatggcttcaattcagtacaagaaggggttggtctatgcccctcacattatgtggatgatcgagactgtgactcagctccagtttcgccatgatgtgactcattctcagcttcagttgcgccttcttaaggccccccgctcctcagctgctcgggacataccctcctcttccactcagccgcctcctgctcctgagcgccctgcctctgtggctcgtcgtgagccgtctcccttattccgcattttgcggagtctttttggtctttgctccacggaggccaaaaagaaccaccgattgcggaattcggcaaagaaaacggctcgtgatgtcaagttcctcaaggcaaggtattatgaggaccaccacattgatatccctccttctcctccaggtttcgaggccgagcccgatgagccagaggatgaagagattgaggatccttttgccgggttgccttccgacttcgacttctttggatatggccatggctatggctatcctcctccacgcccttcgcttgagtcgtcatctcatcgtcctctctttttggtgtcttgatgccaaagagggagactatctatcatggctttagattatctatcttgtccttagagtcgagcacagttggtttttatctgtatgagactgttgtggttttttatgttaagtttaaagctttgtaagactattgtttaattatgaatgcttgtgatgtaatggatctttttatcttttaatgtggtgcaatgtcacatcctgatttttgtttcaggatttataaattatttaataaattaataatagaatttatattaaatgatctttaatttacaagtgaagttaaatgtgggaaataaaatttcctaaatctaaggcatggatggatttaatttttattaaattctccatgattaagtatactctctgaaattttctcggatttttcagagctcaattcctaaatgatacaaagaacagttcagtaattatttgatcaataatgatctaattataattgttaagtgcttttcttgtttaaaatccttaaattataaattgttgtttaaaaggaattattagaaatgattttaaaagcttaaaagagaagatctaattttaatttgttaaatctcaatataaaatggggccagataaaatttcattaaatacttcgcttaattctataattcctagatttttctgggatttatttgagctaaggaagtatttttaataaatggaattgcatttcatgaataatttaaatagaaaaaggttttaaaatcctccttttggctttgggccgaaagccggcccaaaacctctctccttctctctctctttctcggcccaagccagcccagtccgcaaccgagccgccgctcttctctctctctcccactgacaggtgggccctacctgtcaggcctgtcttcctcctcgcgccgccaccgccgcccgaaaccctagcgcaagcagccgccgtctccttccaaattcggccgcgtctttcccgatctggtgaaatcaatagaggggaaatgatcttctcgatctcctcttccttttctcttatagaaactccggtcaatttcctttggaaataggcggattcgagtttgattcggattcgtttttccccaatctttccttctcgtcgccggccgccgtgggccttcgccgccgcctccttgcacctataaaaggacccccggtgtctcctctacccaccgccacctttgccttagcccgccgtcgtgtctagcgccgcctccgcgtagccctagtcgccgccgtcgttgccgtcggttcagccgcgccgcgccgccgttgcagccgccgtcgtcggtcgccgtcgccaccatcgggatcgccaagtcgtcgccgtcctcatccgccccttcgccgccgccgaagaccaccggagcaccgtcgccgccatcgacccgatcttcgccgccgcttcttcctcgtcgccggcgctgtccgttgttcctccgccgcttcttttggtcaccggtgagttcgccgcgtcgccctctacccgttggtgtcctctgttcgcgtcctcgcgccgtcgttcgccggcgagcttgcgccgtccgagccgcccgagtcaccgccggtgctgacgtcgtcgctgacgtcatcgtcgtcgttctctgtgagccggtcgtggaccgttcgatctcggccgtccgttttggatcaagtcgatctcggccgtccgttcccgtgagccgtcgctcgtgcgcccggtccaccgaaaccctagccgctgacgcaataaatctcttttccttttcaaaattaattcattattgcgtcataattcaattaaaatcaatataagtgtttttaatccgatttaatctttaaaaattcataactaattcatcttagctcagtttaatgtggttcaagttgcaaaagttgtataaaataaagatctacgtattaaaattgtccataaattgaattaaatttatttaattctttttaaatgggctttaattagatttaatcttgtaaaattcataataaattcatttgaagtcagaatgaggccgttcaagtctcataattcatctaaaattataatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcaaatgtcaccgggtggtgtgaacttattcctttgttatggccaatttgcattgattactttattccttgataccttgggttattataacttgactagttgagctttatatattggttcagctagatattagatatgattgcttagccatgcttagaaacattagcacattattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttacatttcgtatagcatggttcattgcagagcaccagactgagaagtggcggagataagcccacgggggtcgctggggagtccatgcctctggtttttgagggggtgattatgatccaggaaaggtgcactgtggtgggttgtgttatgcgaggggtactgtcacagctcctttccgaggtaccgtggtggtattgaggcgcatggtgacatgtcgtggggctgtgtcttgtgggtacagtggtacacctctggccagagtaaaactattcggatagctgtgcccgcggttatgggcgggttgagcaatgtttttcgtgattagtctcacacctctcacaataattattgatgttatgactggtaataatttgcttagctcctggtttggagattagatctgtacagccgggtatggttgttcaggatggtcgggcctgtgcagcatgggtgtgctgttcagtgttgattaaaatttctgattaactactctactgttttatttctcttaaatattttgctaaacgctgcttttgcaaatgagcctatattatgccatcctttggtatccttgtgcacttgcatatttgctatgtggcttgctgagtatgtcatatgctcaccttgcaataatcaatcaacctcagttgaagaaaaaggatccagaaggagaagacgtttggcttataccccagttgagctgcctgtgggagtggagctggagcttcgctagattttattttccgctgcaattttcttcttggtgaggactaagtgcctcttaagtaagtatttattgttttagttaatttgatgaatctgtatattaaattgtcagtttgtgtacctcggctgattcctggacgaggattttatgcacaaataagttcggaaattactagtaaatttccgggcgtgacatgcaatgccttatcctctttatatggtgcttgtgatgagatgtaattattcctttgcatgtgatgtgttggatgtaatgagcatatgtgatatatttgttctcttgtgagcttcaatgtggatgcaataatttagggggagctctccacttgcttttatgcacactcttagggggagcttccactaaaactttgcaccaaaaaccttaaattatattcattctctcttgtgttctaatcatattgtcatcaatcaccaaaaagggggagattgaaagtgcatctaggcccctaatgattttggtgattaattataatgcgattagagaggactaacatttttatttaagcaaatgtgaaggttgttatgtcctcaatgagttagcgtaatgcatatcccgccgaatacgttgatgtgatgtgatgcggcaaatgagcaaatggtattttgtacgttttcatttccttgagttaataggaaagccgcactattaagagggatgatgcattgacatacgaggagtgatcaaagtgctcaaaatctatttttaaaaagtgtttctcctcagtttggtgtgttctgaattttttcggagttttccgaaactcattttcggactttccaaaaacacacagaaccagattttcgcttctggaaattttcggatatgtccgaaagtgattttcggactttccgaaaatgactgcgaaggcaaaagtggttctgtatattttcggacttgtctgaaactgattttcggattttccaaaaatcatcagtagagtcaatttcgcttatgtatatttttggacttttccgagaacatccagaacgatgttgttggtactggaaattttccgacttgtccgaaaagttttcggaatgtccgaaaaatccttcgttgactttgctgttggtgctgagctagaattttcggacatgtccgaaaatctttcggaatatccgaaaatctcaattattgtgcataacgggcaaaatctgggctgtggctataaatagccccctcccctcacttgtgagggctgctggttccattccaatcatttgtgcccttggcttgctctctctcactagcacttttgagccttgctttcttgtttcccctctcaccgatgtttgatttggatttggtgtgtgtgtgagagttgtggattcgagtttgtgtgagtgcttgttgttgacttcgtgaagatttgtgagcacttgcatcatctccgggagttctttgcttcatttgttactcttggaggttgaggacacctaggcggctaggtgttgctcccgagccaccgatctacttgtggttggccgggagaagtttgtgaaggtctatctcacctccgaataggaagagatacccttagtggaaggaggagtgcttagtgcaatctcttgaggaaagggttagctaagacccggctcttagtgagctcctcaacggagagtagaatcccctcaaggattcgaacttcgggaacaacctcgtgagcttcatctttggtgactttacttcctccctctccactagctttgcttgttcaagccgctataggtctagttgctgtttgtgctagcatattcttgttgtaggcaactagatctaggatttactttgcaatttgtgctaactccgaaaattttcggatatatccgaaaatttcggaaatatccgaaaattactgcttccgcttttaattgatttttgaattagcctattcaccccccctctaggcctaattgacactttcaatctccctagtcttacttggacaagggggcatatatgagtataaatacaagcccccctaggaggagaggggacacgccacaacgccagaaagccacaagccaacacacgtcgccagatatcaacatcagagataagtctagacatacaccatccggctcctatggaggctggcaagagggatctagcaccatctctgatctcgccgagtacggattcgaggaggaagactactctgtcgtcgactacgggttggttatctagccgcctagtcgacgacgtctagatgagttatcccaattattgtacttgtgtgattcagatgaataaaggagcaacaccagctgcggccaacaggatgtagggctattacctgtcatataatgggcccgaacctatatagaaatccctgtctccatctcttttacctcaatctcgcatataccctggtaccaacgatccccataccatctaaataacgtagtcgcgatatcaaacgtcgacagatgtacaccgcagaccgacggtctaaggagtttattgatggcgtgcattattttttaagtgtggccaatgcccataagcctaagagttttatattttgtctatgcagaaagtgtgaaaactagaaggtgtattctacatcaagaactcttcatatctacttgttgcagtcgggattcatgcctagctataattgttggaccttgcatggagagttaggggttgcaatggaagaagatgaagaagacgacgataacattccggactgggctcaatacgatggatttgcagaaaatacaaatgggcgaggtggacaaagctattgaagaaaacgacagtgtggattatcaaatcctaaagaatattctttctgagggaaacgacttgctcgaaacaacatacaaagataagaaggtagtctgcgctctaggactggaagtctagaagatacacgcatgtccgaacaattgtatcgtctatcgcggtgaggagtacgagaacctagaagcatgcccagtttgtaaggcactattatacaagattagacgagatgaccctggtgatgttgatgggaagcctgaagaagagggttccttctaagatgatgtggtatttccctataataccatggttgaggcgtttgttcaagtacaaagctcatgctagaatgatttgttgtcacgtagaagaacgtaaacatgacgggatgctgagacaccctgttgatggtcgtagtggtgaaacatcgatagaacatttaaagactacggaaaggatgcacagaacataaggtttggtttaagtacagatggcatgaatcattggagagatgagcagcggtagtagcacttggcctgtgaccatgtgtatctatgacctccccccttggttatgcatgaagtggaagtacatcatgatgctgattattactcaagaactagagcaacctggtaacgacattgatgtgtacttaagatcattggttgaagatctgaaacttttatggaagaaagaaggtgccatgtgtgggaggagaacaaacaagagcaatttaacctacgagcgttgtagttcatcaccattaacaattgccctacacttaacgacctatctagataatcaaacaaggggtataacgaaagaaaggcaaacattttgaagagaaggcagaccaccgtactaacctaaacatcataatggaaaaaccatgtttgctaaagatctgaaagtaatatttggaaagggacccgatagccaacctatagctagtgaatatgttcacgtggtgatgtggaagactaagtctatttttttcgggagttaccctattgggaagccttagaggtccgccaagcaatcgacatgatacactttactaagaacccgtgcatcaacctaccgggcttcctaggtgtatgtgagaagtcaaaaaatacacttgaagcatgtaataatctcaagcatatgaaacaacgtgacggccttcgtctgaagccaaggagaaaggaagccattgcttgagtccagccaactactctctgaggaaggcaaagaaggaaagcatgtttgtttcctgtgagagaatgtaagcagcttacgagttctcatagcatatgaacggagagaatagagtgtaaa

SEQ ID NO: 36592 - DNA, 420 bp, Oryza sativa
aacatgctagtatatgtacttttttttaatgactgcgttagattatttgtcctgctaagcacttcgatgtcctgctttgtactttgatgactgttagattattatcctttgtatgccaaggacagtggaggaaccataggaagtcgaaggtctttatggaccaaacgaaggtcttttttgggccaactagtttggtctgttcgcttattgagtatgctgtgttaggaggattccttagattaagctccacatgcagtatccattgtatactgagcttgatctctaacctgttaggtcgattaagtaaattctggactgttgcgagtttgtgtttcccggttcgaagatttcatgttgtgtgttgtgcataaaccctgttcgaagagatcatgctgtgtcgtgcatagacttcaactatgg

SEQ ID NO: 36593 - DNA, 10131 bp, Oryza sativa
ccttttctgctttatttaaatttggatttgaccatgcattgatcctacccctttgtcttctttaaatggctgagcacccccccaaccaccacggaaaaggcatggatgattttgtgacaaaattggctcccatgacactggtggtgggctaccccaacgcgccagaatactcgactgttccaccgctcattggcgagtttcctcaccgtgttcgcttagaggtccatggctatgtgggtacctgcctcgctaacatggtggttgaggcatccggaggcaccgcagaccacgcctcgctaacatggtggttgaggcatccggaggcaccgcagaccacgcctgtcaggaggcagcatatctgatgatggccaggcttcgtgatcggcacagctacaccttctgcaacacggcgtaccgcttccaccctcgtcgagcaagtggctatgatatcagcaccttccgcccgatagccggcgagaacgacaccaccttcggccacatgtgcgccatgatgaggggaatggacaggatgtactcggatctgcacaaggcatccaaggccttgaatgatgggaatctcgtgaggatcatagctctgaaggatgagatagcgcgcctgaagaagaagaatgctcagttgaagggtctcctagcgccaggaggagtccggatccgcaccacgccccgcaagtcaacaacggcacccgtgcgcattcaacttgcgcccaggaacccacctccgcctgcagctcccgcagctcctccagctccgcccgcagttcccgcagctccagcgccagttccagctcctgttccagtgtcagctcccgcgtccgctctctccttcactccagcatcagccgtcaggggcccagccagtggcaacggaggttggttgcctgctactcccagtggcagccgtgaccacagcagcagcagttccagtggcaccgagccaggcagatgcgagacgtatctgccagattccaggagccgctcagagggacctggtgacgagcaggaggacgccttcgactccaccgaccgcaggagccgttccgagcattaggctcgctttccattagtttatcgactatttagcatttgcctgttagtttgtgtgtttaggtctgctcgcttgtgggtcagttgacggtcgatatcatgtgcctataatatggctgtcttaataaagatttttgcttgctgttttaagtgttttaatttagatcagaacaattgcagtttaaattcctatataataaagcttagttcttgagcatctgtttttcttcttttcccccccgtctgcttttcctccagatggtctacaccaggaatggtagccgcacaacaggcgagggcagcaatggcgaagaacgcactgacggggtgcatcccaacagcgattccggcaatggtccgccaccactccccgagaatccgactctggcccaagtaatggctcatcagactcagatgatggcagccatgatgcagcagcagcaccagcagatgcaccaaaggatgcagcagcaagccgagcagcatcagcagcagtttggtccccctccccctcagtccaaactgccggagtttctacgcgttaggccacccaccttctccagcaccaccaaccccatggaggcgaatgactggctaaatgccatagagaagaagctaaatctcctgcagtgcaatgatcaggagaaggtcgccttcgccacacaccagctccaaggtcccgcgtcagcttggtgggacaatctcatggccacccgcccgccaggcactgaagtcacttgggcagagttctgtcgcagttttaggaaggcgcaggtgccagacggggtcgtggcacaaaagaagagagaattccgggcactccaccagggcaacaggacagtgactgagtatctccatgagttcaatcgcttagcgcgatatgcaccggaggatgtccacactaacgcggagaagcaggagaagttcctagcaggcctggatgacgagctaaccaaccagttaatctctggggactacgccgactttgagaggctggttgacaaggcaatccgtcaggaggatcagcgcaccaaaatggacaggaagagaaaggcggcgcagttccggtccaaccaaggaagccaccagcgaccgcgcttcactccaggacagcagggtggacctaccaccatgatcgtccgccagcaccgccctttcaactcaagcagcttccaccagggcgccagtggcagccagaaccaccatggaggtcagcccaaccacagtgcagctccgcgcccaccaatggcaccagtacagtcagctccgtccgcgcaagccaagaaggagactggaacaaagccagggtcctgcttcaactgtggcgagcttggccacttcgctgacaaatgtccgaagcctaggcgtgccgggccaaggttcatccaggctcgtgtcaaccacgcgtccgcagaggaggcgcaagcagcaccagaggtcgtactgggtacgttttgtgtcaactcagtccctgctatagtactttttgattctggtgcaacgcattctttcatttcaaagaaatttgtgggaatacatatgggttaagaaaagaagagcttagtacaccaatgagggttcataccccgggaaatagttcaacctcggtcagttatagcccttcagtgctaataggaattcaaggatcaccatttctagccaacctcatccttcttgaatctaaagacctagatgtcattcttgggatggattggctaaccaagttcaagggagtcattgatttgcaaattgcacagtcaccttgaccaacaagaagggagaaacggtagtgtacaaatcactagtctcaccaaagcaaggggtctccttgaatcagattgaggtggaaatcccagtggtcaccgaggggaagagttcgaggaaattggaagatatccccatagtctgcgagtacccaaaagtgtttcccgaagacctcactaccatgccacccaagagagagattgaattccggattgatttggcaccgggaaccgctccaatttacaagacaccgtataggatggcagccaacgagctagcagaggtcaagaagcaggttgatgagcagctgcagaaagggtacattcgaccaagtacttcaccttggggtgctccggtcatttttgtggagaagaaggacaagacgaagagaatgtgtgtcgactatcgcgcactcaatgaggtcacaatcaagaacaaatatcctttaccgcggatcgatgatttgtttgatcagctgaaaggagctaaagtgttttctaagatagacctgcgatcaggctaccaccagttgagaattcaggaagaggatattccaaagacagccttcaccactcggtatgggttgtatgagtgcacggttatgtctttcggacttaccaacgcacccgcattcttcatgaatctgatgaacaaagtgttcatggaatttctggacaagtttgttgtggtattcatcgatgacatacctatctattcaaagtccgaagaagaacatgagcaacatctccgtctggtactcaagaagttgaaggagcaccagttatacgccaagttcagcaagtgtgacttctggttgtctgaagtcaaatttctgggtcacgttattacagctcaagacgtggcagttgatccatcgaatgtggaatcagttaccaagtggacaccacctaacaccgtgtcgcaaattcggagttttcttggacttgcaggttattaccgccgattcattgaaaacttctccaggatcgcccgacccatgactcagttgcttaagaaagatgagaagtttaaatggacagctgagtgtgacaagagttttgaggagctcaagaagaaattagtatccgccccagttctgattctgcccgaccagatgaaagacttccaagtctattgcaacgcatcccgccacgggtttggatgtgttctaatgcaagagggcagagtggtcgcgtatgcctcgcggcagttgcgtccacatgaagggaattatccaactcatgacctggaattggcagcagtggttcatgccttgaagatctggaggcactatctgattggcaaccgctgcgaagtgtatacggaccacaagagtctgaaatacatctttacccaaccggatctaaatctccaacagcgaagatggttggagctaatcaaagattatgacatgagcattcattaccatccaggaaaagccaatgtggtggcagatgcattaagcaggaaaagctactgcaatgctttatgcaccgaaggcatgtgtaaggaattgcagcagaagcttgaacacctcaacttggggcttgtggaatatgggtacatggctgccctagaggcacgacctacgctcgtggatcaagtcagagcagctcaagtaaatgatcctgaaataacagagctgaaaaagaacatgagggtcggaaaagcccgggatttccacgaagatgaacatggcacaatctggttggaagaaagattgtgtgtacctgacgacaaggaactgaaggatatgatactcaccgaggctcatcagactcagtactccattcatccaggcagcaccaaaatgtatcaagacctcaaagaaaagttttggtgggtcagcatgagaagggaaatagctgaattcgtcacactctgcgacgtttgccaacgagtgaaggcagagcaccaaaggccagcagatttactccaacctcttcaaatcctggaatggaaatgggaagaaattggaatggatttcataacaggtctgcccaggacatcatctggccacgattcgatatgggtagttgtggatcggcttaccaaaaccgctcatttcatcccagtgcacactacttatacgggcaaaaggttggcaaagctctacctctcgcgaatcatgtgtctacatggagtacccaaaaagatagtatctgatcaagggagccaattcacttcaaagttctggcagaaattgcaagaggaattgggaacccggttgaatttcagtacagcctaccatccgcagaccgatggtcagaccgagcgagtcaatcaaatattggaggacatgttaagggcttgtgcacttgattttggtggagcttgggacaaaagcttgccgtatgcggagttctcttacaaccacagttaccaggctagtcttcaaatggcaccgttcgaagcattatacggctggaagtgccgcacacctctcttctgggatcagacaggcgaacgtcaactgttcggaacagaggtgttaacggaagcagaagagaaagtcagaaccatcagagaaaggttgagaattgcccagtctcgacagaagagctacgcggacaaccgccgaagggagctcacttttgaagcaggggataacgtgtaccttcgtgttactccgctccggggagtacaccgttttcaaaccaaaggcaagttggcaccacgcttcgtgggaccataaaaaatcttggaacgaagaggagaagttgcttatcagctagagcttccatccaatatgatcggtatccaagacgtgttccacgtgtcccaattaaagaagtgcttgagggtacccgaagaacaggccgattcggagcacatcgatatccaggaggatctgacctacatggagaagccagttcgcatccttgagaccagcgaaaggaggactagaaacaaggtcaccaggttttgccgggttcagtggagccaccattcagaggaggaagcaacctgggaaagggaagatgagttgaaggccgcccatacgcacctcttcgccagctcttccgaatctcggggtcgagattccgtttaaggggggtaggtttgtcacaccctgaagttctttcccaagcctaaattgaagttataaatggtctcaagaaaataccagtgcaaagcaagactaaaccttaataaattaatgcaaataataatcagaattggcatgtggaatttttcttgagttctacatgtcgaaattcgctaacaagatttttagtggaattttcagagctctcgaaataattttaaccaattaaaattgagcacatgcaattttaaatcaaagggaaaatcttttcctccttttctttttcttttccctccttttcctcttcttgggccgtcggcccagtccaccccgccgccgcgcgcgccctcctccttgtgggccggcccaagccgcccctccctctccccccaggacgccgataggtgggccccacctgttgaggtcgtccccttcctccggccgcccgccccacgtcggcaaccgccgccgaaaccgccgcgcccacctccgccgctcctcccgcgcccacgcggcgtcgcccacgcgtcctccccacatcgccgccctctccccgcgtctcccggcccgcgcgtgcgctcgaaaggggcgggattcgcattttgaatccccccattttctctctctctcctccccacgtcgccggcggaatcggaggccctcccggccacatccgcctccccctccgcctataaaatgttccccgtgcccttctctctcgttttccgctctcgccgctccctcccatgcttcttaccgagctcgcgccgctcgccgcccgcgccgccgcttgccaccgcactccggccgcgtgccgccgccacgctaagccgccgccaccactagcttcgccgccgcaagatctttcccggccgccgccttgcgtcgccagaatccaaccgagaccccttttccctcgcgtcgccggtgagttccctctcccctccgactccggccggcatggatggccgccgtggggtatttcctccgccctaattcctctcctctccttccataggtgtcgccgtcgcgcgtccgcacctcggcatcgccagtcttcgccgcctccctcgttttccgccgccggtcgtcgccgccccctccggtgaggactccctcccccttcctttccttccccatcccgcgtgcaccgtcggttttggccgcgccgctgctccgtctgtgcgcctccgccttcgtgccgtccgccgccgcctctagccatggccggccggccggctttgaagctgagccgagcccggcggctactccctgcgccgtccgatcggcccgaggccgatccggaccgtcggtcctgtggaccggcggtggaccacccgcgtggtcccggtccacggtggaccggccgctttgtgccgctgacccatggggcccacgtgccggcgccccctccctctccccttgcgcaactgacatgcgggccccgcatgtcggcgccgcccgctccctttgatgacgtcagccctaggcatttattgcgcaataattcaattaaggattttttctgtttatagtaaaaacacagtgaatcttctaaaattcataactaattcatccgagctccgtttaagcccattcaagtctcagtaaatcaagaaaaatgtgtagaatccattaaaaatggttttgttctctgtttcaatagtcttatagcctgtttgtattgtttgctttgtatatcgcttagattccggttcttccgacgctccggtgtacttcgagatagtcgccgaggttcctccagcagcagagcaaggcaagtcatgcctgttacttgaacatgttgatcctatattacaaatgttctaatgttttccttcaaatactgcattgttttacaataatacaatgggatgtttacctactgttacagccatgctattttggtaccatgctcctttgttagcttgggttataacatgactagacattggactggggattgcttagccatgcttagttcaactagcacacaatggggaaaatcctattaatgtatagactgtaggttctaatggtaatgttggattagtgccaccgcttcggtgttggttaattaaaataaatcacatggtgggctgtgggtgcatggttttgttggtcgcgcccatggtagttaaggaccggttcgcgggatgccctggaagaacttatcgtacttatcacaagccagcgtgggcaacggctgggcttgtagtgtagctttcctctagctgacgcatccaggcgagggtgagcgtgatggagtttggatgggccctgcgatggcctatgcggcttccagattcacctaggcacgagaagggactgcccgctgccttgcgaggagtgggggggaaacctgaggtgtggtgtgcttggttagagggggttatgcgaagggtcctgtcacggcctctttccggtatgtcgtggtggcatgccggcgcacggaaacgtgtcgtggggctgtgtcttgtgggtacagttgtacatctctgatcagagtaaaactattcgaatagccgtgcccgcggttatgggtggtcaaccagattcaccgtgattagtctcaccctagtttagtctaatgaaattggatagtataggtggatggttgggcctgttgcaacgtggtatagcgttggacagtggatgattaatattgattaattgttacaactgttttactcttctcaacttctgtttataaatgcccgttttatgcaaataaaccattatagctaccccttgataattccctgcatcatacccctattccagtatgacttgctgagtacagtgggtagtactcagtcttactctgttttccccaaaaccccagaatttgagtatgcgtcagatggcggtttctccgaggagtaggcttcgtccgtgccgtcgaggatgcctgtggagtggtgtttccgctgcagatcaagtcaaggcttagctccagttatcttttatttttccgctgcatttatgtaaggctttgataatgtttgtaagacgtggatctgtatgtcaactttgtcgtttgtgtaccccggccggtcctggacggggattttaatggacattctacttggaattctattcagaaatttctgggcgtgacattcctcaaatagctttaattgctcattgtgaaaaagagaataaaaatataaaaaaattaataccgaatccttggaaacagtcttgacgttaaggacgtattcgatgtgagcaaaataatggatgcggaatccctggaaacagtcttgacgacagggacgtacccggaataaaagagaaaaatataagaaaaaaggctcaagaaaagaaaaggttcaaaaaaattctcttagttattttgtgctaaagtttatttgggaaagagttataaatgcaataggtatatgtatttagtgtttattcttcaacatatgtgcttgttaagatattgcattataaatcgtatgaaatcatgaattttgattcttgattcaaggttaattgtaaaatctttggttcatggttatactttaatgcatgcttgttatcttatagatgggtttatcttctttttattgcaacacatgacttgatatgctatatgtatgctaagctcttgaacattactgcacataattcatatgcttgaagaaatcattgtaaaaagggggagaagtaatgtgaaaatttttggatttttgggagaagcaaggtgattttttggagagttgttgagaagagcatgtttttggttcgattgggaatttctttctttcaaaaagggggagaagttttcttttggattttcgagcacgatgtgtacgtttgtgcgaagtgtgcttttttccacttttgtttttatttttccaaacaccaaaacatttttattggtttgccaatgtgttcatcaagggggagattgtaaaatcaaaggtgtttttgattattattctgtgatgaacaatcgggcattggagattattggttttgttatttggaatttattcacaaagtggttttgaagatgattggatttcacaagtgatcgcaggatttgttatttcatgtgaccggtcagaccgggcagtgtgtgccggtcagaccagcggtgatcgagcggtcggaccggctagcccgcggtctgaccggccgacgctgtgtcggtttcggtttcgggttgtttgtttggatatccgtgattatttcatgattatgacttctatatggatactatatgtatgtaatactgttgt

SEQ ID NO: 36594 - DNA, 738 bp, Oryza sativa
ctggattcctaaatttttattatcatcttttggtcgacttctgcttgtgtgtaggctttgtggcaaggaagaaaaacgtgtggatcgtggattccggttgttcgcggcacatgaccggtgataaaaattggttctcctccctcaagaaggcatccaagactgaatcgattatctttggtgatgcttctacaagtgtcgttttcgctacacgtttggttaaggtaaatgaaaattttgaattgaagaatgtagcgttggttgaggacttaaagtacaatttgctttcagtttcacaaattgttgatgaaaattttgaggttcactttaagaaaactggaagtaaagtttttgattcttatggtgattctgtgttgaatatttctcgctatggaagagtgtttaaagctgattttgaaaatcctgtttcacctgtgataacatgtttggttgctaagtttgataaagatgtgatgttttggcatcgtagacttggacatgttggttttgatcatctcactaggttaagtggtttggatcatgttcgtggtttgcctaaacttaagaaagatcttgatttggtttgtacaccgtgtcgtcatgctaagatggttgctacttcacatgctcctgttgtttctgtgatgacggatgcaccgggacagctattacatatggacactgttggtccagctagagtgcaattcgttggaggaaagtggtatgtgttggttattgttg

SEQ ID NO: 36595 - DNA, 880 bp, Oryza sativa
cgatgtttgcttcatggcgcgtggtgaatctgacacagagtatgaagataatgaggtaagtgcttttgaggaagctattaatattttgagtgaaaaaaataagaagtgtgagaagatgtatagaaaacaggaatttatcattgaatctcttaaatctgaaattgctagattaaaatctcttattcctaatgatgatgattgctcaaattgtgaggttttaatgaatgagatttcaaaaattagagatgttaatgctgcacatgatttgaaaaataaatcttctcttgcttgtagttttgctttgcacacacgtactttggatgagttgtttttaacgaaaaagttgttgcaaaaatatcaaattgcttttcatactagtttgatgtttaacatgatttctgctaaaaagttaaaacaacctcatgatgttttggattgcttaacatgtaatttgaataagttgaaattgaaagatgctttaggtcgtgttgagttcatggaagatgttgtgaaaaacaatgaagtgctttcttgcgctaaatgtcgtaaaagcaatggtgtcatggtagattgtgaaaattgtgctaatttggaaaaagaggtttcttatttgaaaaattctttgctaagattttctgatggtaaaaagaacctcaacatgattttggatcaataaaaggttagcacacataaccgtggtttaggttttaatccttatgctcataattctagacatcctcctgttgtgttaggtgttggtgctagaagtggtgagattttggttaaacctgatactaataaaactgtgtttaaatctgctggtatcatgtctaatatgagtgcatttttttcaaatccaatgttgtgcattcaaatctcc

SEQ ID NO: 36596 - DNA, 3074 bp, Oryza sativa
gaaagaggtcttgaacatgaattttcttctcctcgtgttcctcaacaaaacggtgttgttgaaaggaaaattcgtgttttggttaagatggctagaacgatgttggatgaatataaaactcctagaaaattttgggctgaggcgattaacactgcttgttatatttcaaatcgagttttcttgagattaaacttggaaaaacttcttatgaacttcgatttggacatcaacccaaagtttcacatttgcgtgtttttggttgcaagtgctttgtcttgaaatctggaaatttggataagtttgaggcacgttctaccgatggattgtttcttggttaccccgcacatactcgtggctatcgtgtacttattttggagactaacaaaatcgttgagacttgcgaagtttctttcgatgaggctagtccaggtagtagacccgatattgcaggtacactatcacaggttcaggggaaggatggtcgtatttttgaagacgagagcgacgacaacgacgacgacgaggtcagctcggccggacagaccgagcgccaagccggtcagaccgccggtacacctccggtcagaccggcacaggaggtgcggttagaccggccagggtcgtcagctgagggttctattaatgctgttcgagatggtcctccggagactacaactttgaccagtactgatacagaacgtgggtcaacttcagaagttgctactcctttgcacattcaacgacgacatccgccggaacaaatcattggtaatataggtgagcggactacaaggtctaaggtaacgactcatgatgtttgtgcaaattctgcatttgttgcttcttttgaacccaaagatgtgtcacatgcattaactgatgaatcgtggattaacgccatgcatgaagaacttgaaaattttgagagaaacaaagtttggactttagttgaaccaccttctggacataatattattggaaccaagtgggtattcaaaaataaacaaaatgaggatggtttgattgtgagaaataaagctagacttgttgctcaaggttttactcaagttgagggtttggattttgttgaaacttttgctcctgttgctagaattgaggcaattagacttttgtttgcttttgctgcttcaaaaggttttaaattgtatcaaatggatgtgaaaagtgcttttctaaatggttttatacaggaggaagtttatgtcaaacaaccaccaggttttgaaaatcctgattttcccaaccatgtttttaaattgtctaaagctttgtatggcttgaaacaagctcctagagcatggtatataggcttaagaactttttgcttgcgaaaggttttacaatgggaaagattgacaaaacactttttgttcttaagcatggtgataatcaactttttgttcagatttatgtggatgatatcatctttggttgttcgactcacgctttggttgtagattttgctgagactatacgcagggaatttgagatgagcatgatgggtgagttatcgtactttttgggattgcaaattaagcaaacacctcaaggtacctttgtgcatcaaacgaagtatacgaaggatctttaattttgagaaggttcaagatggagaattgcaagccaattttaacaccaattgattctacagctgtgttggatcctgatgaagatggtgaagccgttgatcaaaaagagtatagaagtatgattggatctttgttgtatctaactgcttctaggccagacatacaatttgctatgtgtttgtgtgcacgctttcaagcttctcctcgtgcttcacatcgtcaagcggtcaagcgaataatgaggtatttgaatcatacacttgagtttggaatttggtattctacttcatcttctatatgtttaagtggatattccgatgctgattttagtggttgtagaattaataggaaaagtactagtagaacatgttattttcttggtacatcattgattgcatggtcttctaggaaacaatctagtgttgcttaatcaaatgctgaatctgaatatgttgctgctgctagttgttgttcacagattctttggcttttatctactttgaaagattatggtcttacttttgagaaagtacctctcttttgtgataatactagtgctatcaatattgctaagaatcatgttcaacactcacgcacaaagcacattgatattcgttttcacatggacaccaagttgcaaattgctgatattttcactaaacctttggattctattcgctttgcttttcttcgtggtgaattgggcataattcatccttttggcatggtttgagggggagtttgtacctcatggttttatcaagcaataatatgataatgagaaaaattgagaaaagagagctttgtttatgcatatggtattttcttgtgcatgctagcaatactttgaaggtttatttgtctctagcatagcttgtatgtattctagtcttttcatgagatttagattttgcttttaagggagattatgcatgacacttaaattctacttgaattaagcaaatatgcaatgatgatgctagcatatggtttgatttataaatgctctatatatatgctttattgacttgttattccttgtcacaccctgaagttctttcccaagcctaaattgaagttataaatggtctcaagaaaataccagtgtaaagcaagagtaaaccttaataaattaatgcaaataataatcggaattggcatgtgaatttttcttgagttctacatgtcgaaattcgctaacaagatttttagtggaattttcagagctctcgaaataattttaaccaattaaaattgagcatatgcaattttaaatcccagggaaaatcttttcctccttttctttttcttttccctccttttcctcttcttgggccgtcggcccagtccaccccgccgccgggcgcgccctcctccttgtgggccagcccaagccgcccttcctctccccccgagacgccaacaggtgggccccacctgtcgaggtcgtccccatccttcggc

SEQ ID NO: 36597 - DNA, 3460 bp, Oryza sativa
ccattattacttggaattctgctgtctagtacttaggcaattcacagtgcacacgacaatgttggggccacgtcaaaaaaataaatatagacgggatgtatcacaacaaatctaaataatacatccaatactaaattcggtttttatgggacaaagagagtagacaaatagcttgcctggaggagagaagggattggggactggaccgtgatttcaccgggttcgcgtcaccaaagttggtaacgagagcctcgcggcagtttcgtcataaaaaggaatcacatccgctcgagacaagaaagctagagagagagagagggaagaacagtgtccgagctagatttgcgctggagaatctctccggagaggggtgtggaggtggtgacgtgatggtgagcctgaccccgatgacggtgcccttgccggggacctcaccggcccacacctcctaatacatgccggaggaggggagaggagtaggggcgctgacgccgctagatccgcccctagctcaggtggtggtggccggagcgagggagggagccagggaggggcggccgttggctcaatctgcggggagcccgtcgtgtcacatcctgattttcgtttcaggatttagaaattatttaataaattattgttagaatttatattaaatgttcattaattttcaagtgaagttaaatgtgggaaataaaatttcctaaatataaagcatggatggatttaatttttattaaattctccatggttaattatactctctggaattttcttggatttttcggagctcaattcccaattttaatcatacaaagaacatttcagtaattacccacatatttaattaatcattaaatggtctgttttaatattgttaagtactttgagtgtccaattagttccaggatttttcttgaaattatttgagcattgaaagtatttttaacaattcaaagatcattttggtgattaatttaattggaaaagtaattaagcttgcagccctctccctctcttttccgaagtccatttcatgtccctccttcaatcgggccaaggaaaaggaagcccagccaaagtctactttacctcccactgttcatcttccagctccagacacagcccgagctgccgtcctgtgcctgtagccgacgccgcttcctccaccaaatccggcgcattcgttgatccccttccaaaattgattgcaaaaacggattcctctctatctccactacctaatcccgaagaaacccccatcaaattcgttatctatctcacgaattttggccgtttttattcgggtgaactcggataaatcctaacttccttcaccaaatccatccgttcctgagccgatctcctccaccatgcctatataaagcatcccctagtcgtcctcttccgtttgccccaagtcccgagctctaccgttgcccgtagcgccgccaccgcgtagccctagccgccgccgtcgttgttgtcgttccagccacgccgcgccggggttgtggtcgccgccgccgcttggcgtcgtcgctgtcgggtttgcgcggaggaggagcacctcggccgcccctttgcagctgccgaagaccgtcggagagccgtcgtcgccgtcaagtcaagccgagccgccgttggagttcgtcgccggccgtcgtttgtcgtcgttcgtcgttgttctttgcacctgtgagtttgcgtcgtcgtcctcttcgtgttggtgtctttggatagcccaaccgagctctctatcgccggcggagttgtggtccagtgccatggctgcgatgatgtcgtgatgacatcataaatcatttatttaattcgtaataattatctggattagatgaaaatcgattaaacttcagaaattcataactaaatcatcgtaactcggattcgagtggttcaagttgctaaattcatctaaaatcgagatctacatgttaaaaatgtccacatgtactgtttatgcttgttttttactgttttattgattttgtttatttgctttagtttccgacgttccggaggagagcgtttacattgaagaaggttcaaaagcgtttacggaagctcaaggaaagtcacacagatcccaaacaaccctttgagcatgttgaacccgtttaaagctaatgttttattttaacttatgcattattttcgaatgtcatcgggtggtaagcctttcccaattaattaatggccgaaaatgatgttatttttcctatgggttataatttgattagctagaaccttatatattggtttagttcagctaaatgctatatgtataattgcttagccatgcttagaaacattagctcattaatgggatgaatcatatatactacattattatttatgattatatttaatgatagctcacgatggttaatcgtgttatgataattaattgatatttaaaacttgtcaatggtgggttgtgagcacatggttttgaaggtcgtgctcatggcaattaaggaccggttcgcgagctactgttgtgagacattaaccgtgccaaccacaagccagcgtgggcaacggctttaccttttgtatagcatgattcattacggggtgccagactgagaagcggcgagaagtctgtgggggtcgctggggagtccatgcctctggtaatatttatagagggggtgattatgatccaggaatggtgcactgtggtgagttgtgttgtgcagggggtactgtcacagcctctattcgggtactttccagtatcgcgacgcatggtagacatgatgttgaggctgtgtcttgtggatacagcggtacacctctggccagagtaaaactattcgaatagccgtgcccgcggtcatgggcgggttgagcaatgtttttcgttattagtctcacacctctcacaataattattgatgctataactggtaataatttgtttagctcctggtttggagttagatctgtgcagccgggtatggttgttcagggtggttgggcctgtgcagcatgggtgtgctgtgcagtgttgattaaaattgatgattaattactctactatttcactactcttaaatgtttgctaaatactgcttttgcaaatgagcctatgttatgccatcctttggtatccttgtgcacttgcatatttgttgtgtggcttgttgagtatatcatatgctcaccttgcaataatcaatcaacctcagttgaagaaaaaggatccagaaggaaaagatgtttggcttataccccagttgagctgcctgtgggagtggagctgaagccatcgctagaccgttaattccgctgttgtttttcttttcttttgtaagtatgtaacgttattattatgatggatttgtatattaaattgtcagtttgtgtacctcggctgatttctggacgagggtattatgcacaaataagttcggaaattactagtgaatttccg

SEQ ID NO: 36598 - DNA, 3208 bp, Oryza sativa
gttgagagaccgacaggggggaagaccgacaaaaagaggacatttaacttttgccagttttaaaagttggtctttaagaatttgtcactcgctgcctataacatgtgtgctcttatgtgtacatatggattagtgctaaattctttatcaccacttgtaaaagtggcaaatacttattctttaaaaagggataattttattttcatggagcaacttaaggttacaggctcagggttcacaattacgacgaaaaccggtcgaattccacgaaatttcgaggtttcgacaaggctcgaaagtagaagccgtctaagatttcgatgagtttcattcaaattcaaatttgaattgataaaaaaggaaacaatcaaataaaatcttataaatggtatgatattcatagaacctattgggatataaattttcaaaagaattaatgtatttcgtgtatttactgaaatttacagtaggaaagaaaagaataacgaattaaaaaaaaggaaaaaattcagtttccctccttttctaattactgattgaaattttgatgatttcgctcggaatttcgccaaagccgaccggttttcgcaagcttatcggtaaattcagggaatttgtattcaaattttgatttatcaaatgtgttcagaatctaccggctttctagcggatttcgcaaaaaccgtcattccgccagagcccgaaacggaaggccatctcggaattgtaaaccctgttacagcactgaaacttgtgtctaacatggtaattcaacctatgtggcatgtgaggttcaagaattatatgtgccgcactactgctgcccttacagtttcatggtgttatctttgttgaaaacaactccatcaatcctaattactcagctgatttatacattttaaaatttatcttgaaataaattaaaatttttgctttttttcctagggagttgctaaaaaaaattggcacaagattttatagctaaaaaactttcaaatataattatagtacaattacacagtttaactataaatgtaactattattataattataattatagtgtaacaacattgcaacttctctatataacttatgtataaagttacatgcacatttttaatacttaagttatataaaatttataatatagttgtcaaaaataattaattatattatagttacatttgaaagtttttcctagacaagttttttatagtccatttacctagtatcatccataagatgttcttttaatacacttacctatccatccattaatatttttctattaataagaggcactttggttttttatactcatcgttaatatttttctcgatattttaagaatttatttttctctactactgtaaatgtaaaagtgaagtcttctcctccaccaccctcgtacctccctcgtcacatagaagattcaccccatgtacaaaaatacagtgtttctattaaaaaaatcaacccaacataaaaagattctgtaaaatcaaaggtgttttttattattattctgtgatgatcaattgggcattggagattattggttttgttatttagaatttattcacgaaatgattttggagatgattggatttcacaggtgatcgtaggattctatcattttatgtgaccggtcggaccgggcagtgtgtgccggtcagaccagcggtgatcgagcggtcggaccggccagcccgcggtctgaccggccaacgctgtgtcggtttcggtttcgggttgttcgtttggatatccgtgattatttcatgattatgacttctagatggatactatacgtatgtaatactgttgtttgctactaatgagtcaagttggagatagcttggtctcggaatatggtttctttgtttatttcatgtgtaggtgactcgatgtctcgggatagtatttgcggtgatggatcgggagtcggcttggggataagacgacgtccgtggtggtcagagattatgcgggatactaaggctagagttgatgcacgtggttgatggagattccatatggtatacgatggaggtattgtgtgcgtatgagatgcggagtcgaatttggaaggagtccaaatttggtatgattggttatgtaaagtttgtgtcttgtactagagggtttcctaaggtgtttaggacttctagtatgagtttggtccgtgactttaggttgcctacctcatgtataaatagagggggagcgtgaggcttcccggtatcgcttttgagagcaattgagttgagttttgagttagggtttccagtttagtcgaaatttttgtaaggagtgttgttggtgcactttgtaaacacagagagaatcaataaagtcgtcatccactttaagagttcttcgatttttgtttaccgggttttagcggtctaaccagcaactcaccagcggttagaccggcgagtacatggcggtcagaccggcggcgacagcaagcgcggcaggcgacttcggcggttcgaccgatcgatctacatcggtcagaccgacgttcatcaggcggtcagaccgcgatccgtcgaatttgagggtaacttttatttccactaaaagttttcggtttttggatataccaaccattcacccccccctctggttggcttagttcctgtgattcgatcctacagattctccttaaaaaactatagagaaaatccatgaattgccatcgacaagcaccctaattccagaaatgccatcaacaaaagcaaacttcccagaaatgccattgcacaagtctctttcttcccaaaaatgccatcacagtcaaactgctattaacatatctccattaagttgtatgaaaagacaatcttacctctatgcaactatttgctcacacagcatcattttgcagtgtgtgctcacacaacattattcatatttctgttagcacgtaaattcacagacattattattttgctatcaatcaaatcatttcagaattaaattcacagaaatcagattcaaaaaaaatttcacacattcgccgcttccggactcactgcacatgcagcaactcagcatttctgcatcgtaagagaaatccaaaagaaacttcacctaccactggtcgtcggcgaggagcgtcgatgcggtggggaagtgagcacagcgagaaagaaaaaaccccgaggccaatgtccactgctcccggttcgcgaggc

SEQ ID NO: 36599 - DNA, 2985 bp, Oryza sativa
gcctccgctgtggaccgccgcgccgccaccgtggactgccgccgagccccgcgccaccgccgctgtggacagcctcgccgccgcctgcaacctcctcgtcgccgctgtggaccgctgccacgccgccgtcgccgagcccccgcaccccgctggaaacccgcctctccctcgccaccgctgtggaccgccgcaccgccgccgtggaccgccgcctcgccgtcgcgtgcaacctcctcgccgccgttgccgagccccgcaccaccgccgccgtggaccgccgcgccgccgccgggagagccgcctggattgggttcggtttagggttagcgttagaaattttcaccgtttcatctttctttttcttttaccgtgaaaactggtatatcctgcactgagggtaaaatggtcattatcaaaaaaaataacggttgtaacggtgtagagttgactatgatggtatttttgggagaaagaggcttgtacaatggtatttctgggaagttgcttttgtcgatggcatttctaggattagagtgcttgtcgatggcatttcatggattttctcaaaactatacaattgttactattggatatatatgaacttgtaggtttcgatacaattgttactattggatatatatgaacttgtaggtttcgatacaattgttactattggatatagtttcgttcggtgaccgctactccctctgtcccaaaaaaactcaacctaggaggggcacaatgaatccttgtccaaattcgttgtcttaggagaggccacatcccctcctagattgagttttttcgggacgtagcgagtagtgcactaagtcaagtgacacattttgtcgttccatgtgtacgggcgctattagggcactcacagtgcgccgtgaattttgttgaattccgtttggcctcggctgccaaacaggactccagaactccaaaagacacaaggtcagcattgcgtttttgcctccaaaaaacgcctgagacgttttccccagtctcgatcgaggccaaagcacgagtagcaaactttggtcatacgcgcttcaatttcgtgagcccaaccaataacatggcagcgaatttttactgtttgcatacgtggaacgctcaggccgaacgcctgcgcacagcactgttgaatggccttaccatgtactccctccctcccacccctcctagtataatgaatcaggactaccctttatccagattcattgttctaagaggggtcacgtccccacccctactaagttgagttttttttgggacggaggaagtacacggcacagaaaaaaagagcacgtacaacacaatatacaggcgaacattatttttattttgttttcataccatatactaatgctaataatgctcacattttattaatcttcttccagttcaggctaacaacaaacagctgctacgctataccaaaaacatatacgaatttgtttctcaatgcaaaagttctttcccgaagagcccagcaatggctcgtccagggtcgtcttgcttgaccagggattctcccaccaaaacctacagcatcaacagacacgcttaaattttcagcgaataggatttgtagaaatgcgaatgaatttcagcaggaacatgcaattttatattgatatattgtagcatatttccttcctatagcatataattttggacgaccacaaatctaacattgactcttgtcattaaggaaaaattcgaggtaaattgacaagtgaaaaccgcacaactagtgagaaaagggaaatctgtactaactaacccaatttctcagatgtttcaacaagtttgtcgaatactgaaatcgtataggactagtttacattaatccacaagtaatttgaaaacttacagcggaaactccagcattttgcacataagcaacgtcatctgggttgaacagccctgattcgccaacaacctgaaaacccatcataagttggataaagaccagcacaaactagcaccctaggtgtttcagcaaacctaactatccaaggaaccaaaagtcaagtcaatatcactacaaaaatttatggataacactaaaccctaacatttcctttgatagtaatgtcatgtgcatgtacattgttacgaacaattggaaaatctcatcctgatataccaacaaaaatcacttatttcttcaatacttctagtagttcatctagaatgcacaacagagtacatataatgctgaatagacaaacaggtcatttcaatcttctattgaacagaatatgtgcttgctggaaaggctaccattaaggatgcatgatctgttacaatactaacaggatataatttgaatctagtctagactactaggttacaaagatccgacacaataaattgtttgtgtatggcaggatattgaatgaacaatagctattgactgaagttgtcttcttttttttttttttttgaaaccgtcagctattgaacgaagtcaatcataaggttatgaattcttagcatttgtaaagattgtgttgatgtaccaaagaatccattctcccatatcattttcctcagcagtatacataaattgcataaagtttacacataaatatatctgacataattaattttctattttccatttgctgtaaaatagactgtcgcaaacattcagtcagtgataacagtagatgcaagttaagaattcaacacaataaaagaacaggcgtccaagtgcctacttgtcatacaaagtcagtaaccatttacctaagattccaatatatagaataacagtactaacatttgattgagttgaacagatgcatgaaaatacaactagtgaattgtcacacattagcatgggatattaccaatattcccttctccctgatggtatcaccatgcatatctagcaacatctttgtgtttgaagtatcgacaacaaatgtttctgcagtgtaaatatttttggaagtaagcaggaaa

SEQ ID NO: 36600 - DNA, 1872 bp, Oryza sativa
caacatgttgggaaaaaagtgagcacaagaaaagtatcataccaaggctgcggttattgatgccaataagctgaactccacttatattcagcacacgctccatctccctttcatcatgaacctaaaataacatcaccggataatagaataaaaattaagcttggatctgtgcagattattagagtgtaatcatttcagttattaactcaaatagtacatgttaacaaaaaaaatctgaaacatcatataagttatggtatttgttttccatataaatgtgaatatgagacttatctccacgaaacatgcttcaccaccactccataggccagtttaaatcccgtttaaatgatgtaagctagttttcaattcatgggaccctccagaattaaaaaaaaaatcattgttacaaaatataaagcagtgactaacctcaataagagctgtcattcccaactccttacatatgcgaaggaagtactttatgtcgagatcaggtagcacagcggcaataagcagaattgcatctgcgccctgagagcgggcataatagatctgccatttatcgatgacaaactctttgcataggagagggcactgcatttacacaagatatgtacatcttgagaaaaaaaatggtaatacacaagcattgtcttcatgtttaaataacacatatatcaaccaataccttcactcctgacttccgcacctttgcgagattttcaaaacttccctatcaaataaaagaaagaattagcttagaccagtaaaagtacatgttccaattccaaatccattaacacatccaattccaaagccacctgaaaatacttctcatcggtcaagatgctcaagcatgcagcaccattcttttcataagcctgagcaatttcaacctgcaacaaatttcacactagttatgtaaccaagctttgaagtagcagcgaaaatgacaactaagaagccaaaatctcacaggattgaagttctccctgagcacacccctacttggcgatgccttcttgacctcagcgatcaacgctggcataccattgcgcttgaaggctgatgctaaagcaccgtagaagtctcttgcaggaggagcctgccctgcagcctcaatcacctccttgagaggcttcttggcatgcccctgcacaagaccagtaacagcaatcagccattgtacgaagtatcaagaatgaactacagaaatcgtttctccaaacaatattagaaacagacacaagcatgtcatttggcgtccaggtacacaattttatttttaggtaatattcccttgccattaattagaagaaccacaaactgagcacatcttccgagggatatcaaatattaagatgaaaaaaaagaaaagattaagcatcaaaaattctcctgcaccttgatcttgaacatcaagtatcaacagcatagctaatgaatgagtgtgatttgtaccaaactaaattattgaggtaattgatttgggtttatggttatatacatacctcggctacctcaacctccttgtcccaaatgatcttctccaggatgttgcggggagcacccagctcctcctcgatctccttcaaggggacattgggacggcagtgcctgcggatgcggatcccttgactagccgctatgtcgttgatcgacttgccgttctcccactgcgctagctccaccgcgttcaccatgtcgtcctgcgctagctcctcgagtatggagtccttagagaaaaatggaggagcatttcaagaaacgacggatataaacaggaaacaagaaatactccgaaatggcgctcaaaagagggcaaaaaaaacaccatgtagacttcgaatccgtgctcaagaaatgggg

SEQ ID NO: 36601 - DNA, 3481 bp, Oryza sativa
gcgcagggaaaggaaagccctgtagacagagggcgaggcgaggagggactccatcgcacgaggagcacgaggtgggtgggtgggtgggagggttggtgggatacggatacgacgacggggaagagccggcggcgatggggtgtctctcctcgtcgcaggagaatggggttttgattttataagccaaggcgggggaggtggcgacggcggttagcacaattcgcagaggcagcgacggtccgaggccggagctgaccgacgtgacggggcagtgatgaaagcgatgcccacaagacacggacccgttcccaacttggcctcccctgggcctgcctcgtgttctctcgctcttttcgttcctttttttcatattatttcataaacaaacaaaatactagtaaattatttttaaaaggtcctacatctatcctaaaatatacagtccgtattaaattttaaaatgaaggtaattttgtcttttactcagtccatccatcaagttagaaatattgtatcctcaagttacaatattttgaaatgttgatcataaataacttatgagatgctttctctaaaattaaataaaatgcatgtatagatttatcttaaaaaaattatactatcatagtatgattcacttatttaattttataaactcgttttaatatcaaattattggtcaaattttaaatgttttcataaaattttatcctaaataataaacatttatgggaagtatactatatttttctgcagcataaatattaactaggaaagctagattttttgtgtaggtttcatccctatatatagtcatagcttattcatcaggttattaaaatgaattatttgctatatgcatcgaaaaatatgttttctaacaaaataaagcataacaataatagtcgtgaaacggattattcatgtttgcattataatatgctaaaagtggatgttgtaatatgctacgtactccaagccaaccctaggatgcaaatcaacatattggtttattgaaccaacgtggtacctaagaacatggccaataaagactatcagcggtctcaacatgtcatatactagataatatcccgcgctttgctgcgggatttatgaatgagtatatgttaaatactattgaaatgataaaagctaaaaagttgagaaaataatgtgagaaagatgattaacacatacttgtttatctctataatataatattgtagatgatatgctatgcttgtatgggatttaaaatatactagaataatagtaattgctagtgagtgaagatgtggcatacttgcatgggattttaaatgggctagaatagtaattgctagtgggtgatgatgtgacatgtttgcatgttgagctttagcttctaataattgttaatgggtaccaactatatagaatgtatagataggataaagccacaataaagaccacttaaaggtatattttgcgttttagtccttaattattttttgtcaaaccttatagtactatttttattaccaaatcaactaaaacttttatattttagaccttacaacaataaaaatatatatatatatatatatactcctaacctctatatggacccagcgcaaacctctccccccatcttctttttctctcccttatcccactctctttctattccgccaccatccatggatcctcttctcttgacagtaacatcttctcagccactaatgtcaccttctcttccaccgttgtaatgccgcctctcccccatctccttatctatgagcgatggcaaatgatcctcacagcgacggcggatctggccgcaagctcactagcctttcccccctccccttctctacgagtggtggcggaggatccccacggcagcgacagacttggtcgcgagctcacaggacctgcagtggcgaggagcaacgactatctcgctgagagccctcaacagtagtggtgagcggtgacaacctcggttacagcaagcagctacaaccacaacaagtccggttctgtttctcttttctcccgaaagcgtgtcgcggggctccggacttgcccaaatacgtggcccgaagtaggggtggaaagaagccgaacctagccaggcttggctcggctgctggaagctcgcgaaagccaggctcggcttggctcggctcggttctccaaccgagctatacattaggctcggctcggctcgtgggctggctcgagccggctcgagctggctcgtgagctttgcaatagcagcagttgtattgccagcagcagttgtgttgctttgcaatgacttggttattcagataataactctcaagtccctacaaagataattaggtatattgtatgcagccaacatataacaaattgatggggttttttggttttcggccagaagtctttctattcaaaccgagcctactaagctcgtgagctgctcgcgagctggctcgggctcggctcggttcacaaacgagctaaaacccaggctcgggctcggctcgtttaggattcgagccgagccgagccaggcgagcccgagccgagcttgagccgagttcacgagcccgagctatttgtccagccctagccccgagctgtgtctttgtagctcccgacccgaggcacgacaaggcaaccagaacctctgtaggtcgtgcatggtgtcgtgagaccttggtccctaccgccacgagcgtttaggtccgacatggaggctcgagaccactttatacagtggtgcattgagtatggccttaagcatggaggatcagaggagctcagcagtaagatgagtactagcacatgattgatcagcagtaagatgagtccttctagcacatgattgatcacagtgcttggtgagaacctgcggttgtgcaacacatataaaagagtaaagtacatgttcgacagaaatcactcgtatcctcgtactcataaaatgcagaataagcaaactagtgtttttctgttcagcactagtccaaattagtagtcctaacccattctgtgagctgaaatggcattgcgtaatttggtgattgatgaaacatgttcttgcaccatagtccataaatattggtacttggtaaagaggagttcccagccattcaccatgtggttttttcaggtaatctcagatcatgtgtccatgctttaatttgtttgttcgtgggcaaacaagggatgaggcggccaggctgcgtttgcaacccctttccaaaccgctctcccacgttttcaaactgttaaacaatacgttttttaaaaaaaaaaattttatacgaaaattgtttaaaaaatcaaattaatccatttttttaaaaaaattagttaatacttaattaatcacgcgctaatgaatcgctccgttttccgtgcaaggtgttggtgttgggagtcaggggtggtgaacacacctggcagtgatcgaaagagtgaattcccaacactcccctctcgtttt

SEQ ID NO: 36602 - DNA, 16697 bp, Oryza sativa
cggtgagtttaatttcttgtttgtaagcttcaaatgattttctcataaatcattttgtaattaaatccgattaacactgttttattcattatagttaaatcatcttcggtgattatattttactgaaaaaaatttaaatcatcttcggtgacaagtgagccgcataaaattttagcttatctcaaccatgttacatctctccaatgaatataatctactctggataacttcattgacaatgttctagcttatgcaatttagtatctctttccactggtagacgactagacgtcatcaatataatctcgatatgaagttgtcaaactatcccaaagcagtaacatgtatataagcattttacagtgtgtaactgtggccattacgcactacggacaagtttagcttagatccatggcttcgccacctagttcgaccttgtactccaatccgcaacggcattttactgcatcagaaactccctacaggacaaggagatgatcagctaatcaccactgctcaaagtagcttcaccactccctatcggcagcatagtatggataaggtaaccaaactagatagcatcagcgtaccttcatttcatttatacgttcttcaagagactgaaagtactcaatttctccagctttatcagcttgtagagctttgtgttcctcctctaaggatttcatatccatctgttgtagtggagcctgcaagcaccagagttatacaacatcacaaatgagaattaaaaacaatgttagaatggtagaagagcgtgcctaaacatacaagaaagccagaaattgcatttttctcttgctctatgacctgcttactctgaaaagtaaagacataatcctttcagtttcacccaaaaataggcataatacaacttgcagatgtcatagatctaaggatgggtgtcagaattggagtacttcgctgatttccgtaagaagtgctgattgtttttctttgatctcgtcgatcttatgtttagttgactccagttgaatcctgagttctccttgcttgcttccaatgtcatttccctgtttattagttagtgacactctggatcatttttaagaggatgggatgagatattaatcaccttatctaggctcccacatgagttaagtattccatggctttgtcctgcatacaaacaacacaaccaagtcaatgtaaagttgtaaaaattgttcatcattataacttaacacaagatttctctatgtcatccaatgtttagacacgctacaaggcagagactgctaatctaacacaatgaaaaaaaattctcaattttagtgatgcagcccaatcagttctaaccatatcaattggtgcttttagattaacaaaggttggcactgtactgagactctgggagggagggtggtgaggaagactgtccagaaaagaagattgcagaaacttctactccatgctcaccagttaatcaaaaaggaggaattagttagatatgtaaataaacattatatgattttgttatagcctttgtaaagagagcatatgatgcaaaaatgagtgggggaggacctcatcaatcaatgatttctagaataaacagtggtttggccagaaaagggcaggtgcatatgcctgagctgaatacataggagaatggacttcgctattccttcttgatcaacacttaacctgatccctctttatacaaggtcggcttcctaataatctaagctacgtatagtaatcaaatattaatttaggtatctaaatttcatgccaacttttagatagaaatgctatgcaatttatagaagtctccagaatccagatatcttcttatcaattggtgccacttccacacaaagcctgaactggtgcagctgcacatcggctcctcctttgatactaccaaagtcaaagtataacagcttttagttctaatccacatgtgcataataaatctacaagtctgaaatttcacagattgagccaggaagtgtaactcatgcccccaacttccaagaattgcaatcagtgcaaatgcatttgtcatatgtcatatgtgtacttgtgtagggcatgcacatattaaaagcatgcagtctgctttgcttcatggccttcctcagcacctttcatggtagctaactcagaaacacagattgatgcaattagaactgactggactgcacaataacatgtttcaactatataatgaaaaaaaaaaactgcacaatcaacataccacatattgacgcttaccaacatggatacagaaaacccatgaaaggacttaagtaagataggaaaaaatagcattggagccactatttatttcacttcatattcagaagagctgtaccttgaaggttttgcttgctctgagactcttcaacctgaaagtgtattataacacactaattaaacagtagttgcttcattgtaacagggcattgaaatgaggagcagaggttacaagatgatatcattgaaaaacaagtgatcctatctgctcgaaatacttgcagactacatgttgaatatcaagcggaagctccctgattttaataagcatggttgagataagggcccttaggcctgattgaggtgtatctggacagctggacccaagtagcgacagcactaagggcaggggagaagagggagagatcaaagacttgtctgttgttttggttaatatatagacacgagcctacacttaccaatataaatgagatcagttgatccttgacaacttacctgtaattcaactccaatctgaacaggctttgtgaacagtaaccacacgtgaacagtaccatgggtactgatcatgtacacattgttgcgggccctagagagattgattacctcttaaatatgggcctaatgggtgacacatggcactgataaaattaagatgacttgataatttgtccaaatattccagaattattttccttttacacaagacttgggttgtcattaataaacacaatggttatgatgctcaaattaacttttactttggtaagtggttgccttatggtacagagaatttttagttactggtgttcctggtggggcatatatactatatacctcatgcaacttattagtagcataattggtgaagtgaatttataaatagtccacccaagtattaaacaacatttgttgcttctgttctctgaagttctattggaaatttggattttgggtaggataccagtactggaataaactggctaatatatttttgaatttgaatttaaaattcaaatttgaaatttataaaattgctatagcctcatgtgtcacctttatgccatcacatatgcaatagccaaaagaaaatttattatgtcttcagctcatgctaattgtgcaatgacctctagacatatatatatgtgtgaaaatgtgttatatttgcgctatggactctagtgatatatgtatctatgtgctatatcatgtataatgttcatctctaattggctcatgtattatgttgatctataatttgttatggattcatgcatcatgttcatttggaactataagattgcactaattactatacacaattttccagatggatactgttttcaaattaaatgtttggacctgaatttttctccgagtaaatctggtaaatggacagttctggcgaataccagtatttcataccttgtcattactagctggctcaaaacaagtactagtgtaccacagtattaaacaaaagggcaataagcaataacagaacttatctccctccgtcccaaaatgtaagcatttttagctatgaatctgggcaactgtgtgtccaaattcatagccaaaagttgctatattttgggacggaggtagtagtaacttgcagtaacagtatacatataagtttctttacttacataaaaataatcacaagaaaggaaaacaatttcttcaaattacagtaacatatgcgtaaggcttacagatggttcaattgtaatcaccttaagcttaaatgcaccaagccattcctgtgaaagaatggaaagtgttacagcaatggaatgataaatctggtatacttcctcatggaacataaaactgactagaaaagataaacataggactaaaaaaatatgttaacctgttgctcttgtaatttgaccgtcaggctttctattgtctttgtgtagaacaatctgtcatgagagcagaattagcgtaactacgatttacagtacatccttttgagagcacaggctacaccttttctcaatgagttttgaagaagtacttgcgatttcctgatggaggagctccaaggtctgcaagtacaatggaggaatgaagacagaagtctgactgagaatttatgaagttagatagacaaaaacaaaaacagcaaacaaaaaatgtccagatgataagaaagatgcacggcatacagaattttggattatactactgttacaaaagtctaatatcagagggccttctggggccttcctgctatatgaaattttcatgtgttgtgggactgggctagggtaagagtctaggctgttacgcccttttgatgagctataaagaccctaaggctgcgttcgtttgggtgatagggagtgagaatgcacattgttttccgcggacacgcttcccaaactattaaacggtgtgttttttgcaaaaattttctatatgaaagttgctttaaaaaatcatattaatccatttttgaaatttaaaatagttaatactcaattaatcatgagctaatggttcacctcgttttgcgtatcttcccaatctcctcaatccccttttcctcaaacacaccctaagacttattgggcgtttggagttttggactatccgtagagattgattgattaatggaagtagatatatatccatccttatatggcatatctttaatattacggaaaagatgattctaaccgatctaatcttatcaaaactaattcgtggcatagtaattacataaacaatatgtggtgcaccgatgttacactacacatgtgaacaatacccgagcccataccttaggcctcttcttttataagctcatcacaacacgaaaatcaatgggaaattttacataggatacaataaataccagtgttctaaaagacagcactaggcgccagatagctgccactattaggcaatagatggtgcattaggtcactgaactaccttgggaggtaaacatgtttgaactggtagcagtaacagttggttttacaacttatccctcctctcatatcctgttctcatatcctgtcaaacaaaacaaatcgcgctgataggttggctcttcatcctctccatggatataaaatactcgtccagttaaaatggcataaaaactcatgcatgatcagaaaagttattcaatatgctccaatatatagaaaatcagaaaagttatttctggggaaagtaatgctgtagagttagaaagagattttcagtatattttttcagattagaagcaaaatatagagaaacgtggtttgagttttcaaaacacaatctcagtacacaaaatacttgtcaaaccaaagaaaataaatacttatcatcattgtcatttccatatgccacaaactttttgtaacttctaaagaaatatgcctcataacggtttatggtaagctcactaatgtagtagtgggtattgtgaaaggttgtagaagtattagcatatgtgagaagtgtgccaaagttagtgacaacaaaatttttcccttgtctctaacaattggcacattttgttcagattaaactgacaactgttcacagacagatctaactagtaaatgtagctctctattggttaggaacgaatagtcatatgacgaacagagcatgcaagtatggtggagctccaatgcatctgtttatgtatgaactttaaaagtgtcatttagaacattaagcacaacaatgtttaccacattcaattgaaaaggcaataacataaatacttgatgaccagtttcagaatcaccaaacatcaaattatcttgcttgtcattcattctacacggctaaaaatttgggcattacaagaactatagttttgtaacctccaggaaagtgatgcaccaaatggaatcaaatattaaattagaaaagcaggaaattcgtcccaaatgggataaaatttcgactctacagcaggcaggtgaataaaactttcagctctctaatgttaaacagcatttaattgtatagacctaaaatggtttatggacgtttcatccacgatagacgaaaattggtactacatccaaggcaccaaaaaaactcattgaatgtgaaacgactggcaccaagcagagcactagaattagaatgatcagtaccgggactaatcacctgcttcagcgtggcgcactcaatctccagcgtggcaatcctgccctgcttctcggatatctctacgcagagctccgccctcgccttcgaaagctgctcggactcctcgctagcctgcttcgtctgcgccctcactacccaaccaaaaaccccatagcacgagaaggcgttaccggaggaaagaggcagaagcagggccaaaggggctgggcgccctaggggtggggggaccttgggcgaggtcggcgccgtgggcgtcgatggcagtgcgctgccgctgctcctccgccgaccgcttcgtcgcttcctcctccagatctgcaagaccaacaaaacgaaacaggcggaattcagggagggatgtggattttgggggatcgcagcgcaggacgcaccgctcatgtaggagcggagggtcttcatgttagccaggtactcctccatggctggtccgccggagtggtggagcggaacggaggagaatacgacggcggcggcggcgaggagaggatggagacgcggcggaggagagtatgggcgagcgagagagcgctctcgaggtttccgttggaagtgaggtttatgcttttatccaaccctcgagaaaagaatttaagatcatgtacttacctccgtttatgatgtatagcttcatcaggagatcgctaagtatttttttccaccacttttttttcacgatatagtttttattttcggataagattatatacctaaagtatatgcctataaagtttatacatattttataggttaaaattttatatacccgatcaaatttaaatttggatttaaatattcttatatagaatatttctatacataaagttatattataaatcaaagtctatacacatgaatatatttttaagggtattagattttatttactcttttttatatatatttttaatattttaaatttatgatataataggaagggaagaaggagaagtagcgtacgcaccaagaggagggacgggggatgattgtacgtaccaggaggagggacgggggatgattgttctgggttatcacccacccattagccctccccgcttcatcatcttttttctcaaactatccttaaactttgattaacacatcgtcctattgagtacaattttacatttgactatttatattttttttaagagaaaccatttattgatgagctcgatgttttatattttattattgagactagcaattatgtcagagtgttagaacgggaagaaaaatcgataaagttagacagggaaagagagagaattgttgacaaaaagccgagtataataagttgatataatacaaattaccaaagactagtcatttaagaattaacatatgcatgtctttagcatgatagtaacaatgctaacaatgtggggggataatgcaaactactaccaccttttttaataaatgacaccgttgactttttgtcacacgtttgaccatttgttttattcaaaacatttacgtaattattttttgtgagttgttttatcacttaaaatacttttagcatgatttatatcttatagatttgcataaattttttaaataagataaatagtcaaacatgtgacaaaaggttaacgaccgtaatctattaaaaaatatattaaaaaatagagggagtacttgtctttttacttacaattcagtggcttaaaaataacaagtttggtaactggtaagtagaattacccctgagtcttttcataaactaagggtgtgttcggcaccacatgttctcaactcttctccctcgtgttccgcacgcacgctttttaaactgttaaacgatgtgttttttgtaaaaagtttctatacgaaagttgtttaaaaaaatcatattgatccattttatttttaaaaaatagctaatacttaattaattacgcgctaattaaaaaaagaaaatgcaaactgggagagagagagagtgaagagaggaaggggaggtatgacaagtgggtcccatatttttaaaaagaaaatacttactagattgccacgcgtacgccacgtaggacaaaaccgctctggattaggtcgaggggagtgattcgtccggtattgaaagttcagggtgagcaatgtctgtttttcaagtttagggggtaattcggtcgaccgcgatagtttagtgggtaattcatacttttttaaaaaaaaacacatgatagataactctcgtactcgtattattctggttgttcacagagtacaaaactatctatagacagcaaagctatatatagcttttgaccgttagaaatatgtggggtcgtacgagattctcaagcaaggcgagcagaatttcagaagctgacgaggaaaacagaacaaaacaggggagaaacaagcctacagatgatggctcggtctatcccgccggagtccggtgacgagaacgtctcggcttctgccgatggtgtgtatgcctccttgttcattctctgcatgaattgcctttcctacactgggaatgcaaatgaaattctctcgtggtagaagatcgaaattaagctactagctagtttctcttggagaatgaaatcaacaacagttttcttccacttcccatttgttcgtgcaaaattgctgctaaaatatttaacgattttactcatgtttctttttttttccccaatggaatctgaacggctcagtgttgctttgctaaaaacatgagggtttgagaacttctctcgcaaagacatgcaggcggcctattttagggacagaagatgacaaaagaacatcaaggaagagggcgtacgtgtagagaaagacggtgaaatattttgccagccagccggccggccggagtccgacgatcgagcacattccgatggacactgcaggcggtacaacaaaccacgcctaaaacctcctttacttgtaagtcatcgtcgcaaagttctaccacaaacaagtgaaacgcattgatcgtcaatttcgtaaaaacacttcaaatgcatagatcataagctttcaaatctcggttgcatatcgtttgctggttagtttgttagccatagtcaagatttgaattttgaaactttacttgggagttctttttcatcgtaatctatttttagcattagcttttaaactgcaaacaaatagatataaaaagttgtgattagttcattttggaatttgggattatttcattcaattttgggtcattagaggaaacacttttaatcatttagatggacatccacccatttgttgcctgtcaaattaaatgattatgatttttttttaaaaaaatggataagatatattaatacttcctctatttcacaatgataagatatattagggtgccatcatttggcatattggtggaataagctaaacggtatatttgcaaatgaaaagtaatttgtgaataaaatttttatatatgtgttattagcgatctaaaagcaaaggctgaaaaataaccttcaatgaaaaaaccctaaaatcagcttcaaatttaatattgaaaattcaaattttggctgataagcatatgaatatgccaaacgatggagacctaatacgttccgttccacaatgaatctagacatatagcattgcctacattcatatagatataaagaatctagacacatatttgtctagattcattagagtatctatatgaatgtgaacagtgctagaaaagtcttacaatatgaaatagggggagtacataatatgtcacttcataaacatacaagtttaaatttgacttctatgagttctaacaaaaacataaaaaattaactctaattagtatacgtatatactcacagttaaatttgtttttcttacaactcgtaaaagttaaatttgaacttgtttgtttaagtgaatattcatattaatctatcttatcttgtcaattgttttgatttattattttgtaattatctagttgacatgtaataaatatatgaacatatccaaccgaatgattaaaagccctctccgggttatcagccataatcactatcagagttttgtgtgtgtgtgtgtgcgcactgcagaggagggcatggaggaggaggtgaacgaccacccgatcgaggaggtccggaacacggtgccggtgaccgacgacccgtcggagccgtgcctgacgttccgggtgtgggtgctggggctctcgtcgtgcgtgttcctcgccttcgtcaacgagttcttcatgtaccggaccacgcagctgagcatcggcacggtggtggtgcaaatcatcacgctgcccatcggccgcctcatggcgtcgacgctgccggcgaggcgcctccgcgtcggcggctggtccttctccctcaacccggggcccttcagcctcaaggagcattgcctcatcatcatcttcgccggcgccggcgccagcggcgtctatgccatgaacatcatcgccatcgtcaaggtgttctacaagcgccagatcagcccctacgccgccatgctgctcgcccagaccacccaggttgccactcatgcattggttgattagtaacaaatcgaagacctgatcaaacacacattgattaatccaaaaatggccttttatttgatttcatacagttgcttgggtatggatgggccggattgttcaggaagtacctggttgactcagcctacatgtggtggccgtcaaacctcgtccaagtcaccctcttcaggtaatggtactaattaccagcagttattttgtcgaaatatttgtttctgaaaaatatatgatgcaaatggggaatgggcaaacacaaactttattttgagcattttttttttttgcggggaaacttataagcaaaatttggaatgtttgtcacgcagggcgatgcacgaggaggagaagaggaacaaggggcagctgacgcggctgcagttcttcatcatggtgatgacgtgcagcttcgcctactatatcgtacccagctacctgttcccggcgatcagcaccatctcggtgctgtgctggctgtacagggactcggtgacggcgcagcagatcggctccggcgcctcgggcctcggcgtcggctccttcggcctcgactggaacaccgtggtgggcttcctcggcaacccgctggcgtcgccggcgttcgccatcttcaacgtcatggccggcttcgcgctcagcacctacgtcgccgtgccgatcctctactggaccgacacctacaacgccaagcgcttcccgctcgtgtcgtcgcacgtcttcaacgccgccggcggccgctacgacaccgcccgcatcctcgacccggccaccttcacgctcaacctcagggagtacgacgcctacggccgcatcaacctcagcatcctcttcgccatcaactacggcatcggcttcgcgggcctcatgtccacgctctcccacgtcgcgctctaccacggcaagcaagttttcccgcacaagctcttgctaacttagtactcccgtcagtcataaatatttgatatgtttatgacaagattcagctaaccagcttgcaaaacttttgacttcaatttgttcgagcagggacatttggggcttgtggcggaaggcaacggcggagcaggcgaacggcggcggcaaggagcgccaagacgtgcacacgagaatcatgaagaggaactacaaggccgtgccacagtggtggtttcacttgatgctggccatcgtgatggcattgtcgctgtacacctgtgaggggtttggccggcagcttcagctgccatactggggtctcctccttgcctgtgccatcgccttcaccttcacgttgcccatcggcgtcatctctgccacgaccaacatggtcagcacaagtagaattactttctctttcagccttgaattaacgttaactaagctagtatagtagtaaattgcattattgttggttggttgtttctttcagcaaccagggttaaacatcatcacagagctcatcatcgggtacctgtacccggggaagccattggcgaatgtggtgttcaagacctacggctacataagcatgactcaggcgctgacgtttgtgtcggatttcaagctggggcactacatgaagataccgcccaggtccatgttcatggtgcagctggcagggacggtggtggcgtcgacggtgcacttcgcgacggcgtggtggctgctgacgacggtgaggaacatctgcgacgtggacagcctgccgctggggagcccgtggacgtgccccggcgaggacgtcttctacaacgcctccatcatctggggcgtcgtcggaccgctccggatgtttggccgtctcggcaactactggcagatgaactacttcttcctcgtcggcgtcctcgcgccggtgcccgtctggctgctgtcgcgccggtacccgcgcagcgcgttgctccgggacatcaacctgccgctcgtcctcgccggcgccagcgggctgctcccggcgaggtccgtcaacttcgtcatgtgggggctcgtcgggttcgtgttcaaccacgtcgtgtaccgccggtgcagggcgtggtggatgcggcataactacgtgctcgccgcggggctcgacgccggcgtcgccttcatgggcgtgctcaccttcgtctcgctaggatacttcgacatatacggggtgcagtggtggggtggcgccgccgatgatcactgccccttggcgtcgtgccccacagcacctggggtgtttgccaggggatgcccgcctgtaccttcttgattgatcaggacaccgcatctacatgtatatactccatatgacagatggttactcaaatgtatatattatatcctcttgtcttcctctcttttgccccctcctcttcatacactgtagatccaatggtcgccactcgccagccggcagtggtcacggcctcaccggtgcattacacctgcaatgcaaagtggctatgagcctatgaaggtgtcagtttcttagacagcgagccatgctcgcatgtgcctctttccgcctgcctgcttggatcctaatctggtcggtctttgtgctgtcctctggtctctggttgctattggcacaaattgaggacttttggttgtgtgttgcaaggcttcatgtgaaaatatagctcaaagccagtagggatgacctcgagaggcatcggttccttatgggatggttaataaggttctctttgatcttgccccattatgtctcattgggtgaaaaacaatgattcagcttatcagaccgaatgacaacgctgagtattggccttacatcatgttggttttcgccttagaatccattaaaacctatatctctggacaactgttaaaactcaaaaattctcggtttgtgattacgcttatccactgaacaaaattttaagctccggtccaacaaaaatacctcgaggtatcagtacctcacggtaccaaattgtttccgtgggtgagggctggatcgacagaggcggcggtgtgcggagagaggggaagagaaaaaggaaggaggaggtggctaccttgtgacggcgcgggaatttggatcggcggcgatggcagtgggagaggggaagacagagagaaagagaaaagggggcatcgacggatgaggatttgggagcggggaggtgagcttggggtggtgtagcgaacagcgaagctcgccggcctttttataggcaagcgtcggcgctatagacgcgggagaggcggttgcgcagctcccagtgcggcatggatgtgttggccgtggcagcgacgtagtgaacacttggtgcaggtggcagcaccatgatgttgcggggcaacgcggggaagatgggacacagggaggctgcgatgcgacgtgacgaggatgggttgaatttaacggcgcccttttcgccgcccaattggtcaccaccagctatttaagtgacgcgcctccagtggcgtcactgtccttctcccgtcctcccccctcccccacacaaaatccaagccgttcacatgactcctatcctccactctttgctctagtgtcttccgttcacatcgccggaatgcgctcgcctgcctccacgtcgcgtggcgtcggtaggagttggtcgccaaccgccacgccgcgctcgacatggggctaatcatggggggaaacctcctccaggccgacctcgaggccaccaaatagcgcgcatcatcgccaaccccgatgaaggcagcgacgcggaggctatcgatgagtagacccggtcatcgtttctctcccgcaacagcacggccctccgccgtcgctcggctcctgctcctgtccctctgcaaacgaagagaaaggagagggaaagagagatagaagggagagagagaggaggaagaaggaaatgatagaggatggcatgtagggtcccaacatgacagtgtgtcccacaattatttgtgtgaacaacaaatgggtcttacatattcttttaattttaataccacataagtgccacgtcagcgtcacgttggatgaatactaggtcaacaccgccacgtaagcgctacataagcaaaaccgccctctaaaaccgtcaagggggtcaaattgcaccggttttaatagttgaatgatctgagatatccagtattgtagttcagggagcgccatgcgaagttacaactggacatgcaagacaacatagatcaatggaaagctgacgaatatagctatagtaggggaagtagtctatcttctccaccaagctgatattctagggttttgctggctatagcaattgattacgcaactacgtacaaatacttaattaatcacatgctaatggaccgctccgttttccgtgcgtactgtttaggcggggaaccgactagagcgaacacaacctaagagcaagtagtaattagatgagtagtgaaggtcagtagaaaaaagtgaacggtcgagggttatgattagttggacagagaatgttagtggagaagttatattttagaacaaatactataggctaaaagttattatattttaggatggagtaactactatatgagttggttgagaggttatcagattgtataactgcagacaccttataagatatttcctccatttcatattataagactttctagcattgtccgcattcatatagatattaatgatctagacatatatgtgaatagattcattaacattactcttcgtttcacaatgtaaatcattctagcatttcgtagattcattaacatcaatatgaatgtgcgaaatactagaatgatttacattgtgaaacgaaggaagtatatgaacgtgaacaatactagaaaatcttataatatgaaacgaagggaataatctatacttgggtcctatagtgtatagcttggttcaattggtacacgtgcagtgtgaacatctttggaataatagtgtattctgcatctcaccatgtctccagttaatatagtgcaatttaaatcaaaccagatactaatgaactacaccggctgaaaatgcaattataccaaactagtttatccgaagactactgagccctgcaaggaaaatatgcaacgatatatggtagccatatagcacccaagaagtcagcattcattagcctatagcacccaaccaacctacaaaattgccagcgcagaaaattgatacgcatacaaattaagatgcaagctgacctcaatggacactaatgattacgaaatttttaactaagaacagaagaaaaacgatgatatactactatgaattcaagatacttcatcgccatcatatcaagcctatgataggaaagatccacagaaaatatgctccagttgcatctcaaatcgactaaatacgagctaaactaacagccatagtgactttgctatctaatcaaagcatatgtgcgatctcttgaattctaaacactgaaaaagtgattttaaattctacaagccaatctaacaggagtcaggagtggtacagcaaccttagcagagccaatctaacaggcgtacataaaccttagcagagccaaatctagcaggagaggtacataaccttagcagattaaacttcaactcttcttttctagctgcagataatttatcttgccttgtctagtaccgaccttctgcaagcttatctaacacacacatggcagcatctgaagctgtctaccttgcatatggatgataacgaccagaagcaccagcaccactgctaccatagcctcctctagcaccatagagtccacccgtgccaaagccaacaccagcaccaggacct

SEQ ID NO: 36603 - DNA, 740 bp, Oryza sativa
tcattttccgccgctggtcgtcgctgccccctccggtaaggactccctcccccttcctttccttccccatcccgcgtgcgccgtcgcttttggtcacgccgctgctccggctatgcgccgccgccttcgcgccgtctgccgccgccggtcgccgccggtggtcgtgcacgctgccgcctctagccatggccggccagccggctttgaagccgagccgagcccggcggctgctccctgcgccgtccgatcggcccgaggccgattcggaccgtcggtcccgtggaccggcggtggactacccgcgtggtcccggtccatggtggactggccgctttgtgccgctgacccatggggcccacgtgccggcaccccctccctctccccttgcaccactgacatgcgggccccgcatgtcggcgccgcccgctccctttgatgacgtcggccctgggcatttattgcgcaataattcaattaaggattttttctgtttatagtaaaaacacagcgaatcttctaaaattcataactaattcatccgagctccgtttaagcccattaaagtctcagtaaatcaagaaaaatgtgtagaatccattaaaaatagttttgttctctgtttcagtagtcttatagcctgtttgtattgtttgctttgtatgtcgcttagattccggttcttccgacgctccggtgtacttcgagatagtcgccgaggttcctccaacagcagagcaagg

SEQ ID NO: 36604 - DNA, 1109 bp, Oryza sativa
aacatgctttggacctatctactttttagggaccatctcagattcaagaactggttagaggtacacatgcgttgcagatgtgttgtagtgaatcagacaagataaatagacacaaaacagcataagcatagagttacttacgcataaatggtgtttcctttttccgaaatctccgaaggaaacatcgaagtgcatgatatgatccagtgaatcctccaaaaagtaatcctacccggcaagcttcctccctcactattagatctttctccgaaaccagttgctgcaaattagaaaagaaagttatatcaatgacatcttatttgaactttgtagtatactagtagtagaacagtaaatatttgtcagaaagggaagtttgggaactggaccaattattttattttttaaccttttcttagtaatattttaaaaataaaccatccagtattttgttttaaatgaacctttcggccatgtcacggctgatggcaaggcaaaacagtgaaaacacatgctacaccatatgctattatctcggtgtggcagaggttatttttcaaacattattaacaaaaggttcaaaactttttttaagaaaaaaaaatcatactggatagcctcacaacagggatcgaaccatttaatgcatagcaagaaacatccctccaacaggttatttgatgtgcttcaaacactaccagctggtcctacacaagtactactagtaccagctcattaccagttcaccactaactattcaagtaaatgaacatagagcaatagatgtaacatcacaatcaagaccagcataatatgtgaccctgtcctttgctaacacatttgcacgccctaatgtgcgtgtgtccaagctccaacagttaagcaccaaaacccccaattccactccaattagccaaccgaaacaagatgaagtaaattcgcacagccgaatcccagttcccggccaaattctccgaataattccgtccaaactaaactaatctaatatggggcgcagttgagcactaaccgaaagaaatttgcaaattcaggtaggaggagaggagcaaggaggaccttgaggtcgaggagggaggagtaggatctgc

SEQ ID NO: 36605 - DNA, 482 bp, Oryza sativa
cttcggtttctcaccctcagagtaacggacaggtcgagagggctagagagggctaacggtatagtactacaagggatcaagacccgtgtctacgataggctcatgtcacatgacaagaagtgggtcgaagagctcccctcggtactatgggtcgtgcgcaccacaccgacaacgtccaacaaagagaaacccttcttcctcgtgtacggctcgaaggccatgctccctaccaagttatgtcatcagagtacacgactacagaagtactccgacgaggatcaggaggaacagcgaaacgacgacatgaacctactcgaagaacatcaagaacgggtcgccgtcagagcagctagctaccaacaggccctacgccgatgtcacgagaagcgcatccgagcacgcatactttcgatcggcgattacgtcctccgacgagttcaaagccaggcagggcgaaacaaactctcacccaaatgggaagg

SEQ ID NO: 36606 - DNA, 558 bp, Oryza sativa
tttttgggataattacgacctgattttgtttcgatgacttgctctcgcctgttctactaccattgcaagcctgtgctgtgcatatcatttttttttcaaaaaataagtgttttggtttctcttaagtacggcattgggatattcttcatttgaaaaacagcagcaatttctgatttcttaacatcaccacatagtttgaacacaggatgtgtaccgtaccaaaagtggattttaatcttgacgactacactctccacataagagaattcatcagaagctagaaacagaacggcttttgtgttttgtcatttgatccaagcgtaaactcaggatggaaaactggaaccagaaaacttcgactttgtaggctcggagaaaaatattcactattacaaaaatccatgcaggagtcaagttaaaagaagaaacagggttctgtctttgagatggagtataatttatttaagatcattccctccatcccatcatccatgagtttgcaaacttcagctcacattctaaaaatgaagatgccaaagagagagaagggacagcaac

SEQ ID NO: 36607 - DNA, 230 bp, Oryza sativa
ggtgatggagtttctttcttctttttttttttatgtcaggttcttattgatgaatctacacaggcaacagagcctgaatgtctcattccattggtgcttggtgtaaagcaggtaacaagtaattaattggtggttttttgttctttccattatgctatatttatactctttctttaggttgttcttgttggagatcattgtcaactgggcccagtcatcatgtgcaaaaa

SEQ ID NO: 36608 - DNA, 1568 bp, Oryza sativa
gatgattctccacgatatcctcctaatgctccaccataagcaccatagccactaccatagtcaccagggccataagaactactgtaaccaccaggcctagtgccaaaacttccaggtgatctataggggccaaagctaccaccataattataagagttgcccaatccatcataaccatccgcatgtggacggcccctaggttcactatcaaatgaacgatgaggtgggttagagggtttctttggttcggccttcttgatctccacctacagcaaagcaagaaagtcaacctatattctcttaagacctttctacttccacgaaaatggagtgctaataacctgcagcctatataagacaacgaataaagcaacagaaacataacagcaaatcagcaagggttctcccagaggtaactggaagaacacagtttattaacatgtgcaggcatagttgtaccaaactagtagaattacaaacttcaaaaagcaatacaccgagtctcacctgagaaccatttagatcaatcatattgcctttcttagctaataattcatctacagttttttctgcatcaaagactacaaatccaaatcctcgtgaccggttagttgaatggtcacgaatgatttcatgttccaccacctttccaaatttcgaaaagaactccttgaattcatctgtcaaattatcgcatcaacatgttcagtatacttataaaataataatatgagctagtccatggttaggcaaacaatatatacatgtaataccttctttcaaagcagatggtaatccaccaacaaatattttcttcgtcttgaaatcttttaggggggcagcaccctttggaatagttctcttaatttcaacctgcatgtttcacgttgaatcatgttacgatataaacagagtgagagaagcaataggcaatgcctattttttgctaaaggaagttggactagtatattaacttataaacttatgacatactctggtaaccgacattcatacaaccaagctcaaaggatcaaaagaagtcaggtagcaacaggaatcaaacaatttacctcctttcattaataacatggttgtcctcaatcactctgtcaacaacagcaggatctgcaaaggtaataaatccaaatcctctgggtttctgggtaaagcggtccttcattatgacggcatcaactatctccccatacttcccaaagtattctttgaaagtacctgcatgttcaagagcataacgaagaaattaacagacagctagagtaaatctgaataaaacaagcaataaaaaaatagcctcagattttttacttcttatataaatcttagaatacaagatacagaccaatgaaaaaataatttccgagggccacacgaagatcagtacaaaaaaatttgaccttttgtatgataggtaacaagtgcacatgaaacccaattaaataattcacaacatgaaaaaggcaaagcatatttggtagaatagaagtatcagacatctattatcaacaaatacatcagctattgctttactaaaagtttaagctatgatg

SEQ ID NO: 36609 - DNA, 1662 bp, Oryza sativa
atgtaggttcaaaaatattgtttggtccaaccacagtgccagtaccctatatcacacatatattagtttttatttggtgcagcatgaattgttaacggaacaactgtatttgtcgctacgtagtgcatcccagaatatgccaaagcatgccaccaaagctaaggtcgcaaaattgccatgctcttaatcaagagaagagctattctccaccgggccaactagaccagatcaaggaaattattacctccagaactaggtcaatcgcaacatataaaagctaaaaacatgaagatctgaacaagaaccgaaccataaataactaatcaagcatacgccaaaacagccagtaaacacgagggagaaagtgaatctatagcagatctggacttacccatggtggtgtccttaggcagcccgccgatgaagattttgctgcaggaagagcaaaccaaagacaaaaccacacgaaaaaatacatcagaaaaataatgccgaaagatttcggaaccgagccaccgtaaggagcgaggtggggatctgggggaggggagaaaggcgagaggactgacgctgggctgcgccgtcgtgctccttcatcttgccgccggccatggcgatagagagagatcaaacgggctagggtttcgcgtttcgttgaaaaaggcgggtggaaggggaggacgcgtgagattggggatttttatctgccagtggaattgggatccggaagcggctaatttatgtcggtttcgactttggactttggacgatgatggccactgaccaccacgcgaacgttcgcgccgaacgttcgcgcggaacgtggtcgcacgaacgcagggctaggctgagttcgggagtaactcacctaccccacacgtaaaacggagcaatacattttctcatgattaattaagtatttactaattatatttaaaatatagattaatataattttttaaaacaactttcgtatatttttttttgcaaaaaccacaccgtttagcattttgaaaaaagtgagtgcggaaaatgagggtggtaaattggaaaagttggtaaaagaactcagccgaatacgtaaggagtgggcataaataaatctctagcaagactagcagattggaacagaattaaggcttcttgcaatcagttaactttaaatgataaaaaagatgtggttgtgtggaatctgacaaaaaatggattgttcagtgttaaatccttttatacagctctgaaacttcaggaaacatcctccatgacaggggtatacataagaaaatctggaaaatcaagattcctttaaaagttaggattttcatgtggttgatgttaaaagagagtattctaacaaaagacaatttgataaaaaggggtggaaaaaaggaaacaacttatgccagttctgtgaacaaaaagagacaatccaacatttatttttcgaatgtccaatagtaaggttcacctggaacgttgtgatttgcgcttttggaatgaaacagatcaaagacctgaaacacatgctgaactcttggattcgatcttgtgacaaaaccacaaaacagctaatgttggttggtgtggctgctataatttgggccacttggaaagctagaaacaaagcttgtttcaatcaaattttaccacataatccaacta

SEQ ID NO: 36610 - DNA, 6891 bp, Oryza sativa
tgtttcgggcatttcatgctgttttttttctttcttctttgtttgctccatgtgagcccctggggagagttttctcctcgggtctaagaccttaaatttccacatttctttaatggaaatggagggctttttgccctttgcttaaaaaaataaatctctagcaagaagatttggtatttggtaatactttgatttttttataataataaatttgtttggtttgtaaccttgccaaataatgacaagtaattttgagaaccactatagcactttgtttaataaacgatgtatggcatatgacatttccttttcttaatccggaaaatgggaaaatattgagaggataattttttttattatttttacttcctatcttagttatgcagtacaacggtttctaaaatgaatcatcattacattctctttctccacgagggcggtgacctcccaactccactactcattgtcgatggattgacacctctgggtagatctgcaccatgcgactgaggtagccccttcccccctcccccggcatatgtaagtgtgatgcaccccctacatctctttctccctccttttcttacacaacgtcctcccatttattccatctccttccccttttcttgcactacatcctcccatttattccatctccttccccttttcttacactacgtcctcacatttattccatctccttctgtagcaacctgattctcgttctggagactaaactctccaagacaatgagaaagaagaggaagatgctagacaaggtgagaaaggacaccttccctggatcgcagtcgaagtgtgagattttgatagccgattcacggctcccgtccttattagatccaactcttgcatccttagaactgactgaacatagggatgccaagacaggaaagaatttgtcgaagacatcacaagacgataaagcaagccgatgacgatgaggaggttagttgtttttctttttgtcttttatgtgttatgctctaataacaatgtcaccttgcgatagaaatttatacctgatgaggctcacgccaaatagggaatatactctctgacaagtgaacattctatgcttttctttgcctactatctttgttgggttggtccccaacatatcacatggatgcattcgtggatgaaatctgagttcaaaatgcaagacttgtgcaaaactaagtattgcttaagcttgtagcttgagcatatccctgaaggggtcttagtgcaccagtcaacctacacatagaaagtgttggaacaattttgctttaaaaaaaaatccttcgaaaaccctcatggtagaccaagagaagaggaggaggaagtccttggatcagaatttccatacttgagtgtaataggagcgctcatgtaccttgcaaattgcacaagactggacatagcatttgtcggcaacttacttggaagggcatcaaggatatcctttgttatcttcaaggaagcaaggacatgggactattctacagaaataaccaagatctcaccttggtaggatatgcagatgttgggtacctattacacccacatatagccaagtcacagactggttatgttttcctatgtggaggaacaacaatttcctgaaaatcatcaaaacaaaatattgtagcaattgcgttgaaccactcgaaaaatcttcgcactatacgaagcctcttgcaaatgtgcatggctttgtaggatgattcaccacattcaacaatcatgtgaattgaacaccatccagacccctacaattatttatgaagataatgcagcgtgtgtcacacaagtggaaatgggttacgtgaaaagtaatctcaccaagcatatcaaccccaagttcttctatgctcacgaactgcataagacgaatgaattaaagtattgcataccaagtcctgtgaaaatcttgcagatttattcactaagtcattaccgacatcccttttgaaagatgcatccaagggattgggatgatgagacttagagaagtgcaaaaggagaattttgctaactcacttgctaaacttaatccaaattccagaatgacaaagtacccaataagaataatggtgtgggttgtactctttctcttatataagttttctcgcagtttcttattaaggtttttaatgagacaatatatccgtgcaacacacaaaatgtatgctatgtactctttcttcaattatttcccactaggtttttaagaagttttaatgatgcataagcaatacgtggtgaagatccaaggaagaatgtgagaaatttggactttggcccatgaaggccagtctaaatgtccaatacatcaattgtccctcaccctattttctatatataataattgactatatataaagggagggggacaccctattttttatatataataattgactatataaaggaagaagagctgaggcttcgtgtgcatacgcaatccttttaaactgctgtacgtagtagagcagttgcgtaataaagggatggcctagttatgcgtacttattttctaagtataacaaaagttgctaagtttatctaggagtctaagaacaagtctaatcgtagttcacaaccaatttgggggctgctagctggcgcactaatgacggccagcggcgagcacttccctcctataactactctatattagttaacacttaacactaatgacgggtaattagagaatattctcaagatttttctttctttttgggagatttttttactaacagattgaaaatttataagtcaaatttgaaaactttcgatttaagatttaaattttaaagtcaaattttgaaaactttcagctcgagatttgaaaacttttaactcagattcgaaaactttcacgtccagatttgaaaaatttgaaaactttcaacttgagatttgaaaattttcaactcgagatatgaaaactttaaactcgagattcgaaaacttataagtctagatttgaaatatttgaaaactttcaacttgagatttgaaaatttttcaactcgagatttgaaaactttcaaatccaaatttgaaaattttaaagttaagatttaaaaattactagtaaactaatcactaacttaatctaaactaattactattttttcccctgtccatagggcaggaatggcaaaaacagcaaaaaaaaaaaaaaaaaaaggaaaaaaaaagaagaaagagcggcgtcccaaaaaaaaagaagaaagagagaagaagtgtgcgcgcgtgcgtgaaccttgtgggccaaaggtacgtgccggcagccttatgggccggaagtacgcattggcaacacatgcgcgccaactagcattcacgccaatttgaaatcccaaccaatcaacaaaaaacatgttttactttttttttcccattatgcctccatacataggttcctttttttagcctgaaaataggtcgcttccccctcgtagttgatatgttttacggttcacaggataaacacagaaaaatgggaacagataaaaaataagatactaggaagcagccatatgggtgattcacaagtctacaaagataggagtaccacataccagctatgattcccacgtaaacagcgtttcaccagttcttttcacaaggttaagatcacagtggttgcgtagaacgtctggaataaaatcaaatgcatttccaccatatgtttgcactttgcactcgacttttgtcttgtcaaatctataacattaaggtgatcatgaacattcattgcaccatactgataaaacgagattgggtatctgacaactaataatctaaacaaagtttgtgcagtaccatgcaatggttgctctgcaactcagtacataaaaaaacaaaaacaaaaaaatggcaaacaaaattcctccattaaatattaggttcatatggttccaaagtagccatagaaaatatccaggtagatcaataggacaaagatgcttgaactagtttcctccttagttggttactctgtacttctgcaaatgggaaaagttcaaattagaccttagcaattgatccatgtatgcaataattattgtcaacagctgaatcaaacagagtaaatggaagttcaaccagattatcttaagagcaactgaaataaaattgcaaattcaagtcaacagagatgtttcccattatcttgtggtaaatgaaattcagcggagttacacccgctgagtcaaagcgccacttacaaaactcctaagacatgaaaatgcaataatgcataatttaagctatatcaatactgaacagatcataaattgcctttaaactcgatttgtgacaatgcattgcacagtgcaagcaaaaggcatggatggaagtggttactacagtatcttacagtgtgaagaaagaccataaaagtttaaccacaacagtcagagatggataataaaaaaatataccttaacagtgttaagcagaatctttgcttcactgttgttattgaagtggtcacgaataggctgaaaatagaaaggataacattattaagacaagataagctattggaaccataccgtgcaaggtcttgataataaacaccacatcattatccaatgaaaacaggtcaatacaaaatacactagtgcgaaattgataccacatcaataaaaataatccatcaaaactagagaaaatgacaatagtcaaatgaagcaaacaacaaataggcaccatattattgaacagaaagccaaatgtgggaaactttacctgcaatatttggtttattgcttttgctagagctggcttaacatcagcaggatgcaaagcaccagtcttataatcatcgatgagttcatccatgtttgtaaatgtcctgtttaacatcaatatgcaaaaaagtttaacatcgatgctttgccttgtcatgtcagaagatcaataatagactaacttaatgtgctctgattaacagactggtggcataggcaactaacttaatgattgagccaattgatggtaaataggaaaaattccaagttatgtagctcagaacagaacatttacttgttaccgccatttgcttccttccgaaccacctcaaacatttcaaaccaagggaaaacaatatacttgatgtactccaagcatgggttcccatcaaccacgttgggagggcaaaatgcttgttttatcttcaaatttacctgagcctgcaataaattaagccatgaataaatttagaactagtttgggtagtgatgaatacatgctctgattacaagtacataacagaagctgctatagaagaccaaaaagaaaagaattagcaaattgtagaaacatactcccatcttcctaaattgatcatcatatatgtttatacaccaagaccaaggataatttaaatcacatcaatcaggacatcatgcacacattctcccacaatacatgcatcgattaaaacaccatgccaattacacattagcatgctcacattctcccatgctgcactaattgtattatgatgaaatccgtgtccatgcggttatatgatgatcaatttgagaaattttgagttccactatatgatgatcaatttgggaaggagggagtaaatgagaattttatttatccactagaataagcaaaaggaaaagaaaaactgcaaatcagcatgtaaggttgccatagtagccattcaaaacaacataggtgtctatcaacccgcatcaggaaactaaaaccaaagtaaaatcaccagaaaaaacataaaattatagcacttagatgatgacctctcctaggtaaatacccttaaaacattccactatttcttaggaagggtctagcttgcccaaagattgggatggtcccgagtaaaggcacagttttttttttttcacaaagcatagtcaatggggtcacctttagttgttcctatctcacttatcagttagtactttctttcatccaagttagtgaactttcagcagttatccaacactgaaaacagaaggatacactactattggacagcccttgctgcctaaacttgtgttatgaaaggcataccgcgtaataaatatgttcttttatattacaatagtgggtgtcacaaggttcagaagttatagaaattgatacttgaataacaggaaaacctcgtcatcttccataaaaatggctgaggatggatcactctttgacatcttttcctggccctccttaaaaccagggagcatgtctgcaattcacgttaagggagtaatacaatttttgacaatgttttttttttttcagaaagaaggcttagcatcccaattaatttgacagaccaaaagaaaagtgtcccgcgctgtttaattacagaagataaaggtttaatcaacatgcaagggcagattaggatacgatgtgacaaaataatcggtttgtttttccttttgatgtcggtacagtactccctggctagcacattgaccttcctttggtccatgcccaactggcaaatgtctgcctacaaaaggaagggataattagaataagcttcatgcctatatgaaattctggattacagattcatgtacacacgctctctttacactgtgactcaaggtacttctcaaaaggcatggtgtgcaatagcataaatttactaaccttcaagaaaaatatatcagcacactgcatacaaggatagaatatttgggcagctgtcaactcatccgaatcatttcgacccataatctgacaacatctgtgagccaaaaatatatactcacttgcaagttataaaattgcagttacacttcaggctttggaagtgaagaagccattagacgaacatatgcaatccaaatgtggttacctcattattcttttgacatt

SEQ ID NO: 36611 - DNA, 1987 bp, Oryza sativa
tgtaagcctaaaacttttgcacatctaagcttcatgcatcactaaaaaaaacagcccacaatgagtcatggcagaagagaagaacacaacaagctcatgtagtgaatgttgtagccaaagatgaggtaatgcagcatgttttcaatttgtggaacaagaataaacctcaaagtataggaacagtgaactagagtattcttcttctctggtcgtggttcttagaaaaatatcaccatcatagttgtttactatccaaaccaatgcacgcaccgtctagcatatatcagattaacatatgcaccaaacttagtttcacccatctggtccatacagtgaataaagcaaactttataggtctataggtacatccaacccaaatttcaaatttatttgcacagagaacttaaagcaagcatattagtgcaaatctccactccccagctaggtgaaatcatggtaattccattgaatctttatgtagagaccaagttaacttctcagtaagtagcattccagagaaaaacatcatgtaccacataaattatcaggtaaaatccatttttatcccttgaactttcactaaattcctattttcaacctcaactacgaacccatatatttttcaaccccaaaccttaaaaaccgggtcaagtcccaagactaatattttaatggtgttttttaccacatctaaaacaacaaaaatatgttaaactattctagttgctaatattatagtgactcaacatgccaaacatttcccggggaaatccacccccccccccccccccccccaaatcttcaatcctcacacaatgtagtgataagagaaggagatgcaaggaagaaggatataaagcatatgatatgtgaagcaatgccgtgctagcaaccaatatagcatagcaatgtgattctcaacatggataaaaccagcaactaaaaacaatcatgggagaagtttgtctggtttcaaaagtttaggctgttttatagttcaaggtgaaagatgaactttgatggaagtttgaggcctaaaaatggactttaccctaaatgaactcggtagccacataggagcacattttgatgataataataccctacaaagtacaaatgtgcatatcccttcaaaaaattgcattgaagattgaaactttggaagaaaaattctatatttcacctgtcctgataaatttatgctggtactttttaatttcccccatgatgaattgaactctagtctctaggcagccgatgcgaaattcgatttcttctacaagaaacttataactatttcagttcaagttgcaacataagtagcaacacagatagttgagaccttgagcctccgtttggctacgcggtggattcagataatcccaatagctttacaaattttggtgtctggcaaactgatttttcctttagtttggtgttacaaagggtaatattattacagtttgaaaatataaaacaattgagggaattatgagggttagataacatattttaaaacaattcgatcggcaaaacaaacaaagaaagattgtaagttttagtttgcacagcaatttaaaaaaggataagcacagggcagcaaccacaaaccgagcctgggaattagatcgatctaaaggggggagaggcggcggattcaccgaacctgggcaatgtgcatgcggccggagggctcaaatccgtcgtagcagatggggacgggctttttctgcagcagattcatgagctcgtcctcctggatacactcctcgccgatgccccgcagcaactcgaaccggtcttggaggctcatggccgccatgcccggggcgaggtcctctacggcggaagaagaggaggacgccgaggcgtcggcggagctaccggacggcgccgaagggtccatgtcggcggcggcggcgggcctgcgtgggctggctgtgtccttccttcctgtagtatgtgcgagcggcgggcggctaccact

SEQ ID NO: 36612 - DNA, 3742 bp, Oryza sativa
agggagagggagagggagagagagggagagagagagagttaattgaaaatgttaaggatttgaggtattattactagaaactattggaatatatggcgtggctttgagccttcggatctgcgatgcaaagtttgtagattagatgaatgacagctatgagattcgagcttttctgtgacatccatgaagcagatttcaacaggaggagaggaacagtccatgtgttccttgtgtaagtgagtgaagggagtttggggctaaaaacctacatgacatcaatgaaattagcctaatgaaacccctctttctagttcttcctacttccagttctcgaagcattcccatatttcttgtttcgtgtctcagtttgatctcagatcaccataatcttcccatggacaatcttgactagttagttcggtggtggagttctcatgttgttgcgattcttttgcaataggaaatttgtgccagctattctggataaaatgaacacatggtattctgttggtagcagatttccatcagaagtttccccaattaaaattggtgctaccatccaaactgtattttagtgtacaaattacagtgctattcttttggagaaagacgtgtcatggtatggatatgatgtcttaacctctaattcggcaattcgaatacccaagctgaaaatccaatgtccacaactgcataatcatgtcttatactgacattggaatcattacatggcaaccaattagatctacatgagaatatatggaattgcattacattaacaactgattttctgttacaggtctggcattgttagttgatgttccaagagatgataatattacaggtaactaattcttgttgtttaatccatcaagatactgttagcatagtaaaattgtagttattgtttacttatctcagcatgtgttagtcaaacctaactattgaatttattgtattcgatgcagctaaaatgatggaatcattacatattcctaaaggaattcaacgagtgctatttagaacactaaatactgacaggtaatggactccagcatagttatatgctcatttgtggtaagcatgcctagttaactgttatgccaaaaaaaaatccattatatatatgagcacacatatagttcaaaatcttctgctttatctgttcagcatggtaaaggcattctttctctcttccttaatctatgtctaccgaccctctatatttccttctgagatccaccccattgattgttaaatctgttggcagtgggtcctactgtatactccttgcatttacatttagtttactcactcttgttttctcagatattttaacatcatgattaattgagctcattatgctactagagccactagccaaaatcaccaccttttggtttctatatgaaaacccaaagtgcgtggagtttttttagttgctgcaacggcatgcccttttcatgtgtttctctatctatttagaaatgatgcgctgctgtttaccctatttcttcctaattgtgtattttgtgcatccgtagtctacggatagttttattgcgtattcttataatctatctattatggaatttcctgaaataccgcacttagtaaagctgtcatcttgcaggcaactaatgtggaagaaagaatttgacactagttatgtgggttttatggaggatggcgcacaatggttggtatacaacacagatattaaacttgtcggtgagtttgaagtagcaatgcatccttttgaggttccttcactatatttgtaaccgactcttatattatttagcgtatgcaactatccgtacaattgactcttatcttaagcttgctcatgcaaatgattattgttttggcatggtttgctttgcaactttttgtttttacaaatatatctccaatgagacttttgctaaaaatggaccctaagcagagaggtgacatttggcgctgtgtgtacatagcacaacatagcaagatttggcatcgtgtaggtttctgtatggatgttgcgtggaaccttatggtgtgtttggttgggcgtatgagactggatgggagatggccgcccgagtttttgtggtgtttggttggagggcatgatggatggggcggcccggaatagggaatattccctcaatatgctggatgagtgcatatggccgatttggctggatgaagccatccagttttggactgggtgatgtgtcctgttctgatttgctgtggttggtttgatttcgtgttaagcaagctccaaatgattttttctcgtaaaccgtttatctaatttatgatttgattacacaattatatttgttataattaaatctttaaaacaagatctcggatgattatattttgataaaaaaatatatatgacaaatgggtcccactaacttttggtttttcccatccatgctatatccctccaaccaaacaagaaattggatcgccatatccatacaaaccaaacaaaaaattggatcaccatatccaacaaaatatggatggctatatcctatccatgcatgaccgtgaaccaaacacacccttagtggctccactggccattttacatgccagcctacatgttgttcaatcctgcagcatcgtgttatgaacagacggcaccaaatgtcatagcaccatttggaagggttctatttctgtaaaaagttttttctaggggtccatttgtaaaaaaatgttttccgaaaggtctactttgtgaaaatcactagtctattcctgtttttttttttgggtaccatttatcatattagattaaaattacagtgtcttccttccaaaaacatattattgtttcttgtacttacggacttaccctcccttgataatcatctcaatgtctagtttggtccgatgaataagcatttagctggaagcctcttctcatgtttcacaagtgtgcatccccatcttacatgtcttcctgtttgagcaatgtaattgtgcaaatttgcacttctaatgtgatgatcttcagaaatcatgaccttaagggacttcaaagagtttttgtgtgttatttcatactagtatacttgaactcatctttcaggatattgtgtgtctcaggcagaagcagacatcagctgaccttctgttcaaggatgatattaatattgaatagcacgtttgcaggtttaagtttgtgtcacgagataggtcttgaaacatataacacctatggaaatggtatactgatctagtatggttgcctgggggatggggtactgcatgctgtgtatactccatgcgacatagcattagctcctgtgaaaatccagaattattatgtacttgtatataaaaaacatgggccaaaactaataagtttctgagtaccctgggtcagctttttcttttttttaatattgaatgatttttttttcaaataatagtgtctggagcatacatgacatgctaactaatacacatttttctatgaatcaatgctgaaaaaccagagaaaaaaattacttaggaacaaaagatttttcttgacttgtgaccctccacttaaggtcctatttaatcaagtagtgatgcaaatgaataagattgaaagcatggtaattaaagtcaagtaggaaatgtcatggtctgttttgacactttttggtagataatgctccttttttttgttttttagttctttcattcactttctatgtagagaaaattccttgtgtgcacctca

SEQ ID NO: 36613 - DNA, 11656 bp, Oryza sativa
atataagggattgaaagagttttgaggtgcacacaaggaattttctctatgtatgtactatcagggcaaacttctgtattcttgtttatttaaccttggacgatagtgctctagaggtaatatttttatcgtggtggtgtggtgccctacactacagttattgttctgtaatttctcatttctgttgtcattttcaggaatagactatttgtctgttgcagcttttgatgacttgatcccgtcacatttagttcttctcaaaaacagggtatggacatgtttcctggagtaattttgttatgttcacattcactttcagaatatttatggctcttttatctttgttattcatcttacgtttgttctgatgttctgaactttatcttgcctatcctgtatttcctatactcggtcacttacaacatccagcttccaatagaaatctgataggaatgcgatgtagttaagaaatagttgagtgttgatatatattgtcctcacctaaaattttcttattcttcctagcttggctatgttgaattcaatgtgctaatatcctgttaggcttcctgatgacattaatttctaaactgaacaatgtaaagttgaaaaagttgattgacaattcggtatgatatatcaaagtatccaaggataccagtagtcactcctgaaatttgttgtgccattttttttctacgaagactaatttatgtgtggcactctgcccaaaagaaaaagtgaggcactgttggcacagcacgatatattacacaaactgatatgtgccatatggcagagtcaaacttgtccatacacttgcaagatgcggataaatcaccagactccagtgtgcatataacacaagtgagcacctctagatatatggaatgacaagaaaaaaagtttggtagcaggaatacccacaatctggtatcaacttaattaggagtaccatgtttttccaagaagctgatgtgcttatgagtgttgcagctcatattctgccgtatggaatgtgaatgttaccctacgggtatgatcgacgtaatatattctattttgtttttcaggatatcattcttgtcgagggcctcaaactggaaaatatcatgcctgggatatactccttgcactgcctgccacttcggctgcggggtgctgaaggttcaccaatcagatgcatccttataaagtgaaggggactaggatcagtgcgtttgctagtatcaatgcaacttcagttgcactggatcactgcatggtgagaaatccatttcataacaacgtgtttcatactatatcaaccgttcagcctcaatgcttatttctgaatttatccgttgcttatgcccagatgcaggtctgccaaataaaattgtgtcatgtcggtgctaagctcttggacttggaagctgtacagcatagtcgtaaaacacacaactatcgatgaactgcacaatgggcacattctgcgacttctcttttgaacaaactcaattgaagtttagggcccctttgatttgtatgaaaaatgtaggaattttggaggatttcaattctatgaaggcctttgaaataaagaattgaatcatatccaattctttaaaattcctatggaataggtaattctatgtacattttgaaggaaagttagtaagaggtctaacctccaagtctatctctctcatctgattcccgtgtttattctgtggtccaatcaaacggttattcctgtgttttgcaatcctctattttacaattgtattcctgcaagaatattgtgtttttcctattcctttgtttttttattcatacaattcaaagtggcccttagtcatatcattgtggaattattagtgcttctcagcaggcatggtgatgtttttccccctcagttccgtgtcaagtggttgcatcaattggcaattataaacttcatacctaatatataatttcgtatgcatatgcattttcgagttggatgagattcaatagaatgtttgattcaatagaataggatgagatttaataaatgttcccttgaaatttgttaagaatttaggagatttgttaatgactcactctaatatatatacttgactagcaaagatgcccgtgcattgcaacgggacaaaacaaagaataagttaagaatatagatattgttgtcaatacttagcataatgagatattggcatagaagaaaggggtggtcgttctaaaaagacccgatagtttcacatgcaagcggagtttactctcgtaatacaaaataaagccttaaataaaatttcaggccttaattatgagttacatgcaatatatcgagaagcacggagaatttggtgtctcaaataaatattggagaaaaaaatcggcactggtatgagatcatcagtgccgttatttaaataaatcggcactgatgtatttagtatacatttttcacggtttttcaacggttaattggatccacaccattataaatatattataaatatagtgtattgaaaaaataccattgcaaataaatcggatggatgccactacaatcttctaaaaatagaaccataccactccgtcacatcgtcgtcttcatccccgtccccatcccctcaattattgcatccatcattgttggctccaatctcctccctcgctgacggccaactccttcttccttgtccctcgcgcctccctcgtgctactccccgacttctgccgccgtatgacctcctctgtttccatccctcgcgcatccctctcctcgttccccaccatcagtcgccgctgacttgagtggatcgggggccttggggctaaggcggactccgcgagcttcgcacgtcgaggaatgctgctaccagcgttgacttgagtccctacagtggaagccgatgaacacgtgcatgcggatgcttgggacgaggcacttcttctcacccttccaacattggaccagccgaccaagttgcagaagctggatgtgtgtactgcaagtcatcgaaaccagcgtagaacaggtgaacgacaagttgggtgagggactcatattgcttgatcctaccgtggaagatgtcgttgaggctgaagtggttcgtgctttcgtggtgtactagccctcgtcggtgttcgcgttgtccaccgactcgccgaggtcgccgttgctaaggtacacgcacatgttgaatcactggtacaggtaccactcatggcagttaggtagcatgttgtcattgaactgtggtggcaggtcgtggatgtaccccttgcaagctccgcatctccggtgccttgtgccacgactgtcattgtgacatcgcatgcagacgaacgccttctaagctgctaggaaaagctgagtgttctcgccgtcggacgagcgattaacacggtaagctgatcggaggcgcgttgtcgaactatcacggagacagagacggcgatgtgatggagataacagaaatcatgacggagtaccacattgttctaattttagaaaaattgcagtgacatccacccgattttgtgaatagtaataatatttttctaataagttgtatttgtagtggcattgatccaattaattttttcttacctaccattgattaattaattaacgtatttttttttaaaaaaacaacgaattaattggagccgatcctatccatccggctgttttgttccagctccattgtcgatcaagccgaataaaaaaacaacgaacaaaaaagaacagacatcgaagccgatccttcctatccatccgccctctcgctctccgtccgtccttcgccttcgctccccatctctccctgctagcgacgccgctatgagcgcactcccgcccccgcgccaccaccgccatcgcgtgccgtttctctccagtgtgtaggccgccggatccggccgcctagaagccgggggccaccggatccagccaccttgaagccaggcgcggccggatctgcggggaagcagtggcagtggtgatggtctcatcttccaacgagcagcggctgcctcccccatctccttgataagcgggtggcgatgcggttcgagggtgatgatggatgagagggagattgaccatagcgccacaggttttcccctctattcccttctctcctcaacccaatccaatccctcgtacctgttatgaaacaacatggtgatctaatggatcgcaattgaaggcaaccgcgcctcttctctaggcgctccttgacaatagacacgatgccactccttccccatctataaattgtactgcactgatcaataaagaaatccgctcatttattccctacattcttgtgttaaattctctctcgctcaatctctcaatctctcgctcaatcaattctatccacgttcaacacgttattagagagcgaaggcgaaggagatcgcgaagtgaaagaagggagaaacatcgcttttgatctaacagaaaagcaaatagaagaatcattagagaaggtacgatacctatcttttcattggatcatggatgtcgttctcggcctccctcgccatcagcgcgcatgccggctctgccattttcttcgccgacctatgaggagcacacgctggggatcacgcggaggcagggctagggttggtggccgccgccactaccctcgccgccatgtgactgcaactccggttgtggttcccccgcccgtccctgttgtgcctcctcctccgcctccggttgccgaagcacctcaccggatcctcgtgtagggggtgcagtactgcgcccaccacagatggacggcagtggtgacactacccggcgagccatgtgctcttcccccggagatggagtcgcagccgccaccatcaaccgctccttcaccacctccaccgacaccaagccgacgccaacgccgttcccccactcccgcgccagcggggtctggccggaccggtaccctggctgcgcgcacgggggagccgcccttcttcaatccgtcctcgtctcgtcgtcacgccagtgaagccgccgctcgccgtcccggcctccgccacatcttcatcgccgtcccccatggctctcctagccgtacactccctaacggggtgctggggaatggcgtcagggctcggccggcctccgactccgacgaggattgggagccgtcagcctaatccggctggcaaaccgccagcggacggaggggcggtcggggcggtagtggatggtggatggcgacggcggtggatggcggatggcgacgacggtgaggcggcagaggaaatggatggagacggcggtggactctgtggcggtggcgtcggcggcgcccccaacggcggcgtcggcggcgcacctcggctgcgtcggcggcgttccccacggcgacgtcggcggcggatgaacggcgcccccctcctgcctttttattaatttacctctgtaaattgataatgttaaccatgattgtagggacatggcaacaaaagagttcgacgaaatcgccctcgataggactaactatcccatctgggcttccgatatcaaaatcaattttgcctctcgggggattttaaatacaattgaggaacccaatgatggggatccgcaaattgagcccaggaagctcaatacaaccctttttcttttaagactctacattcacaaggatctcaaacatgaatatatgttagagacgagccctctcaacccttggaaagctctaaaagagcgttatgatcagcaaaaggaactcatttggcctgaggctaattatgagagggttcatttacgccttcaggactttaaaactgtggcagaatacaaccatgctgttcataacatttgttccaggttgaagttttgcgaacaagagccaacggaggcagagaagatagagaaaactctatcaactatgcttccggaggacaggatactgctcaacagtatcgtgctaaaaatttccagaaacattctctgcttatacatacattgactcaggcagaaagacactatgagctttctttaaagaatgcccaacagcgcccatcgggctctgctccactgcctaaggtgcacttcaatgtacagaataatgctgagaataagaaagcattcaagggaaattcttcgaataatcctaagaatctgactggaaagcgcaaacgcaacaataacaggcacaaattcaagggtcaaaagaaaggaaaagggaagggtaaggcaccacaacctcgtagcaatggcaacaagcattgcaacaggtgtggatctgacactcatgtcgctaaagactgccgcatcccgaaacatcttgttctcttgtaccaaaaatcccttaaggacaaaaagtcttctgagaacccaagatttggagcccaattcaatcttacagatgaagagcgccctgaggttgcaagttctcaccaggctcctgttgaaccagagagcaacctcaatgttctcccagaagatgtcgctccactctctgcgatggacgatatgttcatcgaatactgctcaatggacctacttggtgatttgcaataatctcggtgcgtcccacttagagatgaagctgctcttatctcagtgtgcttgaaacagtatattgatatcctataagtttgccaaacaatattggttgtaataagtagataagtacgaactcccttatattgtaaggttgtattgcttgctagtcattagagtatgtacttttaacatatgtaaacgtcatactatgtatttatgtatttgatgttttaattattgtatgtatgtatatatattggataaagaattcttaatcaagcaattcttctttcattatagatgtctaaggatatcgctccgattggagatgaattatgtcttgtggatagtggtaccacaaactctatacttagggagatcaaatactttcaaactctcaaaaagagagaaggaaaagttttgactattgctgggcgcgatactgtgatagttggctcaggacaagcaattattacactcccaatgggtacacaaattacaattgagggtgctttattgtatcctgattcaacccgtaccctactaagttatagatatatccgtcaaaatgggtttcacattgaaacccatatggataatcgagaagaatttcttctcttaaccaaacaaaatggatatggcaaacacatttgcgagaaaattccatctctcacatcttgattgtactatacatacattaagcccattgcacatattgcgtataaagtaatttttcaaaatgttgatgcattccacacttggcatgatcgacttgggcaccccagtatcgggatgatgagaaaaattattggcaactctattggtcatcatttgatcaccgacaaatttctcaaatcctctgatttcgtgtgcactgcatgtgctactgggaaactgattttgagaccatcttatctcaaaattagagctgaaccacttaaattccttgaacacattcaaggagatatctgtggcccaattgtgccaagatctggaccgttcaggtactttatggttttgattgacgcatctacaagatggtctcatgtgtgtcttttatcgacacgaagccatgcctttgccaaattaatgtcttaaattataaggctgaaggcaaattaccctgaacatagggttcaatcaatccatatggacaatgctgccaaatttacatcccatgctttcgatgattattgtatggcattgggaattcaggttcagcactctgttccatatgtccacacacaaaatggtttggctgaatcattgatcaaaagaattaagcttattgctcgaccattattgatgaattgcaaattaccttcgtcgttttggggtcatgcagttctgcacgctgctaaccttgtccaactatgaccaactgcatatcatgaaacttccccaatgcagttagtacgtggaaatcctccaagtatttcccatttgcgtaagttcggttgtgctgtgtactgtaggatcgaatcacaagaactaagccaaccagaggggggggggggtgaatggttggtatacccaaaaaccaaaaacttttagcggaaataaaagttaccctcgaaatcgacggaagtcggtcagaccgagattgatctgccggtctgactgagtggatgccgccggtctgtgtcgcgtcccaaaacgactctaaaatacatcctcgaaattatgcctagaataattaaaatccatgtgaaagcctccaacaattaaaatgtgcaaagttaaaagttaaataaggcttggaggatttttgtatatttcctaaaagcctaaaatgcgtaaataaattttagtggaattttcagagcacaaataataattaagaagaaataaacaaagttaaaatggttttataaaaagaaaaaccctaaaaagttccctttccctccccctctccctcttgggccggctcggcccatccctttccctctctcccctcttccccgcggcccattcggcctcctccccgcgcgcgtgccgctgacgggcgggcccgcccgccaccctcgctgacgggtggggcccacccgtcatccccttcctcccgccgctcccgccgccttggccgtgccctagcgccgccgccgccgcgaatcccgccgctccagtccgtccggggtgcaatcaagaggggggaaatattccccgtgattccctccctctttccccccatttttccctccctctctcccttggattcgttcggaaactttccccctaacctcgccggcgcatcaatggcggccggatcttccgcgcccgtttccccctcatccggccgctctctccccctcccaaccctatataaacactccccgtgcctccctccgccgtttccgccactcgccgctctctctctccgccggaatcgagctcgcgccgtcgctctctctctccgccgtcaccgccgagctccggtccgccgccgtcgtcgccccggaccatctcctgcttcggcgtcgccttcttcgggttcgccgcaacctcgccgacctcgtccacctctccgtttcggtcgccgatcgccggaacgccgccgtccccgtcgaccagagccgcgccgccgcctctctccgctccggtcgccgttcccgtcgtcgccgtcgacccggggtgagccgtggaccgccgattcgtttccccctttcctcccctctctcgggcgccgctccgccgcgccagtggtcgccggcggcgaccatcggggcacgagcgcgccgcctcccgtcggctgtgccggcgtggccgccttcgggcgcgtcccgcggctgccatgtggggcccggctgtcagccgcccgcgccctcgggtgcggctgacgcatgggacccacggcgccggccggtgtgagccgggtgcacccggtccaccgtggaccgtgaggctgccgcgtgggccccactcccgtggacccggtccgcgcgcccctcccctcggctgacgcagtaaatccaattttaaattaaaatttaaatgaagaaattcgcaaatattcatttaaagagcatataaccttcaaatggccataacttggccatttgaactcggaattggaccgctcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcagggcaagtcacatcatccttgaacatattgaatcccagtttataaaattatgtcgctttaaattattgcattatcgctttatttaaattcccgcgttatcactgttttatctagccatgcctatttacctttgttatgaccttattattattgttattgttattatttccttgttcaccctagagtaaacaaaaccccaactagtggacactctactcatggtaccactagtatgattttaggtagatgctttgctatttaattaggtaacattaggtggtttttcaactctagactttgggaatattcatatcacctggacactatggaatggtttggttattgtggaattggcttcacaccgctccttctattcaaaatccccaaaatggttttaggctggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacatggatggagatggacgaagtcgggggtcgatggacatctccagggcaaatgaaggctacacgagctgcggcccggtagtcgagatgtcatggcacagggccggtgtcctgttgctaggggctcagtcctgcctacctgtcccgggggttccggccgtaggtgggattgggtcggtactcttgtctatggctaggatgggttggaaactatgtcacgtcttccgtctgtataccgtggtggtatgtggcacatggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgctaaacaactaaaaggaggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgagcaactaaatatctttaaatgctgtttactgcaactctaaccctttatattataactcctttgtactccctcgcatttattctgcacttgtgggtgtgtcttgttgagtacggtggttgtactcagtcttgctcaatttttcccaaacccagaagaggagcccctagaagatgaaggctttggtgtctagctcgtgcctgccgtcaagtgcctgtggtcatcgccctagtcttccgctgtttcccgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttctggtcgtgacagtctgaccggtgttgaatctccggtctgaccgccgaagtcgcctgccgtgcctgtcgccgccgccggtctgaccgccgcttgccgccggtctgaccgccggtagatcgccggttagaccgccgaaacccggtgaaacacaaatcaaagaactcttaaagtagatgacgactttattgattctctctgtgtttacaaagtgcaccaacagcattccttacaaaaatttcgactaaactcgaaaccctaactcaaaactcaactcaattgctctcaaaagcgataccgggaagcctcacgctccccctttatttatacccgaggtaggcagcctaaagccacga

SEQ ID NO: 36614 - DNA, 3286 bp, Oryza sativa
gggtgtgtcttgttgagtacggcggttgtactcagtcttgctcaatttttcccaaacccagaagaggagcccctagaagatgaagggttttggtgtctagctcgtgcctgccgtcaaagtgcctgtggtcatcgccctagtcttccggtgtttcccgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacaagttggtatcagagcccccttgaccctaggacgagccgtagatcccaagccttagcaatattttcaaaaataaaaaaatcctgtcttatttgtgaaaatcctctagtctctctctgtcctgctgcttcatttatcgccaaaatctgacctttaaaatgttgtttttctttttgtttttgtttgtagatggccggcagcgtcagccgtcgtggcctggacatgactggtttcgtcttggagctgcggggcatgtgcgttgtcctggggtatccacatggagtggactaccagggcatgccgcttccggagcaggagggtgacgatgcagagccccacgctgcttgggaggttactgcagtgatcctcactggctctcccgagcggacttcgttggcagtcaccgcaggtggagattctttccccgccgcttgccagaacgccgctctcctcgccatcggcactcttcaccagcgctacccggacgagttgcagcactcgccctaccgctaccaccctcgccgcggaggagcccgcgacttcgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaagaaggacctagacgcagtggaggcgcagctgcatcagctcaagatcgcccagggagaggtctgtcgccccaagcgccgccgcgtctgccgcagccagaagatcaccgcccgcaagagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgtcctggcctgtcgcagcggtagacgagcagttagtaggcttgcgcgtgtgttctttctcgtttgtcttcttgttggagtcgtgtggggcatggttatgccggtgtgtggcataactgtgtcggagcctgtctttattttatttgcttaagcaacttgaactttaatgaaccaatttaatagcagtaataaattcaagaattatggtagtcgtgggtggttagctttaattgtcagctctctctgtttgctggttttgtgtggggtttccagatggtgacgactaggagaagtgctgccaccggtgatggcaaccaacctgaaggcagcaaccacaacaaccatggcagcccacctccacctcctcctccgcctccaccaccaccaccagacaccaacgccattctcacccaaatcctcgcccagcaggccaacatgatgactgctttcctccaccacctccaaaatccgccacaacataatgctccaccaccaccctcacaacactctaaactcgccgagttcctccgcatccgcccacctaccttctctagctccaataaccccgtggatgcgttggactggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggctcgcttcaccgccgctttccggagaacccatgtgcccgccggagtcgtggcccttaagaaaagggaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctaatctccggtgactatccggatttccaacgtctggtggacaagagcatccgcttggaagccaagcacaaggaactggagtcgcacaaatgccgcttggcgaatttccgcaatcaacagggtgctaaccaaagggtccgctacaccaatccctatccagggggaacctcctcgcagcagcaacagcagcagcaacctcgctccgcgccccgacctcaattcgtggtgcgcgtcccacagccgcagcaacagcagagtcagcaagggactcgtgcgccccgtcctcctacgccaactgtgcagcctggtcaaggccgcagggacgctcaaggtccgcagcgtctgtgcttcaactgcttcgagcccgggcactttgcggataaatgcccgaagccgaggcgccagcaaggccaagcgcctccccgatccaaccacggtggtaaggacgtcattcggggtcgtgtgaaccacgtgacggccgaggacgtgctgacaactctagacgtcatcgttggtacgttcctcattcattccatccctgctaccattttgttcgactctggagcttcccactcatttatatctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattctgctagacaccaagaacttggatgtgatccttgggatgaattatttggctcaattccaaggagtagtggattgcgcgagacgcactgtcactctgtaccgagggccggaacaaccggttgttttctttgcacccccaacctccgtcagtagttcagaacttcatcagataggactgtcagaaatccccatcgtcagagagttcggagacgtgtttccggaagaactacctggtatgccgcccaagcgagagattgagttccggatagaccttgctccaggaatgtcacgaccggaaatcac

SEQ ID NO: 36615 - DNA, 7894 bp, Oryza sativa
gggtcgcttgtgcaaaggagtggttcctggagcaagatctatccggaactcaatctctcgcttgggcggcataccaggtagttcttccggaaacacgtctccgaactctctgactatggggatttctgacagacctatctgatgcagttctgaactactgacggaggttgggggtgcaaagaaaacaaccggttgttctggccctcggtacagagtgacagtgcgtctcgcgcaatccactactccttggaattgagccaaataattcatcccaaggatcacatccaagttcttggtgtctagcagaatcagatccgagggaaaaggaatcccctgaatttctatagggacggcaggactataatactttgctgtcataacccctccaggggtggtgatgagcagagggtttctaagcctttctacccccaactgacttttccccacgaatggcacagatataaacgagtgggaagctccagagtcgaacaaaatggtagcagggatggaatgaacgaggaacgtaccaacgatgacgtctggagttgtcagcacgtcctcggccgtcacgtgattcacacggccccgaaggacatccttcccgccgttgttggagcggggaggcgcttggccttgctgacgccttggcttcgggcatttatccgcaaagtgcccgggctcgaagcagttgaagcacagacgctgctgaccttgagcgtccctgcggccttgaacgggctgcacagttggcgtaggaggacggggcgcacgagtcccctgctgattctgctgctgttgctgctgtgggacgcgcaccacgaattgaggtcgaggcgcggagcgaggttgctgctgctgctgctgctgtgaggaggatccccctgggtagggattggtgtagcggaccctctggttagcaccctgctgattgcggaaattcgccaagcggcgcttgtgcgattccagctccttgtgcttggcttccaagcggatgctcttgtccaccagtcgttgaaaatcaggatagtcccaagagactagacgaacggacagctcagggtccattcctgccaagaacttctcttgcttctcctcatcttcccgcacatcctccggggcataacgggctagattgtggaactcatgcaaatactccatcacggagcggttgccttgcttcaactcccgaaattcccttttcttaagagccacgactccggcgggcacatgggttctccggaaagcggcggtgaagcgagtccaagtaataggttgcccttctggctgcgtggcctggaaatggtcccaccatagagatgcgggcccctgcagctgatgggcggcgaagatgactttctcttcgtcactgcactgcacagtgtctaacttcttccccacggcatgcaaccaatccaacgcatccacggggttgttggagctagagaaggtgggtgggcggatacggaggaattcggcgagtttggagtgttggggagggggtggtggagcattgtgttgtggcgggttttggaggtggtggaggaaagcattcatcaggttagcttgctgggcgaggatttgggtgagaatggcgttggtgtctggtggtggtggtggaggcggaggtggaggtggattgccttggtggttggggttgctgccctcgggttggttgccttcaccggtgttaacatttctcctggtcgtcaccatctgaaaacccctcacagaaccagcaaacagagaaggagagctgacgattaaaactaaccacccacgactactattattcttaaatttatcactgctattaaattggttcattaaggttcaagttgcttaggcaaacaaataaagacaggctccgacatagttatgccacacaccggcataaccatgccccacacaactcaaaaagacaaacgaggaaaaacacacgcgcaagcctactaactgctcgtctaacgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacgaacaagctcgggcctggaggtgctcttgcgggcggtgatcttctggctgcggcagacgcggcgacgcttgggacggctgtcctctccctgggcgatcttgagctgatgcagctgcgcctccaacgcgtcgaggtccttcttgagctgcagattctcttggcgcagctccaggatcttcatgttgttctccaccatgccacggcgcaccatctgatggaagtcgatacgagccgcgtcgtacgcctccaccatgcgtgccagatgcacgacggtagcgtcatcctccgagctggcgtctcggaaggtggcgtagtcgcgggctcctccgcgacgagggtggtaccggtagggcaagtgctgcaactcgtccgggtagcgctggtgaagggtgccaatggcgagaagagcggcgctggcaagcggcgggaaggaatccccacccgcggtgactgccagcgaagtccgctcgggagagccggagagaatcactgcagtgacctcccaaccagcgtgaggctctgcatcctcaccctcttgctccgggagcggcctggcctggtaatccactccatgtggataccccaagaccacgcacatgccccgcagctccaagacgaagccagtcatgtgcaaaccacgacgggtaacgctgccggccatctacaaacaaaaagaaaagcaacattttaaaggccagattttgacgataaatgaagcagcaagacaagagagaatagcgggttttcacaaataataaaggatttttatttttttgaaaatatagctaaggcttgggatctacggctcgtcctagggtcaagggtggctctgataccaacttgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagacaacgaaaaacagcggaagactagggcgacgaccacaggcacttgacggcaggcacgagctagacaccaaagcctttatcttcaaggagctcctcttctggacttgggaaaaattgagcaagactgagtacaaccaccgtactcaacaagacacacccacaaatgcggaataaatgcaagggagtacaagggaataataatatagggattaagttttgcagtaaacagcatttaaaagacatttagttgctcagggctattttgtaaacacgatcttagaactacacaatattattaatcaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttaccacgcgccacataccaccacggtatacagacggaagacgtgacatagtttccaacccatcctagccataaacaagagtaccgacccaatcctgcctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttaagactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaccataaaccaacaattccaaagtgtccaaatgatatgagaattcccaaagtctaaagttgtaaaacctcctaatgttacctaattaaattgcgaagcatctacctagaattaaactagtggtgtcatgagtagagtgtccactagttggggttttgtttgatctagggtgaacaaggtaataataataacaatgacaataatcatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttttatgctctttaaatggatatttgcgaatttcttcatttatttttcaattaaaaaaaatcctatttattgcgtcagccgaggggcgggcgcgcggaccgggtccacgggaagggggggcccacgcgtcagccgctcggtccacggtggaccgggcgcacgcggctggcggcggtcggcgccgtgggtcccgcgcgtcagccgcacccacgggcgtgggcggctgacggccgggcccacttggcagccgcgagggcgcgcccgagggcggcctcgccggcacggccgacgggagcggcgcgcacccgcgccccgatggtcaccgccggcgaccaccggcgcggcggagcggcgcccgagagagaggagggaagggggaaggcgaacggcggtcttcggctcaccccgggacaacgacgacgacgagaacggcggccggagtggagggaagcggcggcgcggttcgggatgacgatgacgaaggtgctccggcggtcggcgggcgaagcggagcggcggacggggtcggcaaccactcggcgaagcggacggaggtgtcgccgagtaaggaggaagtccggagcggcggcggcggcggaacggagctcggcggcgacggcggagagagaggagcacggcgcgagcacgattccgacggcgagagcgagcggcgagcggcggaaacggaagagcggagctcggggagcaattatatagcaacgggagggagagagagcggccggagagagaggaaacgggcgcggagatctcggctccattgaatacgccggcgaggtttgcgggattgattccgagcgaatccgagggagagaggggaaagagggggaatcgggagaggggattgcggggaataattcccccctcttgattgcacgcggggcggacgggagcggcgggattcgcggcggcggcggcgctagggcacgggcgcggcggcggcgggaggagggcaatgacaggtgggccccacccgtcagcgagagtggcgggcgggcccgcctgtcagcggcgcgcgcgcgcggggaggccgatgggccgcgggagaggagagagagagggagagggaagtgggccgagccggcccaagagggaagggggggggaaaagaacttcttttaggattttctttttataaaacctttttaactttgtttatttcttttcaattattatttgtgctctgaaaattccactaaaatttatttaagcattttaggcttttaggaaatatacaaaaatcctccaagcctcatttgacttttatctttgcacattttaattgttgaaggctttcacattgaattttacttattcttttgcacaattttgaggatagattttagagtcgatttgggacgcgacaaacctaccccccttaaacggaatctcgaccccgagattcggaagaactggcgaagagatcgggatgggctgccttcagctcgtcttcgcgctcccaagtagcttcttcttcggcgtggttgctccactggaccttgcaaaaacggattactcggttcctggtcctgcgctccatggcgtccaggattttcactggcttctccacataggtcaagtcttcgcgaacttcaatttgctctgagtcggcctgctcggatggcactcgaagacatttcttgagttgcgacacatggaacacatcatgcacgttgcccaaggaggcgggcaactccagctggtaggcgacttctccgcgtcgagcagtgatacggatgggacccacataccgaggtgcgagcttcccttttgtctgaaacctgtgcacacctcgcaatggcgtgacccgaagatacacaaagtcatacactgcgaattccagatcacggcgacggttatctgcataacttttctgccgagactgtgccacctttagattatcccgaatgattctgactttagcttcagcttctctcaggatatcagtcccgaacacttggctttctccgacttggtcccacaatagcggtgtccggcatttgcgcccgtacaacgcttcatagggtgccctttgtatgctggcttggtagctgttattgtaggagaactcggcataggggagactcttatcccaagtcttcccgaagtccaggacacatgcgcggagcatatcttctaggatctgatttagacgctcggtctgtccatctgtctgcgggtgatatgcggtgctgaaattcaatcgagtacccagctcttcttggagcttcttccaaaagtgagaggtgaattggcttcccctatcagatacgattttcttgggaacgccatggagactcacgatcctagcgaagtagagctccgctagtttattccctccataggtggtcttcacaggaataaatcgagctaccttggttaatcgatccactattacccatatagaatcatacccaccttgggtttttggaaggccggtgatgaaatccatcccaatttcatcccatttccattctggcacttggagaggttggagaagtccggccggtcgttggtgttctgccttgacacgctggcacacatcacatagagccacaaactctgcaatttcccgcttcatgctgacccaccagtatttctccttcaaatctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggctgggcttctagcgcggccaaaaatccacgaccaactatgtttaggttcagggcttccatctgttgattaagctcgggtggaatgcctcggacgttgagagtattgcaatggctcttccgacttagagcgtcggcaaccacgttagccttaccagggtgatagtgaattcccacatcataatccttgatgagttctaaccatctcctttgccgaagattcagatccgactgggtgaagatgtatttcaaactcttatgatcagtatatatttcacagcggttcccaatgagatagtgccgccagatttttaaagcatg

SEQ ID NO: 36616 - DNA, 3335 bp, Oryza sativa
agggggggggggaaaagaacttcttttaggattttctttttataaaacctttttaactttgtttatttcttttcaattattatttgtgctctgaaaattccactaaaatttatttaagcattttaggcttttaggaaatatacaaaaatcctccaagcctcatttgacttttatctttgcacattttaattgttgaaggctttcacattgaattttacttattcttttgcacaattttgaggatagattttagagtcgatttgggacgcgacaaggaaccactcctctgcacaaacgaccctactgtatggcagcaaatgaattgaccgaagtcaagaaacagttggaagagttgaaagaaaaggggtatatacgtccgagtacttccccatggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattcctaagaccacattcaccacgcgatacggactgtatgaattcacggtgatgtcgttcggtttaaccaatgcacctgccttcttcatgaacttaatgaacaaagtgttcatggaatacttggataagtttgttatggtgttcattgatgacattctggtgtactcacaatcagaggaagaccatcagcaccatctccgtctggtgttgggaaagttgcatgaacatcaattgtatgccaaacttagcaagtgtgagttctggttgtccgaagtcaaattcttagggcacgtgatatctgctaaaggagtcgctgtggaccccgaaacagtgaccgccgtcaccgattggaagcaacccaagacagtcactcaaattcgcagtttcttaggtttggcaggatactaccggaggttcatcgagaacttctccaaaatcgctcgacccatgacacagttgttgaagaaagaagagaaatttgtgtggagcccgcaatgcgagaaggcgtttcaaactctcaaagaaaagctggtttcctcgccagtgttaatcttgccggatactcgcaaggacttcatggtgtattgtgatgcttcgcgccaaggattggggtgcgtgctcatgcaggatggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcactcagtcggacctgaatcttcagcagaggagatggttagaactcatcaaggattatgatgtgggaattcactatcatcctggtaaggccaacgtggtcgccgacgctctaagtcgaaagagccattgcaacactcttaacgtccgtggcattccacccgaacttaaccaacagatggaagccctgaatctaagcatagtgggtcgtggattcttggctgcgttggaagccaagcccaccttgctcgatcaaatccgcgaggctcagaagaacgacccggacatgcatggactcctcaagaatatgaaacagggtaaagccgctggtttcacagaggatgaacacggaaccctatggaacggaaatcgggtatgcgttccagataacagaggacttaaacagctgatacttcaggaagctcacgaaagtccttattccatccaccctggcagtacgaagatgtacttagacttgaaggagaaatactggtgggttagtatgaagcgagaaattgcagagttcgtggccctttgtgttgtgtgccagcgtgtcaaggcagagcaccaacgaccggccggactcctccaacctctccaagtaccagaatggaaatgggatgaaattgggatggatttcatcaccggacttccaaaaacccaaggtggatatgattctatatgggtagttgtggatcgcttaaccaaggtagctcgatttattcctgtgaagaccacctatggagggaacaaactagccgagctctacttcgctaggatcgtgaatctccatggcgttcccaagaaaatcgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctataataacagctatcaagccagcatacaaatggcaccttatgaagcgttgtatgggcgcaaatgccggacaccgctcttgtgggaccaagttggggaaagccaagtgttcgggactgatatcctgagagaagctgaagcaaaggtcagaaccattcgggataatctaaaggtggcacagtcccggcagaaaagttatgtagataaccgtcgccgtgacctggaattcgcagtggatgactttgtgtatcttcgggtcacgccattgcgaggtgtacacaggtttcagacaaaagggaagctcgcacctcggtttgtgggtcctttccgtatcattgctcggcgcggagaagtcgcttaccagttggagctgcccgcctccttgggcaacgtgcatgatgtgttccatgtgtcgcaactcaagaaatgtcttcgagtgccatccgagcaggccgactcagagcaaattgaagttcgcgaagacttgacctacgtggaaaggccagtgaaaatcctggacaccatggagcgcaggaccaggaactgggtaatccgtttttgcaaggtccagtggagcaaccacgccgaggaagaagctacttgggagcgtgaagacgagctgaaggcagcccatcctgatctcttcgccagttcctccgaatctcggggtcgagattccgtttaaggggggtaggtttgtcgcgtcccaaaacgactctaaaatacatcctcgaaattatgcctagaataattaaaatccatgtgaaagcctccaacaattaaaatgtgcaaagttaaaagtcaaataaggcttggagtatttttgtatatttcctaaaagcctaaaatgcgtaaataaattttagtggaattttcagagcacaaataataattaagaagaaataaacaaagttaaaatg

SEQ ID NO: 36617 - DNA, 17743 bp, Oryza sativa
tttttttttaaaaaaaaataatacaaggttgtatcaggacagctaatactggtctagacattagcaagccaatacacctagtcaatcttatcacatggcatatttgcccaagcaacagataataatgagaaatgttcagcgctctccgatccatcagtttgggcaagatataacaatggtcctgctgattcacctgctatcaggctatggcattcctgggttaatagtactgttacactgaacagaaatagatgacttctaattatcatttagttggaaataaaagctccggttaagcgggccttcgaagagtcagtatataaagctgctgagcttcctgccataaaaccccttaattttcttcatgcatttatccaactaacatgaactatatatgcaacaagtgcttgcacacaaacactacactgtccatgtaagaagtttgagatagcaacgtacaagtatacctgaaattttcttatccatttctttattccccaaaccctcagcgcggccatctttcttcctccctgtagcagtgttgtgaatgataacagttggtggccatatgataaggtcctccctacttgcttgaacaaggtcagggagcaatgactggtatgccttagaattttcagggacttttgtataatcccatcccataaggacgcatagtgccttgtgcaaaccaagatggtcaatgaatgaatccacatttggtgggttgtaagcatgcatgacaagtccatgcacatcagcaaagtccttagaagacctggaattgtgcacattgaccagacataatcacaaacaaattaagatttggtgaacatgagctgaatacttgcaaacttaatgcagccttcattacatatgttatctgaccgtgtctacacatgcccaaaaaaacatcttaactttattataccaagccacataatatacatataaaaaatatgtcacatgaaagcaggaagataggattctaatgccaaaggatccatggtagcaaaaataatgctgacaggtttgtactgtttaaataacccacaccagctgctgtgtccaaagttctaggacacccgatctttgtatggcattaagcagccaagtcacagaagggatcctatggagcagtctgaggttgaggcagctagtagcagacatagtaataattattgctagccgtaatctcaaggtaatttctactttctactccatctccttcaagatggttcatttgactattgactattcaaattgagcactgacatactaaactatgtgctcacgtgaaacacatcaaggaaaaagcatcagaagctgcacaacacatgcaccgttaatgcctaggtgctaaagcacacacctcctagcataacaaactacagatagcaaaattttaaaactaattattggaagaaaaagttaacaactgttttgcaatgatattttcctgatgtggcattttgactggtgtttttcaagaggatgataatcttgaggaacagataaagaaaatattctacatggaaagtacggctcaaccatggaaatgaaaaaaaaaagattgtgtaagaaatccgacttataagtccaccgcagctaggcgaaggaagcctggaagcgttgcttaaggatcagtgaatacatggagaaggtatagaatagataagcaagacaggcatatggctgaaaaagaagcctgagcgactatgaggggaccactatctaatattccaatgcaacttatatacctttttcagcacaataattttttacctaaattttctcgcattcattttttttctttattttcctatagaaggaataaatcagaagtagcagccaggttataagtggtccctttacaaacatttgtttgacctttcaaatatcaaaagttcccattttccgctactttcttttgaattgctttatggcattatgcaccctcactataatattctagagcgatgttggtgatcaggtcctcagtacataagaatatgaaaatattctgtgcttggtcacagatgcaacgcccattttaagtgttgaatccatatagtagacaagttggaccagagggtgaaccatctaagctcttggttcatcagtctggcattcagaccggccgattgggcagttaaaccatggaccacggttcggaaacattcatctaaaatgcatgtttccttctacactgcaccaagttggtggtaggatggcaacgtgaggctgccccagcgtgaagacctagggtcgaatccccacccgacagcccttttcagcattattttttgcaaaacagattatgttgcaggccttgatggaaggaagtgggccttggtttggcgccccactcgcaattagaaacactctttgagccccacccagtccaactgatcctagtttaatgcctagttcacctgaaaaccgtcaggtttgagcggttcaaatcagtccgagtacacaattagtcttctcaagcaaccaaaccaagctgagatcgacttctaggtttttttctgattaaaacgccagtatgatccatccttttcaactatggttgaatcttgcaatgagatcctttctacgtcatactgattttttttgtccattcaaaatatttcgtctattggcccttcaaaatattttgtctatcagtgtatataacatgtctcctcattagacatcagatctaagaaggcgtgctattttactaaaaatattctgtattgtgcaccaaaagtttgttgattgattatcgagcatattcagttcatttctaatgtcgccataatgtttcggtaaacacacgtaaagtcagatcatcaaaatcagggccaaactttgggtagcaaaaggcattctcaccagagtctacagaaaaggcaatccacacatgtgcagccatgaataaacattgaaacttgcctaaatatgagtctaataaagtatgttacgagccaaacaagcctgaaatgtttagttgggcagtttgtctactgttggcatttgaggcaggaggttgaaagatcgaaaatcagtgatcgcagcgtattttttctaatttaggtggcatgggagagaggacaatgggtcaacctggtttatccataactgtactccaaaatctaacggttcaaccaggatcatctcacctatcacaagctcattaccataatttaccacaccatccataaaagttcagctagggataaactaacttaacactgagaatacttatccacaaccaaaactacacgatattagtggcaaatctttacggtacttgccacttgctaatatggataactaccctgcagcaagaagtggaacaggacatgaaatttatatgattatatctaatatcagaacagtgttctttgcagtacacagaatcagaactcttaacacagcaatgcagctctcaaaaaatgtagctatgtatggatacctcacaaggttcacagtaacataaatttcaaacaacagtggcataaaattactaaactgaatatagaaaagaaagcatttcggttctatctataattctaatcacaaaagtaaaataccactttactctgatcttctgaggccagaaagagccaaaacaaaccacaagtgttagctgtgggggcaaggtccacaaacagtcgaaagtacaaatgaactctataagccgcagtaacaaattactagtccagtagaacacagtaatgtcaactcttaccacagaaaaaaaatcttgactaacgggaaataattttaggaaccataagggtatgatgctatactagaactacagctcgcatcaacattcctagtatcactaccggtatctagagtagtcatccattgcccagctatataattcgtgcaaagtaagcagcatggaaaaacacagtcctatcgggtagcattttccaccaaaatgaaatacggtggtgtggatatctccattcagacaggcagaacatagtatgaacgtcagtttatgtcaaaaagaaacaaacagcaaagcagtaaagccatgccaagtcaaagagtaagagtaagagcgagctcaacgatggaaagaaaccagcgcaagaacctgactacaaacaatacaagaaagcttgccaggaaggaagtgacaagcaatgcgggatcaccaaacctgccgcaggcaaggcaggggacgcgtccaccttcaaggtagctccgcctctgcgccgcgctctcgttgagcatcttggcgtacttgagaaacgccctcctgagcgcgtgccggtccaccgcggcatgcggtggcagctgctgctgctgcggcggtgccgcctcgaaccggggttgcttggggtgcctgctgtggaagccctcgtcgtgctcggcgaggtgcttccgcttggcgtcgtgctgcgccagctgcagctgctgctgctgcggcggcggcggcgggtgatgcggcggccagacttcatggccggccccgcgcgggaggtgcgggagctggggcagaggggtgagctcgaaggggtaatcaggcggcagggcgaagtaggtgcgcacgctgccgtcggcgaggagcatggtgcggcggtccaggttgtggaagccgtacgacggcgggggaggggtctccacccgcggctgctgtgcggctgcggcggaggacggaaggcggcggccgacgacgcggcggggttgcgcgcgccagggccaggaggaggcggatgccgcctggggtcgccggccgtagacggggtcggggtcggggtgcgcgcggaggtggacgccgcccccgcccccttctccccggcgggcggcggcgggccccagcgcgacttgcggggcgccatcgcggcggcggcggcggaggaggaggagtgcttggggtgaggagggttagggttcttcatcggattcgcgatggattggggaattcggggaatgggggggattggggatttcggttttggatttggagcttcgctgctgcggagcacgaagctgtttcactggaaaaggcatggaattggaaggcgtctccacgactttacgccatccatcgtggaaggcgaaggcgtatttctgtggtcaaccagcttaagtttctctctcctttttttttcaaccgatattttttttaaaaaaaaaaacatggtactcgtgtgtacactcactctcataaacatacgcgcataatcatcttgttatcgatatatatgttgtctatcacaattgactcgcttttttaataaataataatgtgtgaaatgcctttgcttgatgccgtttgtcaattgtaaagcaaaacattccctgagcagcattgtcaacaactatatagtgtcaaacacattatatatggcctgtcaaacacattctgaaaaattggcgcatcaaatggaaaagtgattttacacaccatgaaaaaaaaagattaaatatatactatgaaaagtgcttgccctattcactatcatatctgtcgtttttatttctggctttgtgtatgaagttcggacttcattttttatggaggttatgtcaatataagttatattgtcaaattttaataaattttaataacaatttgtattgtatcctatcttactataaagttatcccccactaactccttaaacttaacatgcaaagatgtcacatcatcattcactaacaagatggcacatcatcatccactaattaacaagatgatacatcatcatccactaacaaatcatcacatttaaacattatgcaaacatgctatatttttatagttattataatttaagagcttttcaaatataaacatgttaaattatcatccaacataattcacataatgttttaatgtatatcttatatacttatatagttcatcctcacttagttagtgcttaaatgattaatctatggtccaaattatctttctccttttttcctctaattaagtcatatcacatcaattggttttagcctttagatgattaatctacagtccaaactatctccctactttttttcttccataaaatcataccaccttactttttacgtttcaatcaccatttacatactatttaaatttaaattatcataaaccatattaatttacttaatctgatgttatctagctatcttacacgttattttttttgttatcatactaaattcccgcagcaatgcgcggggtttcacctagtttataaaaggtaaaggtacataagataagaggacatctcctcgaagggtaaaaaaccacttcccatgtcaaacattagatacacaaacaaacctaaaatgatactatattacatataccttcttagcaaaactcaattacctactatatacagaccaagcactcaattagctactatgatcaaacatatggtgatatggcatctttgtttctctgaagtctgaacaagatgaagctctcacacttcagtgccactaaccaaactgatactgggatcctcctccatctgctgaagaggctccaaggtggcgacaatgtcgcgcatcaacggcctagccttggggttgcggttgaggcaatggtaggccagcatcgccgtcttctggactgccttcaccgggtagtcctcggcgagcctggggtctactatgccaagaaccttcttcttctgtatcagcattgggaatgcccagtctgccaatgtctgctccctgactggcctggacttgtccaatgatttgcgccctgtcaagagctcaaggagcacgaccccgtagctgtatacgtcgctcatcgctgtcagatgccctgaagtagcagaaaaaacagaacattggtcaggtgaagtagaagtatattagtctgttcaagattcagatactgatctagcaatgccctttgttttgttcagtgtcaagggatcaggtcatgtctacagtggcaggccaagttcagttggcattgaggcattgagctattggcatcaacctaaattggctaggatgttaactggtgataactaggcttattgttcatttagagatgcaagatgaagatggcactacctgtcatgatgtactccggggctgcataaccgtaggttcccatgattcgtgttgaaacatgtgatttgtcgccgactggtccatcttttgcgagcccaaagtcagagagcttcgcattgtattcctatacaccaaattagttcaggaatcaaacaagaaaatggcaaccatatggtccatgaaaaatcagacaacaacactttactatcaactataggacattttactagagaaaaatttctaattctaatttatgccccattatcattaaattcagttggcatgaactttcttgaataagaacatttaaacagcagaaccgaaacaagtgtaggttctccttgcaagttgcaagaaattttaatgttaggcaaatgagatatgacatgacggttaagataaaaaaaaaaactccatctacctcatcaagtaatatatttgatgtcttgaaatcccgataaatgactggcttctcagcttcatgaagaaaagcaagtccttttgctgcacctagtgcaattttcattctggtgaaccatgggagtggtaccattacccctgtgttagtaaatatcagtacttgaacaaataacaaatatagtggctgatttaaatgaacagataatgcataattgatcatcacattggttatgcagtatctagaaagaaaaaggattgtgattcataggtagtagatgataggcacaacctaagaacacgtcgacaacagcatattaaagtatttattgcatctgtcaaaagaaaaatgatttattgcatagtgtatcatataaaatggaaatcccattttaattctctcgtatctgaattctgttccacactcgcactgttggactcatgtaatcaaaagataaagtgctacattatgaaggtaaaattgaaattcagcaaaacaagcaacatggtttagccttactcgaaaacaggtgtgattccacacttcccaggggcatgaactcataaacaagtactctgtggtcatcttcacaacaatacccgatcaacttcactaaatttgggtgagagagctgcccaagaaatatgacctcagcctgcaaacaagaaaaataattttatatctgacaacaagaaagcaaagaatggaagaacatatcaagataataacttgatacaaatcatgcttttatcaatatagtactaatcagaaaggccaatcaccagccactctctatgcccctggaaactattgtctccatcatggaccttcactgcgactcgcagtggctcctctattgttaatccttcgcgaagatcactggtgatgtatcctttgtagactctaccaaatccacctccccctagtaatgaatcctgcctgaaattttttgttatcctcttgagctcctcaaatgtgaatgctatcagagggttccgagccgactcccttctcagttcctccacctctttcgcgttcgacggcagcatgctgtcatccttttcttttctctcagatgggctctgcattttaggtgattctgtaacaacaaaaagataagcatgtcactggcttgatagtacctaaagcatagattataaatgattaggaatgctttgtgaagataggctaaacatgagtttctcaagataaacaaaatttcacatggcataatgagaacttatggtaattgacttgattttttttttaaaaaaacactaacaataagtatagccacctaaaaggatcaaactaattctgcaggaacggaatagtaatttcattatgcattgaggcaggcatgtccttcgaattattaggatttcctttttgctaaaatcggcagcagtttcaattcattaacaaacagtgcaaatgaacatgtagctctctatatatttaggatcaaacaaataatagaaagtattgcaccatagagctgcaacttcataatcacatagaccaaaccaagaaaggacagtggtacctgattttgttgcattggaagaaaccctgttaaagtatggattccctttaaaccagcagttacccataatacccaattccgcgctttcaaaaaaaataatacccaattcctaaagaacaactcagctttctctgtctgacccagaacaccaagaagaggaggcagcaggcagagatgtctgcaatgagaaaatggtttgatggctgattctttgacacagaaggagccttaatactatcaggactagaagaagaacaggctctcttaaatagaaggcccagccaaaaatggggataaatctagaagaagaaaagaaccaccaagagaaaagattttgggctttttgttctcatatgagagctttctcagaaggaacaaaacgcagagatgaaaacgaaggtctcaaccgaaacatccctgtctgtatttatcatgtgtttaatgaggagaaaccgaagggtaaacgcaaagggggcaaaaagaacggaatggctgaacagttcaattctggtagtccgtttccttttatacataaacacatcctttacagcaacggcatggatcttgcatttaagaagggtatggaagatttctctttttctttggatttttggttttgtggaaggggataaaaaggggagtaggaaatgcagcaatcagacagcagataaaggcagtacactcaccaccaccaagaaagaagaagaggggtgcacttgagtttgagtgggacaatggagagtgtagtggtggccatctctcctccatgtctcttcctcctagattccattggcttttggagttgagacttgagaccccttgaccttggttgggtttggttgggtttgctttgccctcactcctttccaaactgctttcttggttgtggttgggagttgcaaggaatgcactcatctagcctccatctgctgcttgaatcttgatctttcagtgagatggatggatggaatgatggggtttcttggtggacttggatatggtggtgactagtggtgcccatcaccacccactaatcactactcctactcagtaactgcggccacaggtaagacttatgactgcactaatccccatttctttgctgctagaagaataaaaatccctcctttttcacccctccttgtggtagtagcagtagcagcattcgctttctttctttcttcctttcttttcctggtgatgattaacctttgttgatggagggccaagtggatgtctgaatcacagtgccaggtttgcaatccccaaaaaaagacttttttctccaggggggagaggagaggttgcaatcgccgcaagagtttgtgttctagtggaaatttttcttggacttggccgctgttctggctgggcatgaggatgagagagagagagagagagagacctggaccagtgccaatcttccaagcccaacacccaccaaagccatcaccaactagcaccaccatttgatgagttctgctcctttcctcctcatcccattaggtacaaaacatctgctctttgtccaatttgggggtgtcactgtctccctccatcctcttcttcatgtccagacaattgtcatgcccaggttagcctaatctttgccttagtttatgatcaagaaatgtggctccagatacagcacaatggggcctgcacccactaggccactagaggcagttacagttaggctgttcctacatgtgcatcatatagttacatcttgaattatctactagattaggttggtgatcctgtcactctattagattagtctttggagttctctgactaggggaggtgtccatgtccccttggggctcagcaacacaatgtgaaatgtgaattgcttgttgcattgtataggaacagtttctcgtttgatcgaatgctaaaccacgacattagtgaacaaataagcatgtcggtgtgaccaaacaatatatacttctatttggatcggtgtgggctgtctgcttgagattaatcttaatgcgcccgccaagtgttcgactgattgcctgtgagagtagtggtgctgagctctgtatgtttgtgggtagtgcgctattaggttgcccaattttgatctcaccagtgcttaaataaggctaaattctaggtgattggattgtgtgagctccagctggtgttgcacttcttcttggctgtccattttgtgctagtcctaattatgtcgacaccggctgctaggatgtataaattcggattgtctttggattttgtatgactatttgcaccttgagggtgctgacagattcgtctgtggctggtgtgaaagaagttaattgactagagtgagcatactttggtgtgacatctaggggatattttgtttaggttcgaatgctgcttgcagcaactcacagttggcatatcatcaaaatagtatgatatcattgtcatgctaattaacagattaacatctcaaaatctattactcatgagagtagccttcacctacaaaatatcaaagaaaagggacatgatagtaaagagctgattctagggaaagttaagatttcacttttctctcagccatcgagttggagtagttaaccatctatatgtcatggaagaatacactcttcggaaattcaacaccttaaaataaaatagaaaaaacaaaacctgagttcttctttgaagcaataaaatcaataactcctattagcacaagtctgtaaggctttgtgtaaagttttgttacgtcaaagaaacggggtccacttgggcttccatagttgtctggtcctagaaagccctaaaggcaaataaagtagtgcttgttaatcttgtcatttggcaattaaaaccctaatttttaactcttagtttctagtctttattatcagcgtactgtgtgctttttgtaagtcctaattgcaacctatcagctacaataggctgatgcatgctcttattcattttactttctatttttttattataaatcttctgtatttgttgatgattgttcttattctgttattacaatagttcattatgtagttgcagtttcagtgtttcagcaaattaatggtttttaccttgccatgaactcccaatatagtcaaacagttctttttacttactttaaaaggtatagttcagattagacttaagtatttgattcaagactttttgaagccagtggtggtggactaaacttaggtacaagtggccaagtgacaaaacaagcacagttaatacatttctgacaagccagtggtggtggactaaacttaggtacaagtatgcctgaactgtccaattgatggaagtctatttttctgaatcgtagcattgacttttagaaacttgtggaaattataaaaaaaaataaatgacattctcatgttcatttgcaattttgtagcttatataggataggattctggcttcactacatgatacagagcttgatcttactagacgcggcataacttgaatttcatgcataaccataatctgcattctctcagtttgttcctatagatgattatcattttgagtgctattgactttttaaggtcagatttttcaggaatactgggacactttgccctctcttcgaaaaatcttgtcaatgcgacttctctagatatcacagctgacagtgatgagtttgatgctttgcaaggcaggttgggaggacagttcaataaatactccacagtttccatcccatgtctgatgaaggttcaggagttcatgtgttggaaagcctacctgcaaggctgcaactggccataagaatcctcctgcaaaaaatgtatactcatttttcatgaactgcgtagaatggacagttgccatcatcaatccatccttgccagttgccacccagatgccagaaaatgatttggcatctgaagtttcataactatacaaaatatgcagaacttaaaattgatagtacaccatgcagtaagcttctacggtgagtctaaaaacatgtactcctgtatcaaaaccattgttctgacaataccgaccagcctcccaaatctcaattggatggaacatcatcaattgacatgaatgcaggcagccactgaacatgaatgcagatccaacccatatggaacccattgtttgctctgttgtatccaatgatgcaaatttacatattataatgcacagaaaaggcaagattgatggtcggtgaagcatggtttttctgtgaagtgaagaaatgtgattgattgaattcatgtcatggggtgttcggtaagcttcatactgtatgtatgtcggatacttcaggttcttctttatatacctgtaatgattctccatatttccttctgtaaactattatctttgcattactgaagtgcagggcacatatctactggatgtgattcaagatatcctgctaaaatcgtaccacacgatcaatcaggtttctgtttgcctccatgttcttgagtgtctataatagcatgtaaaaaggatatttccatcttattaaggccccctaaacagtttattcatcatcagttaaaaagttgcaatgaggttggctctataagcatgctctttaattctgtgcaatgctagatgatatgcctaccacttaattactacgcatgctagatctacacaaccagccacttacaagttacaaccatctgaaatatattagttgattgagtgcaagtggttgaatgcctgtaaagtagggcgtgaaggattataccataccaaaataagcatggtccatacagattaggaactatttttttccctcaaagtatgattgttctgtattttttttagatttgcactgccatgagtgttcacggattaagtaatggttagtgagaatgtaattattggcattagaaactgtacataaaagttgatagtgcatggctactatgttgatattttgttacctttttacttatgctataaatggttgacaaatactagaaaagagttcaggggaacaattactagatattttaggttctattcaagtattatgcatttctcgctgtagtttgctgaaacctcgatgctgatggtaggcataagtttatcttgtcattaaagtatatcttcaaggtctaatgatttgagcacaatgtgttgaagacaccttgtgtatttaattgaactctaaaccttagagtttagccttttagcagctatttaaactgaaaaccatgaggttagcctttacaggatctcaaaagctggtagatgggtgtctttttgccagttatgtctaacagagcactagataagatgattaaaacacgagttcaagaaggttaggcctctactaacaaaccaaaccccttaggtttgttatcttctactgcattgtacagtagctggactctctgtacttaaactctatagatttaatcatcgcatcaggcatctatagactagatcactagatggacaaggctgaggcatgatgcagcccatggaggattgtcagagccatttgttagctttggaaagcttgtcttgcaagcaccctacagcatggcacaagcacgtcccccacagaatcatatgttctgtcctctgtctacctctgtctatatatatatctcttctcccgttgcagtaacttcatcgtgtaaaggcaatggctgtttttctgcttcttctcattgtttcctttctctcatatcatcccattcaatccactcaagaatcacattcgcatgtagatttttcttgcagatgttactactgttttttcatctttttgtgaaatcatgtgtttcatgttatagttatacctgtgctttctattgtctttcaggttcatattgtgtacttgggccacaacgatggcctcaatgcttcccttactgcaagtcttcatctccaacttctatcaggagtctttacaaggtaattgattgtccttttttctactcaaattaaagacaaataacaaaagacacaccaggtatacttgaagttgaatgtgccaaaatagtcatatggagtgcaaaaacttcatcatctcacatgagctattgttgcgcaacactgtatctagattaaaaaaaggctaaagttgaattattaatttagaaaattcaaaccccttagcttagagaatctagatatatttgttcttatttggcgagaaaatgtggctgaagagtgaagcgtcacttgtgagctcaacttttgtaggtcggatgaagcaagagatgctattctgtatagctacagctatggattctctggttttgctgcaatgctcaattcaacgcaagctgccaaattatctggtatgcatttacctttatcccgttgactttgttctcagaatatacctgtatctacctagttaatttccatgaacttaccaaaaactccaatgatcattatatgagcagaagcagaagaggtcatatcaatattcaggagtaggatgctcgagatccatacaacaagaagctgggacttcatgggcctcagcctgcatattcagaatgaacaatcagccggaatgcaattgaaatacggagacgatataattgtcggtattcttgatacaggtaaatttcctgacagtttcatatacctgtaattccagtttcactctcatatatttgttgctctatattcccaaacatgaagtgcatggtgttctagccggaaaaacatgtggtccaaccacatcgcgagaagttcgagctgatcagctgaatggtgatcgatccctctgacctttgtgttcagacaaatgaaatgagcaaacttgagatgaaagataaaatcatgtcttgcatcttggcatgcgatgcgaagatctgaagctagcatttcttttactactcattcatgtactcctactgtgaaaatgcgcaggagggctcgaagctaaacaaacggtcattccagccgcgcgccgggcgtacatccccaagcaaaccttcgccttctgccaatccctcctctcctcgcgcctcctcctcccgtccgccgcctcccccacggcgccggcaccggccctgcccgtgcaggcgctactcaccaccgctggcctcctgccgcaccaccccgacctctccctggtcgcgctcaactcgctcctccgcgtcctctcccggcgcgcctcctccccggcccacccgctcctcgcgctccgcctcctcctgctcatgctctcccccgcctctcccctcccgccgcccgaccacctctccttccccttcgcactctccgcagccatctccccgtcccacgggaaccaggcgcacccacagcgcatggagcaggtgtccccgcatacacctgcttcgcaccggaccggaatatagttggcaaagcaggagcgaagatcggaaaaagaatcgtatcattcatttcttttagaatttgtaagacttacggtgcaaaactgaagctaaggcatgcaaacaaaaaagtgtgagttcttgcaacaaaaattcttgttccctctctaaattctgatgttagggaactattcatacattacagcatcagcgagcctacttattatcttccttcttctctaatggcctgagatcaatgtgtaatgtgttgataaacctcagctcccactagattcttttcctccataaataccagctgctatctcaggctctcagctctttgtgcagttgtgtttgataaaacctctagggaaaaatcagttcggctacctacttctctccgattctccctgtcacgagagcgcggccatggcctcctcctcgtccggctcctctcccatttggtcggcaagcagcccgagcacctcccatatctccacgcgctgcgggtgcgcctggtcgtcggcgacgaacgacctcaccacgccgtcgacctccaccgcgctgtacgcggggaccttcctgatgccgcggctgccgatcagcttcctgaccctccgcgcgtcgtccttccggttggagtcgaggtagatgttggagagctgcacatacacaccctcgtcggcgccgagcttgccgagctcggcggcggccacctccgccagctccacgttggcgtatgtccggcagccggtcaagacggagccccagacggaggcgagcggggccattggcattgtctcgatcagtgccaccgcgtcctccagccgaccgacacggcagagcatgtccactgtgcaggcgtagtgctcgtgccccggcgcgacgccataccggcggcgcatctccttgagcagcctgagcccgtcctccaccttgccggcgtgcgcacacgcggagagcgctccaagcaccgccacgccatccggtcgcacgccgtcctccctcgccatcctgtccaggcacgacacggcctcctccgccatgccgtgcaccgcaaacgcgccgaccatggtgccccagacgtagtcgttccgctccggcatgccgtcgaacacccgcaccgcctgctccaggcagccgcacttggcgtacatgctcaccagcgccgacccgacgaacgcgtccccgagcagccacggcgcgctcgcctccacgtaccggtgcacccactccccgcactccagcgcgccagcctgcgcgcatgccgcgatggccgtcgtgagcacaacggcgtccggcgccaccccatccacaaacatcgccctgaacacccccagcccctcgcccgccatccccgtgcgcgtgtacgcgccgatcaccaggtcgtaatgtatagcctcccgcctgggcaattcg

SEQ ID NO: 36618 - DNA, 9438 bp, Oryza sativa
acgcggaggagcgagttgagcgcgaccaggtaaaggtcggggtggcgcggcaggaggccgccggtggtgagtagcgcctgcacgggtagggccggcgccgtgggggcggcggcggcggacgggaggaggagacgcgaggagaggagggagtggcagaaagcgaaggtttgcttggggatgtacggacgcatgctcgcacggcgcgcgccgaccggcgacggcgtgaggcggaggatgccggggaggacggcgacgggcggcgacgggagaaagggagagatagtggcggcagtggacgccggcgacgggagaggcggccctcctcgtcgtcctcgcggcggcggtggcgagagggagaggcgagcggcggcggcgagagggagagagagaggcagcggtggacgagcggcgacgagagagaggcagggaggcggccctcctcgtcgttctcgcggccgccggcgacgggataggcgagtgcggcggcgaaaataaaaggagggagaggcgagtgcgaagaaaaagagaagagggggcgggaaagagaaactagggtaggtaagtaaaagtaaacatgggactttgtcggctgagatacaatagcagactattagtcggctgtaaatatattttagtgagataaaagatgagagagcagagcagcgggctacagatctgtagccagctgcagcacggactctaagacacaatgtacaatgtgtgtatgacatgtgggaccatatattaataatatagtaagcaactattgtatgaattgactatagataaattggagctaatagtgggctatactattaaacttgctcttaagttgtttcagattttgagaagctcatctagggtatgatccattgagacatgagtgtcctctaggattggctttgattgaacatgcccttacacgatgaatctgttctttttcatgtgttttttcaggtgtgtggcctgaatcccagagcttcagggatgatggccacctaggcgacatcccgtcgtcatggcgcggcacgtgtgtggagggcgagaagttcgacccggccacggcgtgcaaccggaagctcatcggcgcgcgctactacctcgccggcttcgagagcgaggtcggtccgctcaacaccagcggcggcgccgagtaccggtcgccgcgggaccgcgtcgggcacggcacgcacacggcgtcgacggcggtgggcgccgtgtcgcccgacgccagctacgtcggcggcctgggccgcggcgtggcgcgcgggggcgcgccgtggtcgcggctcgccgtgtacaaggtgtgctggttcaaggacctgacgggccggtgcagcgacgccgacatcctggcggcgttcgacgacgcgctgcgcgacggcgtccacgtgatctcggcgtccctcggctcgacgccgccgctcatgccgctgttcatgacgagcaccgagatcggggcgttccacgcgatgcagctcggcgtgccggcggtgttctcggccgggaacgacgggcccgacgccgccatggtgcagaacgtgtcgccgtgggtgatcaccgtcgccgccagcaccatcgacaggaggttcccgacggtgatcacgctcggcaacaatgtctccctcgtggtaattaacctcgctctcgctgcttctctaatatggcgtctactgtttgtagtggacgcacgatatgacatcacggctcttaatggtgcacgtctacggtagttcactgtcatgtgttttatggtggtatggaaatatttatcttcgagtgcagcagccatgatgttatcagtcttatccctctattttttttttgataatcttatctctctattatatttaagctactccctcagtttcatatttttttcgtagtcaatttttttatatttgatttagtttataagaaaatagcaacatctataatattaaatttgtaccatcgattgtagcattaaatatattttgatagtgtgtccgttttgtgttgaaaatattgttatattttttataaaattagttaaacctagataagtttgactaagaaaaatttatagtgatttatattataaacagagggagtattaagatagctcggaaaaaacaccacgtttactttggggttataaatttcctcataaattaaatcagagaaaaagataaatgtattgagaaatcgtggtgggtctagattataacagtcgagatgtttggtacagttgtatacaaaatataattatgtgtgtgtataaacataagctagcaagctactagttatctgtaatctgcacagaattgtatcttacattatgtgttttagtacttttatatataacgtggtttgctttgtgtgaaatcaagtaataatgtatgaaatgactggttttttgcatagggagagagcttcaatgtgaatgacatgaagatgagattagtagaaagcggcagtgtcttctccgatgggtaatctctctctcacacacgtgcagtttaattggattaagtaatgattattgtaattggcagaacagtgagagataatatggcttttctaggcttgagactgagattttatacccaggtcatgatcaatatgaataagcctgaattatcttgaaaacgttgttagatagtaaaataataataaaaattattggaaaactatattagtgatgactactcctttatatggttcgcaaaatatgcatggaattttagaactctgttagaggaacttgtgagacatgagaactatgatccgcaaggttaataactggttagtggttttgtagctgccatgttgttcttaattgtgatcaccactaactgaactttactatatttgagtagaatctaaccatttgcaagaaaactgctctattcgaacagaaatacataaatattctgaaacaaaatgtgcaagtttaacacccattacgaacacttatcaatagtaataacaaaaaaaaacacaaatcaaatacttcctccgtttcaagttataagacgttttgactttggtcaaagctaaaatgctttaagattgactaagtttgtaaaaaaatagtaatatttttaacccaagacaaatttattatgaaaatatattcaattattgatttgatgaaactaatttagtattataaaaattatcatatttgtctaaaaacttagtcaaacttaaaataatttgactttgactaaagtcaaaacgtcttataagtactaagtaaagctagcaaatacataggtgtagtttctgcaaatctgcatccttgaatcacacggttccaattgctgtatgccaaggtcttgctcattcgaccagctaaccaacgggagccgggcggcggcgtccggcaggatcgttctgtgcttctccaccacgacggcgtccagcggcgtcgcggcgctggcggtgtacgccgccggcggcgccggcctgatcttcgccgagaccatctcccgcaggtcgacgcaggacaacttcctccccaccgtccacgtcgacctccgccagggcacccggatcctcgactacatccgcggcagcagccgcccgccgaccgcgcgcttctccccgagcacgacgctcgtcggcaagtcgccggcgccggccgtcgcctacttctcctccaggggccccagctccatctcccctcacatccttaaggtacgccaccacatttttcattctcgagagcgtggattaaatggtgaaaatggcatgattttattgcggggattatttatacatttgtcgataaatttcctgctcccttgttataagtcattttgactatcaaagttaaactgttttaaatttaactaagtttaaagacaaatatattaatatttataatattaaattagtttcattaaatcaataattaaatttattttcataataaaattttttatgggttgaaaatgttactaattttttctataaatttagataaacttgaagcaattttttttagggaaaaacttgaagcaatttaactttgactaaagtcaaaacgacttataacctaaaacggagagagtacaaattacagtgtaactctattatacttacatgtaactataatacaaattatatataacttttaaaaacattaatacggaaacatgctattttcgtgaagcagacgtttcatgacaaatgtcctcatccatacgcacactatgattttatttttcaaaactatgtaaaaattacatataaattatattgtaattacatataagttacaatataactaaactatatttgcatttgataaatatttaggagaaaatcggatatattgcaaaaccatttattcgtgtgttttggtttgtgattcgtcgggtgcagcctgatgtcaccgctcccggcgtgaacatcctggcggcgtggccacccatgtcgtcgccgacggtgatcccgctggacaagcgctccgtgacgtggaacttcgactcgggcacgtccatgtcgtgcccgcacgtctccggcatcgtcgccgtcgtcagggccgtgcacccgacgtggtcgccggcagccatcaagtcggcgctgatgaccacggcatacatgtacgacgacacgtccgacgtgatgctggccggcgggacgctgaaggcggcggacgcgttcgacgtcggcgccggccacgtcgacccgctgcgcgcgctggacccgggcctcgtctacgacgccggcgtgcgcgaccacgtcctcttcctctgcggcctcggctacaccaggtaccagatacgccagatggtgctcccctcgccgtcgctcgacacgagctgcggcggcgagggcggcggcgcggcgccgccggagtacgacctcaactacccggccatcgtgctcccgcggctcaacgcgacggtgaccgtgaagcggacggtgacgaacatggggccccggagggacgccgtgtaccgcgccgccgtcgtcagcccgcacggcgcgcgcgccgccgtgtggccgccggcgctgtccttctccccgtaccgcgacacggcctcctactacgtgaccgtcgcgccggcgaagctgtcgcgcggccggtacgacttcggcgagatcgtctggtccgacggctaccaccgcgtccgcacgccgctcgtcgtcagggtcaccaccatgcccgacaccgacaccggcgtcgacgtcgacgtcgccgccgcgcgcgccatggacacggctactgccacccagctgcaggattcctagctcagcttgttcagaaacctggtttcatctggtcatcaaatcatcagactacaaaaattgagatctttttgggtgtggatttctcgagcttggagttaaaatttcttcggacaagtagccactaggtgtcagtgtgtcactggtcaagtactactaaatgagcaaatttctggatgctactattactgtcatttctatggcggctaatgatgcaagaattatttatatgtatgatgatgtgagtaattaaaaatttgatgattcacctagatctgggggagcattattgattgagatgtgtgcaattcagcttcgacttggggaagcgagctggggaatttcagcaaggcacggcaagccaagccaagacaagcaactggctactgagagcaccagtaatagtaaagtaatgtgctatctataaaacatgtacatctcagtaatagactagattaatagtaaaccattaatctattgcctcgtttttctctatagactatcttcagattagtagatatatttgttctctctcttcatttaatctcttccaagtaggaaaatatgctgacatgtatctcttgtagagagtctatagataaccattacgggtgtcctgatagggagtagtactgctgtagccaagctcgagattctaaaatgcaattggtgagtaatcggctgacgagaatcttgaatacttctgatttttaatttaatttttcgattttataactaaatattttagaattcaagtaaatcaagtgggaagtcttaggacaatagtagtgtcctctagatttgtcgaacctcacatgccacctaaaccaagaatgtgttaaagctacatactcaacggtgtaagttgcttgtagtaggttccacaagtaccatttcttccatttttcatctcccaccccatctctctttcctctactcctttcctcaccggcggacgaagccaaggcgctgggtggagcggcctaaacggtgacgaccgacggggcggcccaagcggcaatgacaccgggtggagcagcagcggggcagccagatccagccgtcagggtcggggtgctgttgcgtcaccacctccgcaccaaatcgctgccgcacccaactgtcgacgagctcatgtcctcgccgccggatgtgatagcgagcttagggtggatctggctcggactcaactccctcatggctgccaacctcgggggatctggatctggcggttgtaagttcaagtgccttaatttggttttggtgattaatgacaaatctaactatatgagactaatcatttttatgagcctttctttgactagtctcatttggatataaaagtaaaaaatgatgagaggtatgtattaaacttcacatattctaacttggtctctcttgtggatccaaaatatagtgtgagctttctatttgatctttattgattatgtgcatatgcgttccttcatatccatatgtatgcacatcttgagggggagcttattctatattttgtttattataagatttctatcttgatttgaaatcatttttcatctcatctctctatattgtttatatcgggttattatccatcaccaaagagagaaaagattgaaagatcttggattaaacaatttgtgtaattgttgctttggtgatagatgataaaccgatgtttatgggattaacctctcttttgcataagttgtctactaggttatttcccgataatgagatgtggaagacatgcattcttttgtgatggaccttaataatgacaaggatgagatgcatggagataaaacgatatgtaccacttcttatctcctactttttgataggttcatatatatgatttccatgttattgatatataagtgtgagactaatgtttactcgaatgttatcttatttagtctcatttacattgagaacatggagatcatgaaggtatatgttttatgttggtctacatcattactacatatgccttctctatatgtataggataaacccccattggtcattctctaattatgcatacacttgtatctcttgtatatttatttgtatgcatatatttagggggagcaaatcctatacatttattgtgcatgttctagatccatattgttcacctattatttatatcgaatctttgcacttgagcttgcatacgagtatatgacacttgtgatgttaatgaatactcaacaaatatatccatatctttcatatgcaaccggttagtcatcaagtgaaggatgacaaccgatttgttgagactaatgttctcctttgaggtgtgaaaaggaataggtcccactacgatgaggctaatgaatgacaccatgggttagtggtcaccgagccaaggacatcgtcatgttggcaagaatgaagtcaagcttgtgatgagaataaagtcttgacaaaggatggacaagacctcagcataaacatggttcaaccggatggtcacaagtgttgatctcgactcaagcttgacccccaagatggatggcgcaaggcaaagatataatgtagctaagagtgttttcttagtcttttcccggtctttgtgtttggtgtagaccggatttgctagataggcgccgtactatcaagaggggtctatgaagcgagcttgtggataatcttgtgccatattagttcatatgcatgtaggtgcattttttgggcttgtctaaccaagtgtgatgagttttctcaagtcctaaaccaagagagaagtgggcatgtccaataggagtgagtgacatcttgtgggtatgtccggtggatatcctttggagtgtgagccctttatccttgattaagttgtgtttcttggatggatttttcatgggttggatggccctttgaataagctttccatagagtccaaaaacgccaaattccgagacccgagtcaagagatatcgccgttttactaacggtcggttgagctgaaaagtgacctgcggtctgaccgtgggccttaggccggtctgaccggcgtggtaaggccggtctgaccggccccactggtctgttgcactggtctggtttttggtggcgatacagagccgccagagccgcaaccggtcagaccgagccgacggcggtctgaccgagccgtggacggtctgaccggccactacactgcggtcagaccggccaggttgagtgggctccatgattgccctgtaacggctagttttctagccgttacaaagtagtccggtctgaccggcctcacaatggcggtctgaccggcagagcacaaagttggggatttcggttccaatggctagttttggtggttgggggtatatatacccactccccagcagcaagggtaaggttttggcactccattacattatcttgaacccttgcaagagctctcacacccttgtgcacttagtttatctagtgaggtgatagagagtgagttaagccaatccaagtgcattgcttcattgttatagttagtgtggcacttgatcatcctcggcaagcatcctagacttgttactcttggaggttgccgcctcttaaacggcttgtgtaggtgttgcccggtgacctctccgaggagattgtggaggaggcccggcaccgtttgtgagtggtttggagttcaccacctttggagtgaaggaagaactaccccgagtgatcgaggcttgggtagtcctctccgtgggccggctcccgccttgcccaccccttgacgaagggggcgtgcggtggcttcgtggttgggcgggtggagttgggctcacctcaacggggattaggaaaccggcgagtttccgaacctcgatgaaaaattccttgtctcttgtctcatttatttgttgcatttacatttgtgctatttacattcatagagacatatttgagcccatatcacctagtgacggagcgtggggctcctcaccgggagaccgcgcgggcccccctttgccggttcgaccgggggcgctaggtgaggttctaagccctcgatctgtgaaatgtttcgcgagagagcaaatgcgcaagacacgggcgatgtagacaggttcgggccgctgagaagcgtaataccctactcctatgttctggtggatctgtgtatgaaggagttacaaagagctggagagcaagagagttcaaactctagagaccctctcactcctc

SEQ ID NO: 36619 - DNA, 18962 bp, Oryza sativa
gtcacggaccgaacgagtgtgctgcgctgcattaaatgcggcgtgggacgctcgtccaacccgcaataaacgcggttaggtgagcgccgctgtgctcacctaacccacacacgtggcgccaaacccacagggggtcggggcgccccagccctcggggccgaaacgggagcggcccgacccctcggggagacaaagggaggggcggccacatcaccctcgggcccgacccccccgagggggtcaggccaagtgggtgaccgcggctgccccaaacctctagtcaagatacccccggtcccatgtcaccgacagtagcccccggcgttatgccagggcgattgccctcctcgaggaaagtgctcgggcgtgacgccactccttaggcctggtgacaggtggggatggtccctacaggcgggcagaaacccaacggttgcaaatcgcgcgcatcggcaagggtgaaaccgatcgacaataatgagcggcctcttcaagaccgctacactactcgagcagcgcgcgaatcgggacgagccggtttgtttcgcctggggacatgatgatggcgtttttcgcggttggcgagcgcggttaatgcgcgcacgatctgccccatctaaaacgccacggccgcacatctaccgcgtgcgccgcaaacgggcgagtgtggttagtggaggcgcgggcgcgagagacgagggggcgaggtagtgggcgcgggaagcgaggagccgggcatagcgttggcaagggtacaaagacgccaaggacgggatttgtttccttcctctcgccactctcccccttgccttcgccacttgtgctctgactctccgtttcctgcgccctacccttgccatactcgctcgctctcaagctcctcctccgccggcgtcatggcacggggctccgcaccgctcgagggtagcgtgctgccgccttcccgcatcgtgagcgagaggcaggccgggctaccgcgccgatttatgccggaatctgccaccggccgggaggtggtcgcgctgggcgagggacgcccggcgccacactacccggggcggtccgtcttcttcctttcctttgcaatggcagggctggtcccgccattctcttctttcttcatggatgttctggagctttatgatctccagatggcgcacctcacccccaacgcggtaatgacgttggccatcttcgtgcacctgtgcgagatgttcatcggggtgcgcccatctctccggctgttccggtggttcttcaccgtacagccagtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtctgcgatcccaggggctcacgggggccatggtgtacggcgattaccttcgtcgccggatcgcgccgctccagcggcgcgcccggggcgcttgggagtacaccgggtccgaggactacatgaggacccaccagggggtcaaatgggactgggtccctgaagacatcaaggtggtgatccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccccgtgtcgggggcccggggggcagccgccctgccgacgcccgggggaagaggaaacaggaggataccccctccccatctcctccccgagggggcagggcggtccgtgccagcagcaggcgcccggagggtgctgtgccgacgtcgcggcccgagggggagcgaaaaaagaagcggctccgcaagataggggggaccgaaccatgccggggaaacctcatctcccccccaaggtggtcgtttagccgacctcctcgcaggttcgtccccgcgcccactgcggccgtattcattctcccatctcccaaggcaagttttcactcacccgtttttcgtcttctggtttttcttctgcctcagcgagatcccgtcgcgcccttctcgccattccaagtccggccggtctgaggccgaggagacggcgaccgcggaggcccggaggcgggaagctgaccggcgagaagccgcagaccgcctccgggaagccgaagaagctgcctaggaggccgtccgggctcgccaggctgaggaagccgtttgggaagaggccagactccgccgggccgaggagtccgtccgggagacggaggcggcgcacgcacgccgggcggcctgccaagcccccgacccgactccacccgaggcgacaacgacttccgaggccacccacgacgaggccgcgggcgcgccgctcgggcccgacccctcgggcgacgttcgggacgagcccgcttcgggggacgcccccgagttcggcacgtcgatcggcgggccgagccgcgcggcgcccacaccgaggcggctctcccctctgccttccgctgcttcactgagcgcagagcccctcctgcaggccttggccgctgcgaacaccacggtgttggacgggttaagcgcccagatggaggtcctgcaggcagagcgggcggaggtcgatgcggcgtgggcgcgcgtcgaagaggggcggcgctcggtggaagccatggtggaggcgggccgcaaggcacaccgccggcacgcctcagagctcgaggcccgtcgtagggtcctggcggagatcgccagggaggtggaggaggagcgggagactgccctcattgccaccgccgtgttcaacgcggcgcgggacgacctctgcctccaatacgggagccgggcagtggagctagagaagaagctcgacgcgtcccggcagcgcgaagaggcccttgaggctcgcgccacggtgctggagaagcgcgcctgcgccctggacacgaaggagagggaactggcgggtcgcgaggccgccgtcgccatccgggaggcaacgctggcggcgcacgaggccgcctgcgccgaagaggagtccgcactccgcctccgcgaggacgagctcactgagcgggagcgagctctcgaggaggccgaggccgcggcgcagctgcgggaggagaaggcgcgcctcaatctggaaggcgcccgcgccgagagggccgcactggatcagcgggccgctgaattcgaggcgcgggcgaaggagctggacgcaagagcgcgcagcggcggggcggccacgggcgacggcgacctagccgcccgcctcgcaaccgccgaacacaccatcgccgagctgcagggcgcgctggactcgtccgccggggaggtcgaagccctccgcttgatgggcgaggtagggcccggcatgcttcgggacgccgtctcccgtctagaccgtgccgggcggcaggcgggcctctggggcgggcggaccgcgaaatacgccgccaaccaggggggcctcgcccagcgcctctcagagatggccgggaccctccagcggctccccgaggagctcgaggagacgatcaagtcatcctcgagggacctcgcccggggggcggtggagctcgtactggcaagctaccaggccagggaccctgacttctccccgtgggcagcgctggacgagttccctcctggaaccgaggatggcgcgcgcgcacaggtccgggacgccgccgaccacatcgtccacagcttcgagggtacagcccctcggctcgcgtttgccctcgactctgacgaggagggcggtgacggtggtgcggacgacagcgacgacgaggccggcgacccgggcgcgtcggcgtgagcccccaggcccccgccaatcttaaatagctttttctttcttcttctgaggccttcgggcccccttcttgtataaactaattcaatctgcaatcaaataaagaggaaatttttgtgtcaactctgtttgttgtgtgtatgagacgaggatggtttgtgtcgcggtccttctgtgtcttggcttgaacgagggctcgtgcccaggtcccaacctcaagcggcgcgggtcggggctagtgcctggggagatccgcgtgtcgagactggcctggccgggaacgtggtgaccgagggttatggatgacccgattgtgggcctttgccgattcccccccggagttcacaacgccccggggcacggctcggttctgggccccgtttggcgattttagccggcccgggccaccgagggcggggtcgggcacgagcatgctaattcaagccaagattcttcaaaaggaaacgatggctcagacacagtccttaggaaatcgaaaatgcctttattgaaatacggaagagaaaaaatataagcttatgcatgtggtagcccccggccaaccctgcacgcctggggggcgcggggttggcccgagcccgagacctgacacccgacccccactaggggtagaagcgatgaaggtgttcgatgttccacgggttaggcagctctgcgccgtcgcccgtggccagccgaacggagcccggccgggggacaccgatcactcgatacggaccctcccacattggtgagagcttgctaagttcagcacgcgtttggatgcggcgtaggacgaggtcgtcgacgcagagtgatcgggcccggacgtggcgctgatggtagcgcgcggctcggagggccgcgcgccgccttcgctcttccaagtagtcgaggtcatctctgcgaagctgatcttgatcagcctcgcagtacatggtggcccgaggggacctcagggtgagctcggatgggagaaccgcctacgcgccgtagacgaggaagaaaggcgtttccccggttgctcggcttggcgtggttcggttcgcccagagcaccgctggcaactcctcgatccacgagtcgccgtgcttcttgaggatgttgaaggttttggttttgaggcccttgaggatttctgtgttagcgcgctccacttggccattgcttctggggtgggcgggagaggcgaagcagagcttgatgcccatatcttcgcagtagtcaccgaagagttcactagtgaactgggtgcctttatccgtaatgatacgattaggcaccccaaaccgagcagtaatgcccctgatgaatttaagcgcggagtgcttatcgatcttgatgaccgggtaagcctcgggccacttagtgaacttgtcaacagcgacatacagatactcgaacccgcccggggctcgcctaaacggacccaggatatcgagcccccagacagcaaacggccatgaaagaggtatggtctgcagggcctgggccggctgatggatttgcttggcgtggaactggcacgccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacgccttgttcccgaggaatgcatttcaggaggactccgttagccgcgcgccgatagagggtcccttccaccagcacgtagcgcttgagatgcgccggacgcgttcactcccttcgcggtcctcgggtagagtcttatctgcgaggtacgcctggatctcagtgatccaagcaatcaatctaggggagccgggaacgctcccctcgggtcccagaggcctggactccgacgggcctcgggggccgttcaggcgtgtccgtctcccctagcgggtcgggtcgcgccgacggttgggcaagcctttcttcaaaggcgcccggtggggtctgggctcgcgaggaagcgatccttgagagctcgtcggcgaccgcgttatcccgcctgggcacgtgccgaagctctatcccgtcaaaatggcgctccatatgccgcacttggcgcacgtaagcgtccatctgcgggtcagagcaccggtactccttatagacctggttaacgaccagctgggagtcgcctaacaccaggaggcggcggatccccagtccagctgccaccctgagtcccgcaaggagtccctcgtactccgccatgttgttggtcgcccgaaaatcgaggcggaccaggtatctgaggacgtctccgctcggcgaggtcaacgtgacccccgcaccggcgccttgaagagacaaggagccgtcgaactgcatcacccagttgacggtgtgaggcagctgcgaggggcccgagctggcctcgggggcggagacgggctcaggggccggggtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaagaacgtaacccccgtgacccgatgcgcctgaaaataatggcgcaacttcctcgaagccatcaaaatagtgtaaagcatcttctgggcctggaggtatctggtcttagcgtccggagggcctcgctaacgaagtagacgggccgctacacctttcggcggggccgatcctcttcgctaggggccgcatctccagggcgctcttcgtccgagaggccgcacggggcgcactcggcttctgtgccgacgacctcggggtcggagggcgacaggagcggccttcccgcagtggccccggggccatcctgggggtcgggggcgcctagcgccgtcggacaagcaggcggagggccagctccggccgtcgggggcctttggccgccgttcggctcgggggcctctcctccctgctctctcccgggtcgagtcgacacagggtggggatgcgcggggtgagggttgtcctcgtcgcgctccacaaccaacgccgcgctgaccacttgcggggttgccgccaggtagagtagcaacggctcatctggctccggggcgaccaggactgggggagaactgaggtacgccttcaactgagtgaaggcccgctcagcctcctccgtccagataaacggcccggagcatttgaggagcttaaataggggtagcgccttctctcccagcctcgatatgaaccgacttagggcggccatgcagccggtgacgcattgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttaacaaccaagtcatcaacataggcctcaacattacgtcctatttggctacccaaagaaattcgagtagtacgctgaaaagtaggacctgcattctttaacccgaaaggcattgtcgtataacaataagttcctatgggggtaatgaatgcagttttttcctcatcctccctagccatgcgaatctgatgataaccagaatatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgtcgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgccgtccagaagaccaccgattcgtgtggtcttggacgagccgtcgcccagggcaacctccttgaccgggacctcgtcgcacatgatcatccgctgcctcggggcggctgggacggaggtgctgagcctctcgttgccaccctcgggcttggacgcggcggcgaggtggtccgcgcgctgctccatacaagcaagcgcgactttgaggtcgccatggacagagatggggccacaggggcccggcatcttcatctggaggtaggcgtagtggaccgccgccatgaacttcaccaacgcgggcctccccaggaccgcgttgtagggcagactgaggtctgccacatcgaagttcacccgctccgtgcggaagttggcggatccaccgaaggtgaccgggaggtcgatatgacctagcggccaagtgtgccccggcgtcacacctataatcggctgggacggccgaagcaccatccccggggccttgatggcgtcaaaggctgcgggggaaaggatgttgagggctgcagccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccgacgagaagcgtgagcgcatgctcccccatcgacggtggcgatggtggccccaggctcctggaactctaggtcatcgtcgccatcgtcgatgtcctcggcgggggccttctgcttggcctcacttcgccggttgccggagggagccgccggggccttgccctcacgggctcctgcctcctctcctcctcccacttccttgtccgctcagccaaacttttgaccgcgtggcagtccgcgaggtcgtggagggaggtgttgtgcacggtgcaccacttgccggtcgggcgctccctgctgggaccgccggcctccttttttttgtcgctcgcaggcctcctcttttgggtggcccgcgaagcgccctcgatggcgaggacgtgtccctcgtcgtcggaatgggccgacctcttcttcctcctcctgtcccgccgccctgaccgagcggcggatccgggggcggccgaagctgccacaccggaaccggggagttccaggtccaggcctcctccttgcgagccacacggtccgcgagctgaaaaagctccgcagtggtctggggctccttggaggcgatcttttcgagcatgcggttgtgccgcacgcccccctgaacgcgtagattaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatgtgccttggaagttcatggtgaactgctagcacaaatcctcccaagagtggaccgacgcgggcggcaagttcattagccaaccccgcgcctgtcccttcagggccatggggaagaagttcgccatgaccctgtcgtcacccccggcggcctcgatcccggtcgtgtagacctggagaaactcggcggggttgacgcttccgtcatatttttcggtgatggtgggccggaaccttgggggccaacggacgttccgaagactcgccacaaaggctcgacagccgacaccaccaaccgggggcacggggggctggcccccgcgcccgaaccgaagtggcgctccggacgaggaaacgccttccgttgcgtgggcagcacgacgaccattgcgccggcgctcgatactgaggcgggcatccgaccccctacgcacatcttcttgggtcggaggcgttgacgagggaatggctgacgaacggcaggtaacggccgccgctcgccgcgccctccgccttgacgacacggagccggcggtagcagcgccagaggccttggtggcggaggaccgcccaccggcgcctaggcgctgctgcgccgtcatgaccaagtcggccacgtcatccagccaacatcgggctggagtctctggatcggggacgacgggcgggtgacgcaagagcgcgcccgcagcttggagcgcgccctggggcgtgctgccatcgccgtagacgaggaggcgacgctccccgtctcgccgtccttcttcatcgctcgtgggcggcgaagtcgcggatctttcgaccccctcgagcgcctcctcccgcctaagacttcggcgagaggggggcggtggagtacgagctcgacggcgtgggttctgctccccgtcgtcaccgctagcgctcggagagaggttgtgcgccactgcccgttcggccattgggctgagcgggagaagcttggcgcacacgaaagaggacgagagcttagaaaaacacacgcgccccctacctggcgcgccagatgacggagcgtggggctcctcaccgggagaccgcgcgggcccccctttgccggttcggccgggggcgctaggtgaggttctaagccctcgatctgtgaaatgtttcgcgagagagcaaatgcgcaagacacgggcgatgtagacaggttcgggccgctgagaagcgtaataccctactcctatgttctggtggatctgtgtatgaaggagttacaaagagctggagagcaagagagttcaaactctagagaccctctcactcctcctctcctctacgagctccgctcttccttttaccagctccctcctccctccttcctcctttttttcccttttttcttaagtgggcaaggtcctccttttatatctcaaggggatcccacatacaccacttctacctactcttcttttgggtggggactcaccctatctcccaaaaaaaactggcttgcgccttcgcctggaagctaaatcacagcttgtctttgagtgaggcctagcgtcatcactcgcctgacaccggggatttccctgctactccctcattaatgggcggagatttgccatggctgctgtccgaatgaccctccgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacgcgtcagcccttcttcataaaatgacttccttgtaatggttgcgatgaagcctggtatgaatctagccgggactgacgtgctaactccaggagttagcacgccggctccgtctagggacgagtgcctagaggctctcatcattccgacgggacggggcgaggcgtgcaaaaggccgcctgttgccacctaacccgcgatctgaccggtctgtgaccggtcacacactgtgacctgtcacggaccgaacgagtgtgctgcgctgcattaaatgcggcgtgggacgctcgtccaacccgcaataaacgcggttaggtgagcgccgctgtgctcacctaacccacacacgtggcgccaaacccacagggggtcggggcgccctagccctcggagccgaaacgggagcggcccgacccctcggggagacaaagggaggggcggccacatcaccctcgggcccgacccccccgagggggtcaggccacgtgggtgaccgcggctgccccaaacctctagtcaagatacccccggtcccatgtcaccgacacctaggtttgcaaaacttaacttagttgcttagttaaccttgcaccttaccttgcctagcaacttaggttagttttgtttaagtgccattaagttttaaaaccgcctattcaccccccctctagtcggcctccttgattctacagcggtgagcctaacgaagccagcgacatcctcacctcccttggtcccctcccctcccccatccctccggccgctgttgagctctcatcggtgaaatggcatcggtggcgcggatcgaggaaggcggctctggatcaacctcgacggagctgatcgggctcgtctgctctgggtcaaccttggccgttacggaccgagggaggcggttggccagctttggatcgacctcaggcagcggaagctcatagacaacgtctcggtggcaacagctcgatcgccgccatctcctcttcctcccttctcctcatctgccacgtgtgaagcttcgacggcagcaacaacgcgcaaagattgccctgctctgtgcgggtctttatttggttccgcattcttcatttggcaccttgaagcaggcatggcgtgatatccatgatgtggaaggcttggactgaatgacaactatatgtaggggtgaaaacagagcgggtatttctcgtccgcccgctcggacatattatttcgagacaaattcgggtacccgggacttttcacatatatcgggttcaaatacgggtcttttttttacggatatgagatgttcgggaacgtagtacccgacggaaatgaattatccgttaaaaaatctgggtgttacctggataattatacggatattatccgtattatgtttttgtgaggtactttctggtactatgtattgattttactatgatatattgtaccatatttattacctaaggtcctaatggtctaatataatcgtattatggatatatgtaattattaaatggttattgtttatatgatatataagattgttatttcgacttgatatccaaataaatattcgtaaccgataatatacgtatctactttggtacgtattcgttccgtatttttacccgatactattcgagtttgtatccgtattcggcgctatccgtgttcgacccaattccgattataaaatagtgagatcagatcgaacccgattcgttttgactcctagctagatgcactctgaatgcccttgcattagtgagtgagctgcatgtcccatcctggcctcattcttggcacgtcattttcactgccgttgccggctactactccagtagtacttgaccaacaactctggttgaccctatgaaaaaatctgtaggggtacacaaattgggcaatttcaagaatcttatacgtagggtacgatggaaacagttaaaccaatcatgcacatgatccataaatctatcataaggtccttgtccaggatgacatctgacgcagactcctcctcgctaggtgtgacacgtgtgcatccaggcctcagccgtgcgtaattagaaaacgaaattatgctgcataatccatcgttacgtcagataatatcccattacccaagaaaaaaaagggcaagatgacactgaatccgactacgcacgcactactgtactgtgcctacaaattcttcgtcattcattattttaagctgtccagcgcaaatcaacaaaatatgagctaccgcatttatataaaagtgattttatcagagcgaagtaatgacaaggaattgtatctcattataaatcccccaaagctgaagtaattcttccatatcacaataaaccaatctaaatgagaatttgataccactctaagaaatctcatgttcatatttattgtcctaggtggtgttaaattttcatttagataggctttttttaatagagtagcaatgttagagaggtcacatcgatcaacaactaacattaccacctaggacaacctcatgtttcagatttgttattttatattatgttaaaatctcatttaggttaattttttttttcagagagagatcattatcaatcaatagatagagatcatatcgattaatgactaatgttaccgataacctcgtgttcagattcggttagatggtgtttaattctcagttaactttcttttttacagagaaagatcacatcgatcaacgactaacgttgtgttgttcggtccttgtacttttaccctctatcagcatcacgttgcaggaacacgagtacctcgttgggtggcacgacgtgccacacccggcggcgccgcgccttgtggccgagcttggcgaacccgtgcgccaccttgttctcgtcgcggcacaggtgcgacacggcgacgccgtcgagcgccgggagcagcgcggcgatctccccgcactgcctccggtcctcctccgaccgcaccccggcgcgcccgtgcaccacgtcgaccaccgccctcgagtccccctccgcccagacgcgccgccacccgtacctcgccgccagctcgagccctcgccgcagcgcggcgagctccgcggtgaagctcgacgcgccgccgacgatcatccgctccgcgtagccggccacgaacgcgccctcgtggtcgcggaacgcgccgccgatgctcgccgccccggtcgcgtcgttgcgcgacccgtcgaagttgagcttcatccaccccacctccggcttcctccacgtcgtcctctccgacgacgacgacgacgtccaccgccctacttccccggcgacgaggccacaagccagtatagggttgcacggccgtagcacgcccagatcaggacgatacacacgcggcatctacaacaacaacaacaacaaaattacgcgatctttgcgaagaaacagtgggatttcagggtatagatctcacggacttgggggtgcggccgtggaggggaagtatggaatttgtgtgggagaatctcacggcacacggatccatttcggggacgggatttgctacggtttttggcgtgatttcctcgcgttttttcgcatctcagttcgtacgaccccgcgtttgatggctgcacaggaggagggaggagcaggcacggcacgtgcgagatcttatcctggtttgttttatatgcgaggggagaagaaaaaaaaggaaaaaggaaaaaaaaagctgttcgctgctggctgtggccgccgcgaaggaaagaaaaaaaagagaagaaaaagaaaggaaggctgcggctgtggctgtggtagtgtggtggatgtgggcgtcgcgtgcatagcgtggccgcgtgggatcactggacgcgtccagtgcgccgtggttcctcctccaagctgaacgcgtttttttttataattttttttgttttgttttgtttttctttcctttttctttttgtgtgtgttgtataggggcttggaaaggggtaggggtttctggagcgggtgcaaatggagacaagcaatcggtggtggggtggagtcattggactcacgcggttgttgttaggcacggtgcttagcagtttactacataggcatgtattgacttttcccctctctaaaacatccatgtattgatttcttccctatctaaaaaattgatgacaagtaaatcgccatctccttgtgcagtatgcactatgagtttattggataaaaaaatcatatattcaagctggttggcttcagttgataaaccgtagagacataaataagataatataaaataatttgagtcagggttttatgtttctactttaagtgataaaccaagattgaaaaaatgataaaaatatatagaataattttaaaacaacttaaacatttcaaaatttatcaagggcattaagccatgcaattaacgtgattataacatgtcaaaccattttacttagccagtaagcaaatacaaaactttttatgaaacacagtacaaaacacagacactcacaacgtacacacactcactattctaaacgcatacacgtagcatatcttgagattcaagaagtcaccactaaaagactaattagcatctcccgaaaactgaaccgacataacttgaatttgacgaagttatcacgaacatttgaatctgagcgagctatttccaccacaagaaatctagctaaccagttgagatacgcttacttgcttcgtagtcttattcttttttaagagcaaatgcaaacctacgaagtgaacagaatgcatatgacaagccattaggccataagccaaataactaaccacccattctccatccacgttaaaaaaaaaagaaaaaaaacccaagaaaaaaaagtttttaatcggtatcactaaaaagggagaaaaaaaatcagggggaaactggagaggagtggaatccaatgcgggtggcgtccagtgagacgtggtccagtggtccgctccatttctcccccctcccctatcctatatgagcccccgaccctcacccaaaaccctcctcttttcccctttcacaccgtactgccggtttgctagccgcctcgctgctccggctccgcctctccacccatcccgccgccaccgccgccgccgccgcctcatcctcctctctacccgcgccgccgcgcctagctatctctaggaagggaggagaaggggccgggtgcgcgcgcgctcgctcgctcgctcgtctcgccggatctacagccgccgccgccgcctccgggtgttctctgcttgggatctatctcgtgagccaaagccatggccgccgtcgcgccgcctcaggtcccggtcgtcgcgccggcgcccgctgctgctgctgctcctcctgccccggctcctgccgccgccgccaccgctgcccccgtcgcggatcgtatcctttgggttgtgacttttgattattttatttctaggtttttggggtttgggtttggggatttggttttggcttgagggttggttgggctgggtgttgctttgaggctgtacggcggccgtctaccgcccgggggtctcagcgtggtcgtgctagggttgacttctccagatcgggctgtgtttactgtttttagccttctgttgattgtgaaatcgaataattgtttatttatttattcatacacaaataattatcatgatgtttagtagggcttagttcgaaggattggattttgggatctgaatgaatctgttttctccttaattcattgttttgctgttggaagaaaccacggatctgctgcagaagttgtctttggattcgcagcccaaggcggtggatgcggccaccgagcccgccggcgctaagaaggtattggataaaacagtggaaaagatggatcctttatgtttggagtgtatgctctgggttttctgtcggtgatatgtgaattttaataagtgtggtttgggtaatttttggctgtttatccagcaggggcctgcaagcaggcagccttttagcgtggcgattcctcctgagcggtccatcacgccagtggttcaggattttatggatcccaacatgttctacctgccagcatactactatggaggtgaggaaccatggaaaaattcttatggtgatcattgagtacagctattttgaatggctgacatgtctttttttttcttgttcattcctatttgttagcgctgtgataagccctgtggctatttataggacattagcttctttcatggtttctcctatgcttacagaattgtgctggtttgcaaaattaccaggttacgacggatctgtgagcgagtgggatgattatcctagatatgtaaatccagatggagtggagattaccccagtaagttaatcttagataatattaccttttcctttccatgtgatattgctgaccataaattgcaccatgtgtcatatacttaatgtagaaatggtccaaatatttgctattattgtctgttgggagctgtcctgtcaaatcttgttggatgtaataagtggaatgctatgcactcacttatttggctatggtttggttatctgtggttcttcttcttattgcttatgctctgtgcactattgcttctctgtgaatcttttgtgttcactgttatttgtctgccactaaatatcctgtcatgagaatcttgcgtgctgtgctatcaactattctgattggcctttggaatttcacaggcagtatatggagatatttatggatatgggtatgctccttatggtgcatactcccctgctagttccccagttccaacggttgatggccaaatgtttggccagcactatcagtatccaacttcgtattatcagcctcctacaccagttccttctaccactcaaggcgacctgcagccttctgccaatcctgacaagccaacagctaaggcagatccagctaaaacaaccacaaatggtgctcctaatggtactgttcacagtaacagtggaactgtaccccttggatcaagccagcaaaattcatcactgacccctgatggaacttatagggcacccttgctaggtggagttccttctgctggttacctggactctacatatgggtatgacagcacaggagcacactttgcatggtatgatggttctgcttatacaaatggacagcagagaacaactacaaccaatcacatgtcgtcttcaacattcagtaatggctcttctgcaaggactcaaaacaagggctccacacctcagcagatggtgagtcttacgaaaacatgttctttttttctccgtatgaatgcactgtcctgatccgctacggctttgattgtgaactgaattatttggcttctctgtaatgcagggcatgaataacagaagacctacaactacaacaggatcagctgctcctacatatccgaataggatgtacccgagcacccggtcttacagccagtatggaaactcatacaaaactggtctttcgtacagcacaaatggttatggaagtaatggctatggtagtaatggttatgattccaggctatatggtcggtggggtcttagtatggataacaggtacaagccaa

SEQ ID NO: 36620 - DNA, 1774 bp, Oryza sativa
  unsure (1)..(1774): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatcttctacattacaattaaactgaaactggtgctttggtacctcgaacattatcttgcctgcaccaacggtttgttcatgagtaaatagtttcttgctaccgattctgcagatagtcatacagctttagtcggcggttgtacatatacccttgtcacattcctctgattcgaaaattcggtgatgaactgttggatacagctagttgcttagtatcatcatggatagaagctgttctagtaggaaaatttcctgcatactttgggatattgttgtgaacaatgactgaaaattttagtgggaaatatatcttcgttaatgtgcatacaattttcttttcatcatatttactcttcctttaagctttcagtaaaaccgggctcaaaagcgaggaaaatcatattttactcttgttcatgaacctatggaacttttgatgatgtagaaattaccacttgtataggctgcagagatcgatcatagatacaattaactgcaaatcaaatttgtttcggttataatttgcgtgcacagaacacttgcgtttccacacgtattccgaaaggaaacgttggcaataggtagcaatatgtacaaggtgaaggtatcgaacgtgtaagctacgtgcaggcttccgaaacttgcacgtcgtcgttcaggggggctcacgcatgcaggatcacttcagtgtgtcagacgcgcatggcgatcaatggtcggagaagccgatgagaccatgtccgccgtccgccgccgacggatccatcatcagcctgtacttggcgtaaaacccggcggtggccaccaacgccagcacgacggcgaggaccaccctccacggcgtcttcctccggccggtcaccaaggcggtgccacccgccgccgccccgtcgttggccgcgccatcgtcatcttcttcttccttgtcctccttctcttgatctgctggtgcagcggtttgctgcgcctgcgcggcgccatgatcggcgggtgcggcggcggcggcggccttgggctcctcttccgccggcgacagcttgggcatggtgatgtggaggacgcggtccctggagtcgaacctggcgcggacgtcgccggcgttgcagtcatcggggacctggaaatccttgtggaagcggctccaccggttgccggagacctgccgctcgccgcttatccgcagcttcccgtggttgtcgatctgcactctcagctgctccttcttgaaccctgcaattgcacccgccatccaaaatgacacatatcaaaccttgcattgcatgaactgagcaataaaaaacaatttgtattcggtctaaaagttggtgttgaaaaacagaatgcgacgaaaacctctaaaatcaaactgcagttcccaaaattgaaatttaattttggtgcggctcataagcgaagaggtgggaaggaataatgctcttgcctgcggcagataggttgatttgaaggaccttcttgccggcctcctcgaccagctggtgcggcgg

SEQ ID NO: 36621 - DNA, 19045 bp, Oryza sativa
gttgttacatggtcttgttctcacagtataagtatttcctgcgattttctgtggtttgttctgggcggcactgtcgggatgtcggcagtcggcacggtaaaagaaaaaaagaaagaagaaaaaaatgtgcgtgaaacaccgccttgtcaagccatctcccgttctccattgggccgggcccggcccactggccgagtgaaactgtacagtagacttgcagttccaggttattgaggtcagacgggtcgttgaaccggcgaggacctcaatgaatgaaccaacggtccaaacggtcaaaccaattaactatcgaaccgagggccgccggttcaacgactggtccgatctcaataactatattctgagctgctacagactcacatgcacctgtccagcggttcggtgccgatttttttatcggtcttaagcggttttctcaaaatctatgtgtctagccggtttttaccggttcacttgcgtagacggtcttttaactggatcagaccgacgaaagctttggttccgatccaaccgctgctccggtccggtcctatggttccagccgagccgagccgagccgacgagaagctcttagaagagtggcgttggggacgtggacggcgagagcaggtgacgcgttcccgcgcgacgcgggccgaggtggcgagctgcatgcgcctcatgcacgcacaccaacgcaccaaccagcgagttcactctcccatactactagtaccactctactagactccgttcgctgacacgccccgtccactcttgtccacgctgcgccgcgcagtgtcgcgcacaccccaaaaccccaaccaaccaaacaacccgacccgcggccatggatgcggcggcgggcggcggcggcgagccttcgccggcgccgggagtgggcggccggaagcacctctcctccatcgccaaccacgtgctccgccaatgctccctgtgcgtactttctctaatcctaaatcctaatcaaaccctgttgatggttgatttctccatcgtgtagaaactgtgttgttgttgttgttgttgttgttgttgttgttgtgtgtgtagaaactgttgctatcaattcgaaagaaactggcagtgttttccttgtagcagactcatgtgctttgatcttgtacgaacagaacatattggtatgaagcttcactacttgaaatgaagccggattacatgtttgggcattttatttgaccgcacaaactgcttccaaataaacctctagcgcgtcagttattcattagtaactataccctgtatttgctaaacgtctctagttctctgatccatatgtccaaaacaatctgaatactataatttctaaccatgtcactgtaaccatgtcctgataccattagtaatatattatagcaattattctattcggtgcatgattcatacgtaatccttatagctcgtcgggagtcaggactcaggactagaaatggcaagagtaactaatacggggtcatggcttaattacaggacattggacagaagtgttgatgaattagttgcagactttgagctcggtttgaagactgctgcggtggataactattcaagaagacttgtcgagttctgtatccttcaggcgctgcaagttgttacatctgttgatctaggagacaagatccatgatggatcgcttagtcggttcacatttgatatgatgctggcttgggagacacccactccttcagatcaacaagttaccatggtttgtgatttttttatatttgtgtgaaattgtgtgtttgtgttcttctgaaatctgatctaaactgaccaatatggtgacattacaggagagcatagctaaagaaagagaggataagaaggagccgctcggagcaaatgaagctgtcatgggcgatgagacctcactgttctattcagatatcatgcctcttctcgtatgttaacacatagctgattaaattcctttccgtaaaatttcttcaagctattcatcggtaatgatgtttcaggtgaatgaagaaccaacagttggagaagatgcatatgtgtggtttggatctgtatttcctttggcgtgcgatgttatcaatgctcgattcacctttgaagccctgactgctacaaccgctaataggcttcattatcctgcttacgacaaattcctgaaagaaatggacaagtatgcaaccacttcacagttagatcttttttgcaaacataagcaacattgcatttcctctgttttttaatggataactccattgacttttgatgtgatatttgactattcgtctaattcaaaccagtagtgcaaatatgcaaaaaaatttaagtcaaccttaaaagtttttaatgataaaacaaatcataacaaaataaacgatactgatataatatttttgaataagacaaatagtcaaatggaatgccaaaagtcaacactttcatacctccctgctagatgtcgttcttcttctttttttttaacaaactggtagaactgcaaattatactgataaagcatgagaaaatgatacaaaatatagaacactgaccaccagtccaccacatcctgatggatgccatgtgaaattgacttttttttaggtcttccgaattcttgcagaaggtgtcaactccaaccggaactgaacttgctgaagatgaattcatcttgcacatcgagggaacagcaggaacacaaagggtggtgcggcacattggaaccactagttggccaggtcatcaatctgatcaagagttatattatttctggtttcttcaggtcttagcattttacgttgatgctttggtaacattttcttatgaatgctacattggttgtatactatacaggcaggctgactctgacaaacaaggcattgtattttgaggcttctgggaaaatttcatacgaacctgctttcaaagtcgaacttacaggcagtgaaataggaaaacaagttaaaactacttcaactggtccttttggtgcaccaatgtttaacataggcatcgaatctgtactgtgagttccctcctgccattattatttttagtgttcatatggccaacctaccgggatcaattcattttgttattaaaattatcactttgccccttttgcaaagaatatcgacagtaaccattcatctatgcagaccagaacctttggttttggagtttcctgagatgaccagctcaacaaggcgcaatatgtggcttaccctgataagggaagtaatattccttcaccgattcatatcaatgtacagcatagactcccccattcacaaatgggaggtgcattcgagaatcatattgggggtgataaggcttcatgctgcaagagagatgctaaggatgtcgccaccgcctccttctagcttcctagtattctcgctttacgatgagcttcctaaaggtgattttgtgcttgaacaactagcaaataatctgaaagagacgtcaacgataactccgctcagtgcatcccatgtgttcaagggtttgagcaagtcgcatcgggtagctttaagtgcggagatagcaaaagagcatgacaaggactcaaatagccatgaacagcccttggcatcacttgaaaacactatcggtcaagtaagagacgaggctcgggaagtcaccgtcgctaacgttgctatcgaaggaatgaaggaggaaggtatcactgatagccttcttgtactggtggtatgtacatttcttttatattctctttggtattttatctgctcaaatcatttttatttaagccggattgatttaatcaaacttccattcaacggttctaagttctaactgttttttatgcaggggttagtaagccccatgagcaaattgtttccagtgatccaaaagataatctcatgggagaaaccacttgtgactatcagtgtccttgccatgatggtgttaaccatatacaggttagatttatacaccgcatttaatttcaacatacattttactcttggaaacgatcagggaacatgagatgcaaggtccctttttttttcaacatgatgcagagagtgggtcggttttgcgttagcggcatccttgatactggcagcaggattcatggtttgggctagacaaagaaaaatcggtgcactatgctcagaggtgatcatcgacacttcatcggacaagacgacgatggaaagcctagtggaagcacagcaaagcctgaaaagagtgcacgagtacatcaagacagcaaatgtcgtgatcctccgagtatcgtcgatcgcgttagcgaggtcaccaaaggtatcaatatcatcagagttcatcacacacgttctccgatcaccgaatcgttccaccgttgcgattcatttccatgtcatgttaacgcgttccttcatcatcatggtgtggaactctggataattttctgagtttgcagcatacagaaacggtgatatggatgctgacagggttggcgctggcgctggccgtgatcccgttcaaatacgtcctgatcggggtgatggccggcggcttcatgtcgaacacgaggatcgcgagagccatgtcgaacccgcagggaagccggcggtggagggagtggtgggagagcatacctgccgtcccagttcgggcggttgacgggggtggtctgtgaagtgttcgacgaaatgccggcagaaaaatcctcggtattgttcagctataagcttaagtgttcatgtatgttttttgctcagagatgtgccatactgccatcatctttatcacctgtcagctggtgtataccagaaaagaaaaatggcagagcacttaacacggaacactttgttggatgtactaacggttaaataactgtcaatgtgtgttgataaataaaggaatacgtcatatattcaatattcaatattgtggtgccgagtttttgtcagtgacatatggatttagaagaacgtattggcagcggaaatactgctactaatgaaatagataaagtttctgtgtttgttccgaactttcactctgaaacttccgaaccaaaatcaccatctgaattgtcaacttcccagcacgcgattaggccatctgtaatctgttatctccagaacaacatgagagtgaatgggtgatcatgcttatatctgaaattcagaggcaaattgaaaaaactaaaatattgaaacatggataaatgtggttttcgagtgctattattagccccgtcgattagggaacatatttgatataacaaaccttttggtgcacacattatgcacaccaactattttttttaaaaaaaatcttcgcgtatatatcatacacactaactaatatattttttaaaaaatatataaaaaaggtgtacgatagtattacacttatatataaagtcgtaactacaattcatttcattgtattttagctgtaacaaaataaataaaaaaataactatttcaagagtataaatgtattaatttttgtttttttatatatagagtgagtttgaagataagatttacacatagatgtaatactagttgtataaaatatcttagaaatttttagtgatagtttttagttaatgtgcacggtggatacacgaaaagattttgtgcgtacgatattccagtcagattaacagctcaacactagcattgcaattgggacacagtgctaggagcctccgcgcctttccgaagccgaccgccgctccatccgccgagctccttacattcccgggcgcttgtttcgtagcgagtcttgacccagacagacgacgccgggaatgcgccggccattgagagcgccgccgtggataccagccgtttgacgtgagatgaagacgtggggctttgccgtcgccgtgttgccggcttttgccgccatgccgtggcgctgtgcttttgctgttcgttcaacgtgttaaagcgcggccattgttgcagggcgaggtgccgacgttttcttcaaggactgacttagcaattctcttcattctttgggtttaattattccatagttcatcactagaacagcttgacaaatgtgtactgtatgtagcaaccaaaatcttcatgtttgtcgtcttcagagttcagacaaaatggcgtccggtttttgttttgcaatcgattcaaccaaaccttgtcgaaacgatgaaacgatcttaccatgtcaaggaagacaaggaaaaaaccagcaaaaacgtttgctatctgccattaagaacttgacagctagatgagtcctcagatgaatcatgatggcattatcagcggtatcgagtcgtttggctgaacacacaccgtgccaacttggttaacccttttgtttggtagcgcaaacaacagttaaaaaaaaagtactacttcaatttacagattttttttcccagtctatccatccaattaaccaacttaacgaccattgcatgtagtcatgttcagattcggacaacgcacatcgagaaaacgtttgctttgcatcagatatgctaaaattgcccccacacacgcctaacttgttggagatatttacccgtcgagctgtcccaatccaaacgaactctcatagtatatgatggatgagatggatgcatagatggattggggaaaaaagttgagttgcgcatgaacaatccatgaacttggcgaaggaaaaggccacatccatccactaatcccctcatccaccattccacccacacgccgagcgcgaggcggaggcggccgcgtctataaaaccagaggcgcgcctcgccgcgccgcgccgcgttctcttcctccccggagtagaaaccgcccgccatttggatccccccaattcccctcctcgcccaaaaccctagccgcacccccgccgcgcgccctccgcctccgcctccgccgcggcgtgcgggctccgtcgtccgtcggctcctcgccactggcgtcgcgaggcgtcgtcaccggaggtagcgggagctcaggggacacgatctcgaaggcgcgcgccaggacgaacagctcgagcgcgccgcggggggccttcggttctgagataaatcaccccgtccgcatcatcgacgcctccctccccgcgcttggcgccagctcgttctagggggggaagatctcggcgacgagcagcttgggcgcgttcgcctcgatggacgagttcaaaggcccaggggagaaggagaaggaggaggaggccggggacaaggccgcggcggaggaggcgggggacggattccaggtggtgcgcggtaagaagaagaagcggcccaatggtggttcggcttcgggtgctgggtcggggacgatgatggccaaggacaaggcggcggcggcggcggccgcggagccgtggacgaaggcgaaggtgtctttccacgatcccaacattccgcggccgcaggatgtgtacgcaatcagagtgaacaactacaacgtgccgttcgaccatgtctggctagagcgcaccgaagatggcagccgccctatccaccctctggttagtgttctatttcgtcttttagtacctagtttttgcttttgagtcttttcctttttctgttgcttggtgtgtttagaatgaggagctaggaagcccttgatcaaatttcaagccatgacatgaccaaacattgttttacctttttttttgtggtgtttttatttgtcaatcaaatattgatgtttcttggctaaagatcgagccttgtatgggtaagaaatgttttggggatggcctacatctactttggagtatgatcttaagacaagaatgcttgggtattgttgaaaaactataagatggcatgtgcagagagaagcggggaaagacaaagatttcttgaatttttttttcggataatcaatgtgttatttttattattatgttgaaactatcaaaaagtaagcatttacatgttgactcaggcctaattggttaacagaattagtaggaatgctgtattttgtttttcgtaatcatatagagttattcaagatttgttggttttcttatgtccttattaatcaatagtggaaggattgacttttttgcatattcaattatccatgcatgggatctgatgtaatatactctcgccttgcaggaaaaactgccaatggagcagtttattgacagaaatgttcctgaaagtgaacctgtaaagccagctgatttggaggataccccatttacgctagttgaagataagaatggtttagcagacttagctaaaaagttgaagagtgtaaatgaatttgctgtaagcatttgtaattaagttttatttaactttcaaatgaatatatatcatactttgtttccacttgcattgtattatttattaactttcaactgctagagtattttgtcttatgtagatatccccctgaaaaaaattgtaagcatgcttccctggcatgagttcctaatactggattttaaaatatgcaaacaaatcttgtcagtaattatctataaaatgtagtgaaacatagctgtagttgttgggaagtagcttttctttattgggtgggcagtaccttttatgatctggtacattgattttgacacatattgtgtactgagtttattttggttagagcagtaggactctactatttctagaactgttagaccattagctccttaaatgttttcattttacctatcatcataaggctccagtcattaacccaattagcgctgataccctgtaaggattaaaccattttatgtccaatatattgtagccttttgacttaggattcaaatgaaattgatatatgctttattctgaatgacatactgttgcctgtattgtttccctttctttgccttgtctgacaacaccattcactttctgcactaacggcattgcataactttactggattcttgaaaaagaacatattccatactttctttctgttgccttctcggtcttttacatttcattcatgttatgggcatctgttatggaataaaacaacttctgaggccttgcagtgttaggaacttaagctttatttcggttcgtctgttgttttcaggttgacttggagcacaatcaatataggtcatttcagggtttgacctgcttgatgcagatttcaacaagaacagaggattttgttgtagacacccttaaacttcgcatatacattggtctctacttgaaagaacattttaaagatccaaccaagagaaaggtttcttctgcgttctccaattgtttatcattttattgaggggaaattgtttatcattgtgaactcaaatttctgtttacttggtttcttcttgtgcaaaaaggtaatgcatggggctgatcgtgatattatgtggctccaacgggatttccacatatatgtttgcaatctttttgacacaggacaggtattttgattaataggctaataatactaaatactaaaactgtgattcttgattgcacctttaatttacctctttcttcattctccttcaaaatcctcattttcatgtcttataaactgaaccttggattttcctttctaactccaaacaggcttcaagggttttacagatggagcgaaacagcctagagcacctattgcgtcacttttgtggagtcacagcaaataaagagtactgctcatttacaccaacacaattttcaagtatccatggtgacctacctaattatctacaatgagtatttatgaccaaaacataccccttttgtagatatcaaaacgctgattggaggtcaaggccactttctgatgaaatgataaagtgtttaacctatagaccctatctttcatttattttggtttagtcttgcctcgtttttgtcctacatgttttactatttcatccagttttacccacttgcaaataactcctgtacaggtatgctagagaagatacacactatctgttgtatatgtatgacttgatgaggttgagactgcaaaaggagtcgacatctgacaatgatcttcttctagaggtaaaaccttagttcactagtttttccttttgttctgatctgatttttaagtctgtatgagtgaacattattttggtatatcctttttttccccttgaatgaagtatcgctttagaacaaactgcatgtagatcttacaaagtaaccattgtgcgatcctgttcacataaatttacaatctgtttgttagtcatgattcctgaatatatgtgattttcattagtactgacaaagagtatcaaaatagacattctgatcaccagttttcggttatttcaggtgcaaaagcgcagtaatgaaatttgtttacagttgtatgaaaaggaactgctgacagatacatcttatctccacatatacgggtctgtagctctgtatgatgttctctcaattagttcatttcattctatcattcagaaatgcacttttgctaacctcgaagttattttgttcacatttataatttgcgtgaatcccattaacacgtgtattattacaggttgcaagaacatgacctggatgcaaaacagctggctgttgtatatgtaagagaacatcttgttatttgtttacttcattatgatcattctgtctcgaactcgaatagagctaacatgtgtaacatggcattgttcctagaaatgtatttgtagttgctattactattggctgttggcgacagtttctcattttggctatgttcataactttattgacttaaagtttctgaaagcccatatgtccatgccatgtttccaaataacaacttatattttttctaccaattcgggttatttaatttatgtgtgtaataaatatctcacatatctttttgcaggctctacatcaatggagagattatatagctcgtgaagtagatgagagcactggttatgtgttaccaaataaggctttaattgagataggtactgctgatttatttttgtttttacggcacaggacttgatgtattagtttggctaactaactctttcatttccaccccctattgaattcaaaagcaaagaagatgcctacagatactgcagagttaaaaagaatggtgaaatcaaaatatccatttgttgatgaaaatctggaccaagtcgtaggcatcatatggaatgcaactgaatcttcttatgcctttgaaagcagagctgaacaactaaagaaggaacgtctggagcaggtatgtttaggttgatcttctgtgtatttcatatcttatttgtttgcttttgaggatggtggggagaggatcacagaatgcgatttcttatgtgccaattattagcattgacgtttaagcacctttggttgtatccagctaacggacagggttcagactatatcatcacctgagatgaagacatctatgaacttatcaggccagattagatcaatggataaggaaatactgagcgataacatacatcagcaggtaagagataatttcagtgtctgtagtttttgttcgcccctgtatttatgtagttgcattttgcaggtggcacaggctacttttcaagaactgaagagacctatggctttgggagcagtagggaattcaacatccgggggacagagagatttctttggagggttttcaaataaggtataagcgagtgcttgatctgaacaatgaaaacatttaagtgttcatttaaatgcatgcatgtcattttccttttgaattgttgatgagttattggtatagtacattcttggtcatatactgtaaaatgtttaaataatccttttggtttagttctgaatgttttgtctttacaatagttttttgaaaggaaaatgtttgaagaaccttcaatttttgcaatagttatgtcatatgccaccattttacctttttccttcatgatttaagctatgctttcctggaaatgtttttagatttcccagttagcttcatgtaggaattgtagacttatgtttgttatcatgcaattgcaacttatcaataatttacggaattgcagtctgagaagatggagaaggctaaatcctatccagccttttactacccccagcttccacaatatagccctgaagttgggtacggctttcaatcaataaaccgaactatggcgggaacagcacagtctcctactggcaataaggagagggatctccagaaccctagaagacgtcaatctttcccaccttccggtaacataagtgatacacaccagtaattgctctgatgtatgccttcaaattcatccttctgtgcagaaaatagctgtagagaaatggaaactgggctgtttttatccgtgccccctaatatgagaaactatgcctccctcagatttttttggctagactaacagaaatatgagaatagcccatatcattgacattagatgcagagcatgggaaatgccaatgtggattggcttgtgtgtaacaactgacaaacatgtgctgtgcaattgtgaatactggagttgtacaagtggtatactgtaatactgttatagcatagcatcagaatacaaagacagaaatgaacacatagcatcgatgtctcttttctttatttttttctttggacagcatgccttgaattatttgccataatgtctccgtcccgctggcttcatcacaccttctttgctgggtttagtttcagttcatcgtttggattagctgtttatgaatagagatgctgtttctgtctatgttcactctcagggatgaacatagggcctgcactgtctatgttcaaactcagagaggaacattgggcctgcactgcagcggtgaaatggatccgtgtgttcgcgccaccagaatgagcttggggcgcaatggaacatgtgatgtcagttaaagttgcaggtaaggcagtcaccggtcaaatcacggcactcgccaaccaggccggagcatatcggctctgccgtttgtttgctcctatctgtacgtagcacgagctgttttccattggcaacgcctgatcgatcaaggcgttctactcccctcagcacatgacgccaacgggttgcatctgctgacgacaaatcgctacgcagactccagattttacagctgtgttctgcatcaaccatggggaattggcgacccaaagtgccaaaccatcacacgcaagttgccatgatcgatgcgtgaaccggaaattgatcctctaacttgtccccataatttatgagcctacgtatgagtaacccatagcatagtatcagagaacagtaagtcagataagccttttcgatctgcgaccatcaaaatcgaacaaacggcagcacattttagccgaaacgaatcagagatctgccccagatttgcaacctacacacttgacaatctcaacttggctgcctgcaatctgccattccccttccactgcaacatggagatagccccacccaccaacgcagccaccctacggaaaagcacaccgtaacgccgcccaccaacccccctccgaatctcctccgatcccgacgcctatagatgaataaatctcctccctcttctcactagacaaagcccaaaccaaggccaaaaccctcctcccctcctctcctctccattccgccgccatggccgccgccgccgccgccgccaccacccccaactccctcctcctccgccgcccggcggcacccaagccggcctccgcggcggcctcgccgctccgtctccccacgcgggcagccaggatctcctgcgcggccgtggccacgcccgcgcagtcctcctcctcccccgccgccgccgccgccgaccgcggggtctacaacttcgccgcgggcccggccacgctgccgctctccgtgctccagagggcgcaggcggagctcgtcgactaccgcggctccggcatgagcatcatggagatgagccaccgcgggaaggagttcgacgccgcgatcaagaaggcggaggccgacctccgcgcgctcctcgccgtgcccgacacccacgaggtgctcttcctccagggcggcgccacctcccagttcgccgccgcgccgctcaacctctgcgcctccccctccgaccccgccgacttcgtcgtctccgggtcgtggagcgacaaggcgttcaaggaggccaagaagttctccgccgggtccgtcgcctggtccggcaaggacggcaagtacacctccctcccgcccttcgacgccatcgagcagaaccccgaggcaaggttcctccacatctgctccaacgagaccatccatggcgtcgagttcaaggactacccggagcccaagaacaagtcgggcatcctcgtcgccgacatgtcctccaacttctgctccaagcccgtcgacgtctcccgcttcggcctcatctacgccggcgcgcagaagaacgtcggcccctccggcgtcaccatcgccatcgtccgcaaggacctcgtcggcagcgcgcagcccatcaccccggtgatgctcgactacaagacgcacgcggacaacgcctccctgtacaacaccccgccgtgcttcgccatctacatctgcggcctcgtgttcgaggacctgctcgcgcagggcggcctcgccgaggtcgagaagaagaacgcccacaaggccggcatcctctacgacgccattgatgccagcggcggatactacatctgccccgtggagaaatccgtgcgatcgctgatgaatgtgccgttcaccctcgccaagggtggggattttgagaagcagttcatcgccgaggcggccaaggagggaatggtgcagctcaaggggcacaggtcggtcggcggcgtgcgcgcctccatctacaacgccatgccgctcgccggtgtggagaagctcgtcgcgttcatgaaggatttccaagccaggaacccttaatttgactcatggtggttatggtattttgatgctgtcttcagtaggaatggtctctgttcttcatcatagcataattaggctccttgcaagagctgctttgcgcgtaagagattttcgatccatctgttgtatcggtaccagtaactatttcgcgatgctgctgctactgcttttcatgtgttcatgggatctcattcccattttgtgccattgaatgttagtatgggaataaaggtagattcttagctatctgagaggagtatatgctgatgctgatgcataataacaaggttgcttggtcttcttgtgtgatcatttctgcttagtttttcttgtgtaatcattttctcctttgagaaatatttgccgatgactgttcattcggatcatgtaagattgttctaccagaaaatctttagattgggggtgaaatgttaaattaccggtaactttcgtgatgctgcttctgttcctgtttgatctcattcccgtgtcgttcatgctgtctcttgattcagtgcttatgtaacaatgtacaatttttagctcggttacagttctgtcaaaacaaacaagtttggttggttctgatgttttatcatttccttatagagacttatcgacaatcattcattcggtttatgtaagattcttccagcagaaaattcttcagattgggatgcaatatccaggttgttgttagtattcatggtctggaggttggtgagcaagttcttgagtttggtggcgaagagtatttttacttgttgctgtgtctcagtctggagtggactggactcactcagagatgagtgcgacagcttcttgttgcaagccaacaaattctaaacaaaaatgtcatttaacttcgaaatttcaaaccgcacgtttggtaaatctgccttaaagccaggagtaccaaaggtgactacgatcaaatcacaaagaaagtgtatttgactttgttctgtcaatacttaagcagagcagcaacaatcctttttgaatacctcgatatgtcaaacttgtactgtactagtttgtcatccttgttcatttgattatgttttctagttgtgtttctacaataaagctgtaagctgtttagttccagtcccatgttgatcggttgatgcatctttctttatagagacgtgaggaatcccaaatgcattggttgcctttctgaatcttcggcgttttcaagtgagaggatcactggggtatactagtaccacttggtaatcatatgacgtcatcgatgattaatcccccgtttggactcttcgtttggtattgctaatctattcggccgagtggatatttctgtggcacctttctgaatttctaatataattttggatcttttgttaattcttttacgtgttttgagccagaataagttcaggaattttgtgagtcaccaattacccctggaatagctgccatcagaaagcaaatgctctgcttgcttagtatcactgtcagaagtatgtagtatttagatggatattaggataggattaatctgtattgggtccttttaacaagagaaggttatactccaataataagaagcaaaaggtctaagaaatacttactatcgaaatatagtaatctagtattcaattagacaatgttcagattcataaaataattagacaatgttcagatttataaaattgtttagattcgtaatactatatataatgcctaggaccgcagaagtaagaagagcacctgctagctagctgttcatgctgatttctgaatcttcagaaatcaattaatccagtcgtgatagaaaatttttaattcggcccaaaatgaatggcacattgaatcgtaggcccaaatatcaaaggaataagttcacctgaggtcccttaacttgttaacgaatccaattttcgtccttcaaccggaaaaccagatacgacaggtccctcaactatcaaaaccggtgcagatgaggtccctcagcggttttgatggcggttttagctgacgtggcgcctatgtggctaatttgactcggtattcgtcccacgtggcattgacgtggcgcttacatggcaattctatccccgaaaaataataaaaactatgggcccacatgtcagttaaaaaaagtgggcccccacaagtcagtgctctctctctctctctcacactcttctcatctggacccttgccgtcgacttcacttcgaggcgttcgggctgccgccgctcgtcccgtccctcgacccggccgtcaacatgagcagccttgccgctggcgcatgcttcgcctccgccggcgccggctacgacaatgccacctctgatctttttgttagccttccattagagcaaaacgatagctagcttagctacattttcatggtgttcttaggtgacatcacacatgacatccatggagtaattttgtgaggtcgcgtcgtgcatcggtgctgccgatgtggaaggagctggactacttcaaggagtacgcggcgaggcttcaaagcttccggggggacgacgacgcggcggcggcggcaacgctgtcggaggcgctctacatcgtcagcatgggcaccaacgacttcctcgagaactactacgccatggcgcgcgcccaagcggcggagtactccacggcggcggcgtacggcgactacctcctcggcatcggcgcatcgccgagtcgtactcgttcgtccgcgagctgcacgcgctcggtgcccgcaaggtcgaccttaacggcctcccgcccatgggctgcctcccgctggagcgcgccacggggagcggcggcgcgtgtaccgacgagaaaaacaccgtcgtcgagcgcttcaacgtcggcctccaggacatgatcgcgaggctcaacgacgagctcggcgacggcgagatgatcgtgtacggcgacgtgtacaggccggtggccgccggcggcgtacggggtggagaacgtaggcaacagcaccgtgcccacgcgggtcaaccggcggcggctcacctgtgccatctgcttcgacatgttcgcccccggtaggatgaggtcggcggggtgctcccacagtcccactacaactgcatcgcttcggtgcccggacccgtcctgctcagtcgccggcggaggcgagcgcggcgaccgttcctgaggagggcgcgggggcggaagacggtgctggagaacggccaccggaggccgaggcaagggggaagcggcggcggcggcgggaacatgcggaggcggcggaggcaggcacggcaggtgacgaggagagggcagcggcagccggcggtaggcccatgggggcgggagtggaggaggccgcgcctcgacgctgtccgcatctccgccggtgagaggagagaggaaaggggagagatgtgaagataggtgagatggggagagaggaggaggaagaggaggggattgagataagaagagtgagtgagagagagctgacatgtgggacccacttggggcccaccagttttttttaactgacatgtgggcccatggttttttattattttcagtgatagaattgccacataagcgccacgtcaaatgccatgtaggtgccacgtcagccaaaaccaccatcaaaccgcggagggatctcatctgcaccggttttaatagttgagggacccgttgtatctggtttttcggttgaaggatgaaaatcagattcgttgacaagttaagggacctcagataagcttatgccaatatcaaaagataaggcccaaagtaccctaccctctaggcccaaatcttccgccataatgctccggcccactaaacgagacgcgggcttaccgcgacgcggtgtgcgtacatcgtaagcagcgggctcctccgcttaaaagctaagctccccaatataaaccgcagtcagggcgaaaaaaagaaagaaagaaaaaaaacaaacgcgaaccgactgcgagtagtaagtaaggctaagcatccgtctccccccttctcgattgttctcgatctgcggcggcggcggcggcgatggccgacggcgggaagcccccgacgccggagaagaagtcgtgggccgacgtagaggaggaggaggaggccaaggcgaaagcggccgcggcggcggaggcggcctcctcgtcttcgtcgaacgagccggcggtggacgcgcaagcgaaacaaattg

SEQ ID NO: 36622 - DNA, 1985 bp, Oryza sativa
  unsure (1)..(1985): unsure at all n locations
acaacggctccgggaagaccacctgcttcgtcctcggcatgctcagccccgtcgacccttacccgaaggtcacgcaggccatctgcatctgccccaccagggagcttgcccagcaggttgattgagcacacatacttctattatgtgctagtatgtggatttttttcttttcttgttatggatgtgcacactgtaatgtactctgtttgttttattgtgatttgcagaataaatcggtgcttatgagaatggggaagtttactggcattacctgtgcatgtgcgatcccaccggctcagaaagattatgtgccgatcgctaaaatgccaaagattactgaccaggtggtgatcggcacttctgggacacttatgaagtggattaatcataagaagatcttgacaaatgatatcaagatacttgtgtttgatgaggcagaccatatgcttgccgaggtatggatgagttctattgctgttcctctatccaaaacttgtgtatgcccattgcccaatgttgttttctattatttattttgttattataggagaacgcctcgtgtttagttattagggacatttgggttagatattaatcttatggaaagagataattgattattgcaatttctaagctgtataggaattgggaacaatgaagcaaaaactgccataagctcgatttgttgtaagatttttttttttgacttaacaagaataatggtggcttcatgatgattgattttcttactcgaagtggcataccaaagattatctatggcctgtatacacagtacgtggtgtttccattgatattacagatcgggtctggttgggatgtaaaaaggcttaatgtttttttcaactactatatttgccactggtttgtgcagcattgcattatattcattattaagaaaaatgaaaaaaataataatgtattggtccattgttgctacagtatggttctgattcgaacggaaaattgcttcatgtttttcagtagatcaaatgatattagcctttcctaatagaaaatattttggtatttggcatatgttttatctagattagaagagattcattcatatggttatgtcgtacatttggtaagacataatccctcacatgactaaacatttgtttaaaattgatgttgctcgtatgtttcatacttcatatctgcttatgcactcgatgagtttatgtattatgagttgaatagctttattttcacgcaatctaacttcacattataaatttcataaagtccaattccttataatggtgaatgcattctcgcaggatggcttcacgagtgatcctganaggattatgagggatatacaaagaaacgctggtggctgtcaggtaaccattttctggtcacttttaacttcctttgcttgagtaggtcccgcacatgaaacagcttgaatgctccttataaaaggcgatctggatacagtttgaaatcagatatgagggtaatatgtccattctgtgttaagaggatgttttaggagaagcattttcctatagtctgcagtatacatgtaaatatgcaattgcttattcaagaactccaaccaatgcttatgatgtaattggagaactcctttgcttgcttgcaagtagtggaaagagggtctaattttaaattttttggccattgatgatttttttttttgaccaagggcagccattgatgattttatctggtttgttcagcaattttgcaagatcattcagatgatcccaaatataccttttgagttttaaactagtcttttccatgtcatgtgatcatgtgtggagttgattgtccaatgtgtggagttgttatttattatttgaactgatggctgtcaggtgcttctcttttctgcgacattcaatgagagagtcaaagattttgttacaagggtcattaaggatgggaatcaaatatttgtgaagaaggaagagcttactttggaaaaagtc

SEQ ID NO: 36623 - DNA, 6114 bp, Oryza sativa
tcttttctaacattcttcctttgaaaggttaacctcgtcatcaattatgacatgccaatcaagtttggcacaagagatgaacctgattatgaagtgtacctgcacagaattggcagagctggtcgctttggcggaaaaggtgaaattatttctttggttctcttttgtccaaaaaggaaaaaaaaatgtcgtggttataattcaatgtttagtaagtcttcgattaataaataatgagacatagtcaatatcagaggtggcctttataaggtatgttcaattgctgatcaacaatttcggctgatggatccaagttctaagaggtcttagctgagcaaacctgtcctgtggtgctgacaaatcttgcctatgtctagtcgaatacttaacataatgtatgtgtcttagactgtaagttgagcctgagcttttcagctgttttctgtggataagatagaatgtaagtggcttggtcaattataccaggtcatctttctatgatgggcaatgatgtgtcttatggtgcttataatcaaatttttctggacttatttcatggtttatgtgtttaacattgatagggcttgtagaccaagtgatgctaggccaaccaaacacctattcaaattcagcccttctatattttagtacatattctgtagcttatattcttaactttgtcattgctggtgcaggagctgttttcaacttgctatgcggcgaaacagataacactgtgatgagaaagattgagacctacttccagcacaatgttcctgaggtgtgtaactgcaagatgcatatgccagtatcttgtgctcctaagcattagcttattgtgttctgttcatttgtaggttcgtaattggcaaagcgaggaagattttgaaagagctctgaaggatgccggcttggttgagtaacaccattggaaatatggcatcagatgcgctcttcacttgtgacgaacaggcgcgtgatatttaccagctgaaacagcttctaaagcaaagcaatcgagcttcttgagctcatccttggttattatgtcgagagctgtgaattctgttaaagggactcatccaaacaattttgatgctatgagcttatatgaagcaaaggtgttccttcgctatttcgtgggaacttgttgccaggactagatctacacttgcattatactctgttacttcgtgtacttaactgggaacctgttttggtttttatggctttgtcgtcgaaatgcggtcaccggtgtacgttacgcccttgtgaaaaaactggaaaccttctttctgggtcagtgtacttgtacacttgcgccattgtttagttgcatgtacgaatgtttctttctgcgtcagctgtaagtgtacacttgatttattgtttagttccatgtaccatgttctttttcctgttctctgtacacttggccacgctgatacatgagatgccccactatttcttcctgcatgctatcgctttcagcgtgtttcttgtttcaaagaccaattcgtgtataaattggtcgcctttttcactgtcgtaataatgaaaaaaaaatagagaagaagttacaggttgtcgtgctcgatgacctgcgccgccctccactcctcgccggggttgacgaccaccggcaccagcatggacgccgtcccggtgcacaggaagtagtccttgccgaacttcctgtacatctcccccgggctgcacaggtacatgtcctcgtaccccatcctcaccaccctgaaccccagcccgctattctgcaaacgcatcaacaaattcaaagatcaaattcagttcaatttcaaccaagcctttgatgatctttttttcaattctcagaagaaacaaagttcttgacgatccatgaagatttcttggtgctatgatttttcttcaaaaaggaaaaaggcttgtctttttatgatactctccatttcaaaaattaacaactaatgcctccttcaaatgtttgacgtttgaaccagccaacatcgaacaaaaaaagaatagagggaatatgttatgtctaatacggattgagatcctctgactttacgtcagaggaacgtggtgactggtatgtggaccccgccgctttagggcctacatagtagtgtccacatcagggataactttacgtctgaagatccctcaacatcaaatacaatactagtctgttatattttggaaagaagaattatacgaacatatgaacatttcctggtggtgactttggttgtttccctgatcaatggtggtgaatttggagggcgccgtgctgtagatgcgcttcttcctctcctccggcgggcccgcgtacaccatgctcacattcttcttaaggatggtgtagaggttgtcctccacggtccacaccccctgccgggggtccttaccgccgccgccgccgaaccatccgccgtcctcccgcttcatggcctccgccggggtgaggagcgcgaagccggcggccggcggcgggtgggagcagtaggggcatccccggagcccctccaccgccgtgccccgccgcttgtcgaacttgatgtgggtcagcatcgcgctcgtcagcgacaccggcttcttgccgttgttcttcaccatcaccgccgtcgccatgctcagcgggtacagcgtcaccacgtacgtcacctccagcgtcccgctccccttggtgcaccccagctcaacctgcaaattttagacaaattttaccccagatttgaagtggatttgtttgcctcggaacgcaaacaagattcttcaggtttgcaaacatttgcaatgccaacatgtaacatattaaggtacatagatttttttttttacctacatgtaatcgcaccatgtttggcacagctttggattaagatttcttagagctggatatttctagctccacaaatccattaaccaatatatgtttatgttgatataatattattttttttgactgaaaaagtagagagactctaccttataaccattgtataatggtagtcaaggtgatatataaagaggtacaaaagaaccggataaagagggaggaagaagagaaaataagaaggagaaaagaagaagaagaagaagaagaagaagaagaagaaatacagaaaacaggagaaagcatggaagaactagaaaagctagctacgctagtaagtctatccatctgcatattggaggtcgacattgtggcttaatgtgattttcccataattgtagacattctctgatttgatgtgtcacatttgccgtggtaagatctcgctgctggaatgttctatggttgcgtgctttccataagttgtgtgtgcaggcgccaaagcatattggccatccagatttgagatgtgagggcgtaattgtcaggacctgatcaacgaagtggagaacgtctgtgctttgagttgcctgttcatagatgttgagtttcttccaaaccttagaagctagtcggcagcgcaatatgatatggtctgctgtctcaatggtagggcagacagcacaatgtggatcagatgcccagcatttctgtaccctattgtcatttgtgttcagtcttcctcgaaaggccagccaaagaaaaattttacatgtgttcggtattgctttgatccatatgaaaggagctgggcgccatagaatgccatgatatgttataagcctgtagtatgctgctgttgttaatccaaccgggcttagtgtacagcttcttacgtcttgttcagtatgctgtagttgctgagaagctagaatcgtcatgagcgaatccagctcagtttgggcttggcgagagagcacagggtgaagatccagtacccaattatcattaaccagctgagaggaggcggtgcagttgatgtcgcgggcaaacgaggccagggttggaaaggtgaagcaatgatgaattatattgtttatattttagataaaatataaaattttaactactataaagtttaacttacaaacttgagttatgtcaaacaggacctaagctaaattggttttgcatgtacattcattcttgcgtgttcttgttttgaattttgtaaatttcccaaaattcgttcacaaagaaattcgcatttgcaaacatttgggaatcgcgatgtgaaccagcaacataggaaattgaatattcaagactcgaatgcagtcgtttccttctcattcctcaaatatcaatcgaatatgatcttgcacgttcatgttttgaattttttttattgtagagtccgtaaaattcgttcaaaaatcattatgaaacgattttagaatgggaagtgtacctgcactgcatcgtaggagtcggagtcggcgtccacgacggaccactcggagccgacgaggagcgactcggcggcgccggaggaggacacctcgctgagcgcgagcccgacgccgcccttgacctcgccgccggcgccggcgccggcgacggtgtggagcacctccctgcacccgtcgtccttccagtacaccttgggccggtacgaggtgaccagcccgtcggcgagccggagctgcagcgagctgccgttccgcacgctgagctcggcggtgggcgcgccggtggccgggtcggcggcgaaccggaggcccttccgtccgaacgactcctccagcgactgcggcgtcggggccgccgccgccgtcgcggcggcggaggccttgacggcggacggcctcgtggggaggtggagggggagcagcgaggaggtggccatgggtgggttggagtggagtggagaggcgggggcttgggctttcactgcagcctcatatccgcgaggcttcaggatagatagttttttttctcattgtctgcttgtttgcgttgctcccgcgcgttttttggcgctttttttgcacaggagatattggaggggtggtgcgcacgcctacctgcagtctgcagtgctgcggggaagtatccaactatgcaactcctataaatggacgtccgacgattcattcacgtcaccatgagttaaaaaatttaactcccagtaaattttaactcatgagtgaatctgcgagttaaattttaactctcggacgtccatttctcgatccaacggtgtaagatgagagttgcatagttgcactgaattagatgactacacctgatacttccccgcagtactgcagggtttagccagcgatttcattttcataaaacaaagtttactatctcgattagtctaattgtaaatgtaaatacgagcattcgtattaaatctagaacttgattacttgaatgtgtttaggtgaactagtgaatgagttcaagtaaactagttacaccgtaatgaatctaaccaattgaactacggatcacttcgtgattgaccaacaaatttcaattgtttttgtggtcgatttacaactagacattcgagctggacatgctcgaaactcgccgagattgtgaacacactgcagcgacgaagtaggctggtggtcatgaacggtaagaattcacaagtactatttgctgggtggttcaaaataaaaaagcttagaaaatgatggtgaatcatatcgggaagattagacttaaaataatatgttagtaacattttagcacaaaggtcaggatggccgagtggtctaaggcgccagactcaagttctggtcctctaacgagggcgtgggttcaaatcccacttctgacaatattttcgatcatttttttgaaacttttgctttaactttattatagcctggacactaatctttttcaaacagcacgatatatcgtgtctttcacaaacaaaaatagtttctcagttttttttttaaacttttgctttaactttactatagcctgaacacttatcttttccgaagagcacgatgtatcgtgtttttcacaaagaaaaacagttttaatttgttatagcctggccaccaatcttccccgaacagcatgatgtacagtatcaagttttcagtaagacaagcttgcgaatgttaaagcatccgaaacctgtgcgtcctgcagccagttaaatgcaacgctatggacgacgtgtttgtttacttgcacagcatggttagcgcgcgtcggtgcacaagcaaagtctggtt

SEQ ID NO: 36624 - DNA, 1326 bp, Oryza sativa
tgtgacacattccagtattacaactctgtacatatctatattcagattcgtttgtactaaaaaaaatgtcacattcagttctagattcatttttttaggaggaggggtatatctcactacgttggatctagtcatttgtgacggatccaaatcctcatctttaacaggtatactcttcgttattgataagtggtcagtgatgactaaacttattaggatctcacttgtgacagacctaaatcttcatctgaaataggcatacttctcgtcattgatgattcaaccttaacaggaccttacttgtgaccggcctaaatcttcgtctgtaacatactaacatgtatacttttcatcactgataagtaaagcaaacgcaaaacagccgtccgagttaggtaagagggaaacgcgagaaactactctatgtaccaaaatataagaacctattcgatgtttcttatatcttggcaaacatcttatatttaggcatggagagagtagctgtagctccgatcctcgaccagactgacaccatgcaacacttgagcgggaggcgagaccggcacgcactgcaaccatgcaacatctcagaaaaacggtctcacgaatcacgatccctctcaccttccaaccctgaccgcacttgagcagcatatcgtctactcctagttggcccatgggcaccacatgccgatgaaaccacagttcctttctcatcgtaccaagtagcaacaatcacagtggtcaccgtattatactagtactcctttttcagcaacaggtagtagtagtagtactgcagtctgtacctacacttgatcggttcatcaagcagaagcgatagcagcactgcactgcagtctgcagttaaagtgcttggtagtaccatccatccgcttagctatagttaacaaataaagggccctgaaatgataatactactagcactactcatcaagcaaccaaatggaatgatgcaagcaatgccccagctttagaacagccgcgaaaagcagtgagtcagcttcgcaatagctgcttagtggagcacttagaggcgagaccctgcatcatcagatgtatataaagcaagattcttttaagtaaaataaatagcaccaatctaacccacttccagaaccactcaacaacgggattatagtactccaccccccactgaataagcgcgaaacgcaacgcaccaaagccagacatggtctttgcaacttgttgtctttgccgctaggtttttttctggcattttcgacgatactataaacggagtcttagagcgagctaaaaaaaagcaaaccgaaaacgggaata

SEQ ID NO: 36625 - DNA, 1096 bp, Oryza sativa
aaccccagagtccgcacatcctcaaatacaaagcacttccctagttagatgtaggttagacttcccgttcgaaaaactctaccttctacctgccctcaatttatgcacgattaatgaatgccacctgggtggaagcgagaggtggaaatggaaggtcttagttcggaggtggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaag

SEQ ID NO: 36626 - DNA, 10470 bp, Oryza sativa
tggttgagatgaggagataggtggagaagtagctgtatttgagataaatttaaatacttctaaatttaaatcctagaagtagctatattttaagataaagagggagtactatgctagactaaactgctctttcatggatacatatataatgatatacatatcctgtggtgtggagtgcagactctagtccatctccatgatagtgcaaaatctgcttttatcttttcttgttgggagcgttgccggtgcttgtgcctgtcgcaatgccatcttctgctccgtgtcatttcacctgtatgtcggcgtcgctgccggtcagaaaggaagtgtagtgctgctggccggtggtggacttgccagatcttgtttctgattgtattgttgtgcaagatgccggtgtttgttggttgctgctccagcgctgtttctgttgctgctgcagggatcgcaacatggctgcacaaatgcacaatgtccttttgttcacatcttgatgtcaactggctttgttttccagtgacatacattagtcagtaagcaactgaactggtcccaaaaaaaacatgaagttttctgtagagacagcgaaactcatctgtgttcagatcaggttggtacagtgagtgaagaggtcttcatgggaaaggcagatagatatatctattgatctttcttctcggttgcaatgtcaatgtctctcctcacaggcttaattgctttgcagttcgtcactaataggactcttttttcttctttagaggtttttgctatcacgatgcatgagttttgtcacgaaaggagagaaatgttgatgtcactcagatgtgatccgtccaactaacacatacagaggtcatgcactgtgccaattggttttctgttttgcacggcacctgcttttattattgccaactgtggctggatccaaagaggacctcactcctctcaagggaagagacctcgtttacagggtagtttacaacttgtgttaacactgataaggacaggtaagaagtaaacagaatgctgaattctctgaagacatatacaattagtggcagagattgtgatggaaagccaataagattgtacatacacatcccaaatatttagtactagtagcaatcataatggttagtacagcttattacaacatcaaccacacaacaacaaattcagccttataattagtaggaagttcagataaccagcagagagagagagcaggaaagatgaaatgagcgaaacagtgaaaagatgactcacaaagatggccaaaaaggcaaacacaaagcagcacatttggggaagccgatatcatactgtcttcaccaacacgctcacgccttagaaaaagtgaaaagcttttgcatacgaactgaactttggtacgaaatttccagacatatttacagctagctagacgaccccgacattttagagtacaaaacattttgctggcaattttgcatgcaacgagattttcagtcgatcgttcgaagaatctcgtaccaaaaatctgttcgtacgcagcaattcaaatagaaaagtgagacccaaaaaaaaatcaaaaaaatggaagagaattaagaaatcaagaaagcaaaagggttcaatgtgactcgtgcaggtgggcggcccacggcgcggggctcgccgtcgtaaggttggcggccgcggtgatgccgaagaagaggtccgtgaatgcgctgaccacgtacttgtgggcgcgccggtcgttgagcgcgaggtaccaaaagagcagctcgtggagccgcgccctgtcgccgcggcggcgcgcgtccagccgcagcgccgccgaccatagcctccatcgacctgaggaagtcggcgtgcgggtccggcgagtacgtctgcaccgccaccccggccgcgcccacgccgacggcggcgccgtgcgccgacgagtcgacgatggagttggacctgccgggcgaggagaggaagaaccggcgcgacgcgatggccgacgacagcccggagtcggacagcgccgaggcgttctcagcgacgacggcgccgccgccgccgacaccatcgtcgtcgtcttcaccgccgacgccgcccgagttcttgcaccggagcgaggaggacgaggagcacggcgaggtctccgcggtgcagccgccgccgccgccagccgaggtcgacgtcgacgcgtcgtcagactgcgccatgggcgccggcgccgcccccccgacgccggccgccgcagccgggagaagcagcccagcatctcgcctatagctagctagctagctaagctaagctactccccactaggcagctaagcttcagctaggtagctactactcctagtcctagctaagctaaggacgaacacgatgacgttgtgggctgtgcactgtgaggagtttataggagaggaggcgtttgcagctgttcagtggctcacctgttgctggacaaaaccgagttaagtactccaagctgactaagcatgcattatttgttcggattaattactcctaaagtcctacctatacttaacaacattagcaacacgtggatgatcagtatcatcaggagatagtgcctttttcgtttataaataaaaaaaagtaaatgagcagcagaaaatatcatactaccatgcattctgtctcagacactaattaattatcacatcattgtattattcctccaagttagtaatccaagtgtgattaggtccaaaccagccccatctatttcttatgcttatacttatcaaccaaaatttaaatttttaactttaaatataaagttgattttgagatttttttcatcgaagtttatttttcagcctttacttttagatcgttaagaacacgtatataaaagttttattcacaaattacttctcgtttgcaaatacgcgtttggcttattcctactgcatgatactcctactacatgtaaaaagcacagtgttttgtacttggtcagatcgatcagctacgcatgtacagaaacttagcctgcaaatgtattgagagtttgtacgcgttcaactaccgcatttgcttcgcagtacatctctgcttagctacttgtgtgactggtcctaactgcgctgtaacaattcgccacgcattttgtccgtttgtcgccgtaagtacgtacgtacgtacgcaattccagctagctcgtacgtacacatgcccccgcaccgaaaatcgctaatcagctattagccgcgcgcgattgctttctgagcccacgaatctttgtatgtatacgtgtacgtataactttatgtgcatacgtataaagtttgtgagcatataagtgaaattttatacaagtatgtgtgtgaacttttttacatccaaaatatatacacacgcgtacaaggtttctatataaaatatttatatatgtaccatccacgggtgtgggcgcgcggctgaccgcacgttagtgccccctcctctatatatgtacatatatacatgtattatattgagcatcagggtactttctccgtttttcaaaatgtagattgtttggtcgtgtttttttcctcctaataacaagtcgttaaattttagtaagtttgataaagtttatagaaaaatacagcaacaatctttaaccgcgaggtgtatatgtgtgtgtgtgtgtgtgtgtctatatatatataatatatatatatatatatatatatatatatatatagagagagagagagagtctggaatccaaacgtgactagcacaatactccctctattttttaataaataacgtcgttgactttcgaacacatgtttgatcattcgttttattcaaaaattttatgtaaatatataagatataaattatgcttaaagtactttgactgataaaacaactcacaacaaaataaattataattaagtaatttttttaataagatgaatggccaaacgtatgaagtgaatgacgtcatgtattaaaaaacgaagttagtatatacgtactcatgtctgtgccatacggtgcgcgcgtgcaataatcgtgcatgacgagagagtacgtgtactatacgtacgtgacctggttggtacttggtactacgacgtggctagctagctgtgtgcatggatgggttcacatgaccaattgctaccagcatatcgatatgcaacgacacattcaagtcgatcgatctgacgggtcaattgaagcgtactcatgtatagtatacacatgtatgcccgtactgcaggtagtagttagccctgtataaatgtcgaccagaacgaattgattattagtacattgtaccgtattatctgcctgatgtatccccggcctgtggccccacatcgtcagatttaatacgtatgctactcagctgccaccgctgaattttctttgatttttttacagcatcagtcttaattaagctactcccatttacagataaaatatttatgtctgcatactattcactgtataaaagtcaaaagtaataatagaaaacagattacacaacttcagaagcattgaagacaaaaacaacaaattcgactttaaacagggcgcgtaattcgtagttaaatttatttttctctaattatacgtatcgaatttgaactttatatccccgcaaaaaaaagaatttgaactttatataataaagtgatgcgttacctattgatcgatctttcttaccaaattaatgtttctaaaaatttttatgacttttttagacgacatcgaagggccatcgaagggctagctggagtttctcaaaaaaaaaaaggctagctggctgatgaaagaggtttcttgtcacaatctgggagaaggtatacgtagctgtgagcagtgtacgtacgtacgtatgaggtatactcgactgtctacatcgacactacacgtgatctcctgcctttcgctcgcccatctcgatctgtatcgcgtctgtgtctctcaccggcctttcgctcgcccatctcgaaactggttgtttgattaggcaacaggaaaacacgaaaattggatgaaagagatagattcattttctaaaagattggatattttttttttaagtttcttctaaaatttacgtgcaatgagccattttataggaatttcaattttgaatgcttcaatgttttgtatcaaaggaccaagtacggaaattttatataagatttaaatcttacaaattttcccataaatcctttgattcaaatggatctaagtaaagtatagaggatccagctggctcggtttacaaatataaacgagactatgtctaggggtgtgtttagttcctgaaaaaagttggaagtttgaagaaagttaggagtttgaaaaaaaaagttaaaaatttacgtgtgtagaaaagtttttaatgtgatatgatgtgatggaaagttaaaaatagggggaaagtaaagacagcctaggattctagctacatgcactggatgagtatagacaagtaggagtaattaaataggcacttttgtaggtgcagccaggatcagcatctcccaatcccatggttgatactccctccgtcttaaaatatatatatagtaacgtagaatgagataaaacacatcctaaaacaatgcatctagacactccagatacattgttttaggataggtcttatcccatcctagattgctactccctctgtcccataatatgagggattttgagtttttacttgtattgtttaaacactcgttttattcaaaaaattttgaaattattatttatttatttttacttactttattattcaaagtattttaagcacaactttttattttttatatttgcataaatgtttgaataagacgagtggtcaaacaatacaagaaaaaactcaaaatactttatattatattataggacggagggagtatattttggaacggtaggagtagcatatgagagcatggctgtatgggcaactcatgctgtcatgcagatgcaacacaggccagggcgcctggcaaagcaatggaagcaactgaaaatcatatcatcgcgcaataagtgccaactgatttgtggatctcgtcatctcctcgcaacaagatcaagctggcctcctcaaggcagcgaattcatggttgtaagttgtagtaacatgtaaaaggccggtgtaggtgtaccagctaacgctgttaattaagcttactcttaattaatctcctaaccccgtgttcatacactgcacctgtgcttcgattttcagaaactcacaactaaaccggagaagacaagtgaactgatgaatcgaagcaccaattgggagaggtcagagttgttgctcgatctgtctcaacaacctcgaaacgcagaaaattgcagggcccccagttcgctgtttctccggacaattaatgccgcacacacacaggtgacacacaacatttgagaagggtactttttaccctatctatacatttaacgggatatatgcaatattttaaattagaaacctagccacttaaacaagtcgatttaaaattcgttcgtacgaagatttaaattcaaaactttaaattcagaactttaagatgcatatagaccttagatcactgtactaaactacatgtccttttgcacgtaagtgacacccgggcctgatctatacgtccaaccgatatatacgatctttttaaattgaaaacctagccacttaacaagccgttctaaaatccgttcatatgaagatttaaattcagatccttaagatactattcgcacgtagaccttatatcactgtaactactagattacggtgtccaatcgcacataagtgacacacagggccccaatgtgctctccaccttgccagtgcagtggtcaccgcgtcgcgcctgctgctttgccccccgcgtctcggctcagatcggcaccgcggagcagccggcggccggcgtgcacgcggacacgatccgcgtctcgtgcttgtcctcttcgcgccgccataaattccatggcggggcgcatgtccggcgacggcgagcggggcggacacgcgcgcggcgagcacgcgatgtcacgccgtggcgccatccgtcgccgcggttttaacacaagtttaaagcgttgtgatcagtggtgttagaatcaaaactcacgaactctcgctctcacgatctgtcaaccttttatcaaatgtgaacagttaactgaagaacagactagaacgagaatctctgaactttttatcgaacgtgaacagttagctgaagaacagagtagaacgagcagagttttggtgcagcgtaagcttttctggtttttctatttattctcctcgattacagactttgttacatgcataacagaaaaaaaacacctgattgatctggatccactcctgaccgtactcccacgatccaattcagtccaaccgaaccaaagaactagctagagaacagctacaggctaactgaaaagaaacggcttctgacagattctaacatagcttcagccacccatatggccatatgcaatgcaacaacggaaactagaagggatggaagcatataaaacgtacaccgaagcgtgttaattttacatcgcgctcgcgtcgcgacacgagctgtttgatacacatggatcgatgcgtggatcgtatccactcatgtcgttgggccgcggttgaggcgcgcggccgcggccatggacgcggccacgccgcccggcctcgccgccgcgccgggcttgttgcgcatctccgctccggccaccctcgccgcgtcgccgctctccacctccttgtccgccgcgagcttcgccgtcgcgttctgcatgaaccaatgttagtatagtactcctacctacctagctagcttagcttgcaagatcgatatgatcaaagagagcgcgcaccgagaggacgtcgccgagcttggtcttgtcggcgtcgcgcgccgtccagaggttggccacggcggcggactgcgcctgcgccgccaagccgccgggcatgtaggtgtccgtgccggtggcttttgcttcggccgcctgaatggccgccgcgtcgctgcgttccaccggcgtccctcctgccgccagcgccgccgcctccagcgcctcgccgattgttatcttcgcaggttcctccacccgtaccgcgccgggggcggcgccgacgactcctgcaaccacggcggcgccatcgtcctgctccacgtagtgacccaccgcctgcaaaaaaaaaaaagaaagaaaagggagatcgttcacgctgcacgcacagcggagagacgtcgatcgacgacgaagtgtgtgacctggccggcgacgaactcggtgacgatgcggccgccgccggggacgagggtgtcggagacgttgacgccctgctcggcggcggcgtccgtggcctggtcatgcccgacgacgcccatctcctcgttacgactcgccgcggactccatggcggcggcggggccgcccttgaccgtcttccccagcacgaggttctccgccgactgcatcgtcgccgcgtcccgcggggcgatgggcttggccgcgaggcttccggtcaccgggaacacgtcgccataccggatcccctgctcgccgccgccgccgccggccgccttctccgacggcctcctcggctgctcctggctcatcgtcctagtacactctcgtcgtagctagcactattgtagtgagatcgtgtgtggtctgcgctgtgaatgtgtgagagagatcttcgatttcgaggtcatatatggcgcggctcgccgggtagaacgggggacaggtgtgggagacggcggcgacgtgggcgcgttcgtgtcgcgcgcgaatgggagcggcatgcgtggcgcgtgtgagcggtgctgtttgttcgcttcttcctccgccacctctctggtctttccgggtgtcgacgaccacggtggcggtgcatgcagactaaactcactcccatgaacacgtacgctagctgtcatcggacgccgttggcggttggagactacgtcatcgtcccggcctggcccatattgattgcagtgtacgtgacaacttgcggcccatacttattaggcccgaacaggattgcgtcctctttttattgggctcgagcgagattgcggagtacgggcggtctatacttaggctgtgtccgtttctcccacaagagttggatgaaattttggatactagtggcatgctttttaagttctaaacggtgtgtttcgtgcgaaaactttctatatgaaagttactctaaaataccagattaatatatttttcaagtttgtaataattaaaactcaattaattacatgttattaccatctcgttttgcatgaaacacttaatcttaatcttcatcttcattttcaggagattcaaacaccacctaaggtgtatggagggaaagggagggatcataagtgaacttactgtcgcttttctagtgacgtgtggcccatacttattgggaagaacgtattgtacggactataaattttgggccgtaattgtgttacggtggatgagaggcccatttatatccacgcgattcactggcgaagcagaagctaccgccgccgatcaccgatggcgatcgccgccgcgcgccggcggctgtggcgcgggctgacgactgcggccgccgcctccgtaggggtggaagcggacaccagcgccttgctcgcgcgccttgtcgccgagcctgagtaccgcgtgaaggcgacgatggaggaggcgagcggcggctcctccgcggcggccgccttctgggagcccctcgccgccgccctcctccgcgcgtcgtccccgactaaggcaaacctcgtgagtgagacacccttcttctccccgcttaactgtcagttgagctgttgttttgtttagttagtatcagcgttatggcgcagagaaatttccccctttctcgtatactaggtcgggttcagatctgcgatgcatttggcggtaccatgatttagcttatagagtggagtagaactattggatcgcgagcttgcggtgcatgattatataatgcaaagagctaagctattgatagcctgatgccctgatatgattctgttggagtgagtacattggtgctgattctgttgtagtcttcatgacgattttaccgaattatacatgtttgtgcattctagtgagagatctttgtaattgcgtgctaagatagaatcaacattgattcaggtcttggaatggaagctagagaagctaatcaaggaagggatccgtgattgtgagccctactcagtgataatccgtttctgccgagagacaaagaatgcagaatttgcaatgaaagtctttgaattcgtggaggagcttggaattcagctgaacactggcattttcaatgcccttatcaatgctttcttgtcggtaggagatctccttgctgcaatgaccttatatgaggctatggaagacatagaggattgcaagcccaactccgctacatatg

SEQ ID NO: 36627 - DNA, 4617 bp, Oryza sativa
ttccagatgttggataatggcatggtttttgcccactcagaggatgttgaggctgttatctgttcttattttcgtcacaaggactttgataggttggatctattcttaaaccgaatacggagtttgtacaagctcacccggtctacttatgatatattgatttctggatatcagaggttgaatttacacggaaggctcgacttggccataaaagatatgagggaagctgggtttgcatgagttcctgcaaaacattcattgttctgtgacctcctaaaaacaaatttcctgtggattttggaaaagaaggtagcgtcctctttatacaaacaattccgtgctttcagtactttggatttgttaaatgtcatttgacgatgttgctaactcctttgataaactaatcattctttacttcattattgatgttgtactttattctttactcactgtaaaactgggaaacggctaaacaaactgaaatctgaaagagaagtgcagaaactatgttgcatttgaaacaggatgtttgtgctttcaacaagttgaattggcttacaacttttaagtgtataggtttgatatgcgcttactgcttccattattagcctgaataaaatttacccttctaattgtaattgaatacattttcttgagctattgtattatatatatggagtctgaacatattttaagatgcaagaaagacaattcacacaatacaaccttaaagaagttcagtcacaaaagtttgctccagtatgtggaatggatagttcctgcactgaaacatgattaatcttgcttgcataattttccttcggttttattcataagagatagtgcatctcacttcttaactcaaaatatctataagtgctgaattgtgctcttcttttacagcaggctccatgtcagaaagcttcatgcaaagtttgagcttaaagcattgcctcctgttcattcatgaaaacaacgcctcgatgacaggaattaattaatacttccatgatgcttatgttccttgcaaaacaagctagtaaacctgtttgtatgttacttttcagaatctcaggtccagttttgtacaaaccatcaacttgttttcttctcctaataggaaaaaaaaaacgtaccagctgcagtcatgtctctaaactttttccaagtatttgtcagccattaagcatagtcagaaaattaatttgaaatgcaaaacttagatagaactatactgttatgtaaccatgccgacaaacatgcttgacttgctttcacctgaatgacggtataatccagagcttggagtaccttgctccaggattgactttgatttttttttcaaaaaaggtttcgagctttgctgtggccatgtctcaaggtggaactgtgagaaaccttctatgagttgataaattctgacgttgtgagcaatttcttgaatacactgttcatggtaaccacattcgtgagttgattatcatgaggtttcaggacgatgaatctatacatgaacacaagattcagactcacaggatgacatgcatgatcttttcccattatccaacaaatatatgggatcaattgactgaagactttcatacctagccaattcgtgagcttctggtggagccgagctttggtgtcatgcaccaattaattcatactcctatattagtttcccctttctattttccctttctgttctcactttcagtttcaactcaggtagcaattttcttttattcttcttggcacattggcattcatcctcgacaagttcgcatgtgcatcaagaaaattttataagctgtaaacgttctaccattcatttaatcacctaaacatgaagtaggttgattgtgcacattatatttccatttcttacataaaccatttaaaaatattacaaaagctttgtacatattattcttgatgattgtttcagaccttatgtgaggaagaacaactatttttaatgattttaattattcttacataaaccattcaaataaaagatctttgtgaggaagaacaactattcttgattgtaattatgatgattttaaactacacataagggaggttactgtcgcgcgaatacaattatagactagtatattctgaagaaccaattactgagaatttcgactacttgtgcagatgcacgtgagcactgcgaatttgtgattacagaaacatttagatgtattttatgtttgagattcaacttcactaatccaatgtggcaatatatacaggctacaacaatctccgccgcccgcctccccgcctgactctgccttaggcgccaccatgcggcagcagcgtgggtagacgaggaggaggctgggagcggggcgaggagctcgacgacagcgccggccgcggccctgctgaggatggaggagcggcgaggagagaagagaggcttaacctgctgaggatgtacatatctttaatcttttattaatataacatagtaggagcctctcctgctgtttaaccggctaaaaaaaaaagagaggcttctggccgccgcccctccgctcctccccgccgctctgctggcatgcttcgaccatcgtcgtcgtcagaggcggcgtcagaggcggcggggactaggacgacaacaacggcgacggctacggagcagcaccgaagacgacgcaacgaggaaaaagagggagagccgacaggaggagagggaatgatatgtggggcccgccccaccataatatttttaaactgatatgtgggtcccactattcttaaattattttttgcgtgtcgctggcatgtgggctcacggtttttattatttctctgagatataattactacgttagcgccacgtcaataccacgtgggatggagacctagtcaaaccagccacgtaggcgccacctcagccaaaaccactttttaaaccgccgagggacctcgtttacaccggttttgacagttcagggaccggttgtatctgattttggggttcaatgacgaaaattggatttggtgaaaaattaaggaaccttagatgaacttattccttttttgtttgagccgggctgggattggatggaacatacggggaaaaagtgtagcgaaggtccctcaacttgtcatcgagttataaaatcgtcctccaatcacaaaaccaaatatatgacatccctcaacttagggtgtgtttggatggtgggttttgcctggataggagatggctgtttggtcgctgggcggtgtgggatatggccaccaccccagagaatattcgcggatgaggcgatccagggatgggcgagcgcacgctagggaaaaaagtgacgtgcgctcacctccttcccctcgttttctctttctgtcctctcctttttttcctcttatttgagagaactcattatatgccattgactttatcatacgttcacgatttgccactgactttatcacgttctacaatatgctatcgacttttgcttaacttatacaatttaccatcgccgtccggttagtttccgttagtattgtataaatttgtcaaaatgaccaaaatacccttgggacaaaaacttttaaaatttggataaaaattctgaaatataagattttaagtttttggccaaaaattggatgtttacaatcttatgtttataatatgatattttgaattttttatccaaattttagaagtttctattctaggggtattttagtcatttggacaaaaattgtagtactaacataggctaaccggacagcgatggtatactgtagaacgtgacaaagccgatggtaaatcgtaaacgtgtgacaaaattcaggggcataattctctctctctctctcttttttttttcctttctaaccggtcaaaccctagcttctcccttcctctcccctggcggcgacggcctcaagcccgggaggcgcacgggtggcggcgttcggcggttcagggagcggtgtccggcgccggagcttgcagctgaagaggcggtatcttgctgaggctacaacatcgattttctccatccactcatctcccaaaaccaaaggtatactcccagatctgagcttgtttgttgttgtttggtgatgggttcgttcagatctgatgtattatgcttatttgtttgtatttttatatcttgtatgcatctctgtccatgtatatgtgtgtgaatgtagtaggcctgattgtgtatcaacctttggcattgtagatggacaacagaacaaggtttatgatttatgcgtaaaggtaaagcagccaaacgataatgttgtctggaaaaaaaattaaagaagccaaacgacaatgttgtctggaaaaaattgaagcaaaaatatgttgcgactcttgccaatagtcagcttgaagccacacctaggactcagccgccacctaggacaaaaccgggtcaaaaaccaccgaaggacctaaagttaaacctcctctgtgattatgcaaatggacaaggtaatagaactaagccctaggtgtggcttcaagctggctccgcccctgaaattgacctcaacgttaactcatggttctgattgttttttttcttaacatttttggtagtatgaccatgtgcaaacacaacg

SEQ ID NO: 36628 - DNA, 1219 bp, Oryza sativa
tataggcaggccttgcgcatgactcgccgagctcctgtgcatgcatgcggtcagacatttttaaaccttgctttcctatctttgctgtctaatgtttactcttgaagttacaactaataactgtccttgaatgttctttgtccagatgagttgaggcaaactgtaagagctgagattgaaaaaaatcgccgttgcgacgataaacagaagattaagttcttgatcagtgaaggtctgcaacgattaaaaggccttgatgagatgcttgacatgacaggaaatagttaacctgagtttcatgtcggatatgaggttcaatttacacggaagctgggtttgcatgagctcctgcaaaacattcattgctctgtgacctcctacacctgatatttccagaacccataaggcatcaggccacatgaacttgtggcctcctggattagagtttgttagaacggacccattcagattctttgcctcgttctatccaggggataggaaagatatcaggctcagatatattatcatggtagatcatcgatggtgtgcgtgcatatgggacgaaaatgcagttaccgaggcatcatgcttgattttgcacacatctattcagtcaagatatgctagcgagctttagaagcaattgggatttctttagatgctatcttgagaccctgaatttccaggtgttacatctgagaaaatagcagctagagatggattaagctgaagaaaggtatctgacttgtcgtttaggtacgtctgctttgaggcgatgatgttcaactttttcagacccgatggcttacttttcatatttgagatactgacctcatgtttcagtcctgatgttcttaccatttcttcgttgcaatttcttagctggtatgatgaggtcattaaacatgtactttctttccaactatttcattatatgccacaataaagatacttggtaatatatgctggtcctgccgtgctggtatataaaaatatgctccatgatcttaagcttttgttttgttgtgatcatatcaaatgaagggatacctgctaacattacttccattaggtaacttattatgtgacaatcgctgtttttagtgctttccggacccaattgtggggatctcactatcaccatcgattgagctggtgctcacactgttaatctactctagattttggaattttggattatgttgtcttacttaaaaaa

SEQ ID NO: 36629 - DNA, 934 bp, Oryza sativa
tagataataagtagattagatgaacaattagcgcagacaaagggctatcactctactgatgatttctctactgtacaaccaccagcctgccactaatcttccctccattgcagcacctccaggcctcctctccgccgtcgttgtcaccttcgccgccgccgcgccccttgggcacggtgacgacgagctggccgttgacgtagccggccacggccatcgccgggcagctcgcctccggcagccgggacctccacttgtcgagctccatgtcgtcgtcgtcgccgtcgtcgtgtacgcctcctcctccggcctgcaccaccaccctgacaaccccggggtggatcctgacggtgcgcacgcgcacctcgccggcgagcgcggcggcggcggacacgacgaagtggaacgcgtcggggccttcgaacaccgcgacgtcggtgtccgccgggaacggcagctccagcaccttgctgtagacgtgcggcagccgccggagatccttcttgccgccgcagctgccgccggcggtcgtggctggtgatgggtggatcctcatgtgtatgtttctttctcctctttttctcactgtcttctccttttttttcttttcttttcttgctgctggtttgttggtttggttgggcaagacgaagggtggagagggggctctggatttataggtaaaggccaagcagaagcaggtgtcacaaggttgtttctttctctcttttcttgggtgtgttcagggagcttctgcagctatagcttttcttaaaataaaaaactctctaacaatttctcttaaaataagaagttttcaaaaaaaaaaagcttttttttaagattttgatgagttatagttatagaatctagaaaataaattaaagatcgagagctgggaaactcgatttttttttaaattctcataatctaa

SEQ ID NO: 36630 - DNA, 830 bp, Oryza sativa
tagacatgtacagatattcttgaactatcataatttaaacactttgaaattaaattgcccctcgttccgtcgctggcctggcgaatttttttttaatactctgaatttgaactgagagtgatagcctgataagattatcactacttacttcagttcagatagtcacagaagaaaattgcaagtagaaataaaataacatacactgatcaaacaaagggtatgcagctataggtttgttataaaccatggattgtcaactgacacaacttttatggtacacaaagcatattgtagtgatatatttttcagttatagatggttctaagataatactcttcgaacagtctcctggcagtatgctaatgcatactaggcctcgaaattctgtagaaatcttatgggaattagtcaattccttcaatgtctgcagaagttgggaaaacattttcagtatttctgtggatgcattagcaaaaaaaaaaaaattgtgtcaaataattgtggcagataagagctactactaccagacacttcggggcagaccgtgggccactaaaatacgacagatttgatgaatccatgtgaaatgctgcaccaaccaagtgggcctattggcaactgaccttcagaaactaataaaataacctgacaaatctagggaagatttacacggtttgttaaacccaaactgaatcaagagaaaaatcaagataaaaattaatcacatattctcctgtatttacaattggtttcaggaaagaaaaaaaacaaaaaccaaaaccaaaacaaagagaagctaccacttacaaaacttacagtaggttccttcc

SEQ ID NO: 36631 - DNA, 24188 bp, Oryza sativa
  unsure (1)..(24188): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtgccccgtcatctcgcaaaaacaatgaaatcaagtgaagcggccggctagctatgatatctacgtgcaggtgcatatgcatcacatatatgcaacaatataatcggattgggaactctaaaagcaagcgttatacttggagagcaagaacgtagagcatgctgctatcatgctactccgtgatcccctctttatatactatataagacctggccttttggtttgttttaagtcgcactttttaaagttgatcaacttaatttatagaatgaatgtagcaacgacatttcttaaaaaaaacaaataggctgtaaaaaattcaatggtggtgatgaaactaattttatgttgtagatttcgatttttttttataaaccttatgtacttaaagaagtttaactcagaataaactcaaaatatcttatacttcctccatttcacaatgtaagtctaacattttccacatttatattagtggtaatgaatctagataaatatatatgtctagattcattaacatcaactagctgggtggcccgcgcaattgcgcggctagtacccaaacaaaatcatatatttttttagtatgattttacttaaaatttattaaatagctatctcattgtcttaagattttgaaagatcaaaccttatcatcctcgtgtttctaattatatagtttttaaaagtcacaccagttgctaccccttatgtcatctacttctttatttgcttgctcgatctaccaatatttctattcattcttcttggaacctttaaaaattggattttatagtttttagagtttattgtcacattgggtttcatttttataatttctagatgttccgtcaaacgttaccattatactcctgtgtgacatgtccactgtctcttctctttattgtcattgagattttaaaaattgaacataattatcgtttgggttcattttttactttctagtagtcccgccaaaccgtcagcggctttgctattgtactcctctacggcttgcccgttgccttccttctttattgtcattgagattttaaaatcgaacatgataataattgttttttttttactttttagaagttctgaaccttaaaaaattgaacttgtagttttattttttataatttttagaagtcccatcaaacgatgccactatgctcctgtacagtccgtccgccacctactctttattgtcattgtgattctaaaaatcgaatataactatcgttggaattcattttttattttctagaagtcccgtcaaccgtcgacagctctgcaactatactcttatgcaccccgcccgctgcttctcctttttattgtcattgagattttaaaaatcaaatatgattatcaatgggttttttttactttctagaagtcccggcaaccgccttacttgtttacttcacggtctgcctgatatcccttcttttaatcattattaggattcaatttggtgttttattaacaatttttatatgtcgtaccaaccgccaccactctactcctttataggcctgttaattaatttatctcgtcatgtgttttagatggtcttttcttaacaaccgacaccttgtaagcttcgatgcctcgtgagcatggactcgtttcaatgatattttttccgtattgaaaatccaatttgaaatttatttcatattttattataaatataattaatctcattttgaattttagatggtctgtgtaaaacttataacctataagccttatattttaggcttaactacattaattaacactaaattatgctccgaggtgaatacagctccgagctgaatacgtttaaaataaatttacacgattatgattataatttgttgtcagttgccaatgtggccggacgcttctgggtgggttgcatgcattgctggtctggaatgctggttgcagctttgctttgtttgctttacctattgggggcgatggtaatcaactttgcttgtcacttgttctgccgcagcagcccaagtatatctacttcatatatctgcgttttatatgtgcggtaacaatgcatatatacttgcgttttggaatcataacaaattctgtaccgtattgtatcccgcttgaatttttgataccgtatagtaatccaattggatttttctaaacggacaggactttttaatctatatcaaagctctataattctttattttttctatagcaaatctaaaccgttgtaatctaaatctattataatccaacggtgtataattttctctttttctccgattaatgtgagaatttctagcccccacagtgaacgtggtgccttcttttcgagctgtcttaataatataatagaagatatgaatgtgggaaatgctagaatgactaatattgtgaaatagagggagtaatatggaacgaaggggattgtgtgatgttgccttaagacaagttggaccactaccttgagttatgtgagaaaaatcacacctctctacgcgtggtattaactaagtacgcgtaatcaaaaaataatataaatttcttagggatatatatctatcgtgagaaagtactatttgtgtccctactaaagatatcatcatcgcaaatgggtgataatataatcctcatttgtaatgggtatccactagagtataagtttggatgtccatgaaaatgaccttgactcgagactttaagctattttcacagcttatgcgagaaaaatcaagctcttctccgtgtggcatcaactacatacgcgcaatcgaaaaatcaatggaattaaatttctgggtgatgtgtctatcgtgagacgagttataattaatattggtgtgtagtgtggtcttgaaatttgagtgcatcatttgatccagtagagtttaagtatgtgtgaatatgacttagcttcaagacaagttgggctattttctcagcttgtgtgagaaaaatcacacctttctccatatagcactaaccatatggatgcacaatcgaaaaaaaaaatattgatactattcggtcaacgtatatggtgagaagaagtatcataggtgttgagttaagtttaagtatgtacatcacttcatccattagagtttaaataataaatatataagaatatgcgttggctcatatgacataagtaatacttctagaataaaatacgtcatgtaataatatttaattttaagtgtgatttctcaattacatggaattcaactagtttaaataaaatataacagggaaacttttaagtttctgctaacaaatgagttactgaatttctaccttgcgagtttgcgaggacaatgtatagaagaattatatggatagcgccacacaagaaaactcatctaatttccttagtgtacgtactagcacctgtttatatataacgtacgaatccgggactagagagtcccaggactgccgtaagatagggagcggcagtcccggttggtccatttttctttttttttttcccttccaaattgagtgagatgtatatacctaaatcaaacaccagatccccaaatcgtgtgctatgcatatacctaaatcaaaccccaaatcaacgtaacatcccaaatcattcacatcacaaatacaaatcctaagttacttacacacaaatcaactacatcacaaatcttaaaaaaaattacacacaaatcaaatgcatcatagatcgattatacatatcagatccatgcaataaatcacaaattgtaataaaagaaattatacatctcttaatcacaaattattaaaaaaacggagaggagaaccggcgcgttgcctcccgcctgctgccgctcaccacggccggcacgctgtcgccccgtgcgcggccccgctggccgccgccgcgtgctgccccaccacccgctagccgcttgctcgccgacgctgcccgccagatgtgaggaggagaggggaagaggaggaaggggggaggagaggggaggggaggaaggaaatacgagggatagaaggaggatatgatcttatctaaatattttggtgaggaggaaatatcatctgggacttaaccgatcagatatggagagaaatatttacttccggttggtagtatcaaccgggactactttagtgccgattgatacctcagcctcctgacatgcctctgacaggggtttgtgttactaaccgggactaaagatcaaaatttttataaccgggactaccggttcttattggaaccggtattattgtggaaaacagccgatccagcaaagatcatttttctagtagtgtagttttatctcatgtcaaatttatattcgactttattcagttaacgcgttgttaattcgtggtcgatcgatctagtttgtaggtgtagctgccgcaagataatatgcacaagcacatggatcagattaatagctgtcgttttaggcactacgccatttatgtggatcaggacacatgttgcaacttgcaagtgacatgaccgcaagtatatgcattgaactagtctaaaaataataataataaaaatagtctaaaaaagtagtatatgcattgaaccagtcaagtaaacgcaagtaaactaggtactttgatagtctgattgacacagacatatgtagcaactaaccggagtgtgtatggggcacaacgtacgcattcaaaacgttgggcattcaggcatttcagggttatgggtcgtaagtgaaaaaaaaatgtgaccactaatggaaaaacgcagttaatttacagcaagacttttatacccttacctttagttagtggaccaaaagatatagctaagtgataaaacgatgaaaaattcccaataaatcctaagagtacgctttaaaactcaacattattaattgtctttgaaacaagcaagcctaatcaacaattctgattttttttttggtggatggcacatggagcagtgttgatatgcttagatcgaggtcgtgcgtttggcggcgaccttcgtgagcgtggttagcggacgggaaccgcggcaggatgtggtgtgtactttgtggcagtatccttgcctagtcggctttgatgactttggaggtggtaatatctaggtcaacgactgatattctccgatgttactccagttctatttaggttcgatgtcagatgtgagcaaaattcgattagcacaataatcagccgctgatttcacagaagataaggacttcatacaacacaaaattcgattagcacaataatcaaccactgatttcatagaagataaagacttcatgcaacttataagccattgagcagaaacaacgaatggctatgtagattctcgccaaacatagattaaagtttagcaatacctattatctttatcttaaggttggtatttttaattcgtagccattcgatccagccacaacctacgtaataattggttatagcttctttgtagcatatgttgggatgaatttcattttaaaaaatgtgtattgctagattccaagagcataaaaatttgcgaaaattaggtcacctaaaaattacacattcataagcctaaaactgcatcggtatgcaatatacaattttacttatttttaactataatattattcttatatatagttttgatttattaatttgtatctgagcttgagtacttctaaaaaaaaattaaatctttatctttcatgtagtttggtaatatttattttttaggttagaatagtttacaaagtagcgtgcctcgctataagacatgtcacgtgtgtttgtcatctttatatatgatatccttataacatgctttaaggcatgttatacttgagtatgaagtatgaatcttttcactcccccccccctctcttcttattcccctttcccttttaaaagttgccaactatgcaaggtcaattagcagcacttctctcacgcatatgcaagtagctagtagtgcatgtgcatgggcgactgacaaggagcattctcgtaagaataatcaacaccttatccctatcgatgcctatcgatgtactcgtttacttggaagtttggaagttcacttgccggttcttacattctaaaccccgcgtggtacgcgacgttattagatactacatatactgtgtacctatatgtttctcccactagctagctaattaattaatctctcgtacgtttctatatatataagtgaccgcgagatcgatccaagccacggtatgctatgagctactgaaacctacctagctactcaaaagatcgatctagcttggcgagcgtgaggtggtgaggtacgtttacgtacgtacgtatactcagcatggccgggtacaccgaaattttggacaccaaccatcacgagcacaaggtgtgcttggttcgcaaggacgaacctttcatttgctctggctgcaaagagctcggcttcgagctccggtacgcttgccacactgcgggctgcaaccatcagtaccacaggtcctgtacactgcagcctctcaacactcgcgtgccagctcccttctacaagcacgacttcttcttcttcaagtcggtcagtacagctggtgcccgttgcgaggcatgcgctgctgaggtctccgctctcttcattcttaattactaattcctcctggcaaggtttatgattagatatacttaagtctggcttgtatatatttatatttgcacgtatttcgaataacataaatacatatttaaaaaccaaagtaattttgaataagataaatgcatatttaaaaaaaatcaaaggagtcatccatcataaaattaagccggtgataatacctccgaaacatgagaaactatttttatcccttgagggatgttccctcattgtttatatgttacttatgttacttaaatagttatgaaaaaaattgagaagatatattaacatgtgatataccactctacaaacatgtaagtttaaattcaacttatgcatctcgcaaaaaaattaaattatagctagttaacatatattcacagtcaattttattttttttctttgctagatatagaaattgaatttgaacttgcatgttcgtggagtgatatatcacatgttaatatatcttctctttttttttaaatttttttcataattatttaagtgacatacaaacaacgatgagacatctcctcgagttatcagaatccactcccccgaaacatatgttgatgtttctttccttggatggcgaggcatgcgctactgaggtcctcgctctctccattcttaatacttccttccggcaaggttgaccttgactgcaaattaatactctctatgactttttagtaaagaacgtcgttttgattttttacatagatttcatcatttgacttattaaaattttatataattatgatttctttattatggtttggtttatgattacagttacttaagtatgacttgtatttttacatatttgtacatattttgaataaggtaaatgcatattaaaaaaagagacgtcatccgatccattgtaaaagccggcgataatacctccaaaacatatggagttgtttcttttctttggatgtccctcgtttcttacatatcatccaaacaatataaattatttttgacaacattaatcaatatgtaatatatatatatatatcattatgtaaacatgtaagtttaaatttgactcatacaagttgaaaaaaagataatgaaactaactagcaagctagtgtattgttcacatattcacagtcatatttattatttctattccaacttaatttgtatataggttgaatttaactttaatgtttctgaaataacataccacctttgatctatattattagatatatttttttatttaagatggcatcgaagaaacgatgccttaaggagaaaaatgactttccatgaaatatatatgtattcacgaaaatagtattagtagattttttttcctcaaaactactccttcaatttaatcttttagaagaataaagattaaaaggtgctagccatatacattgagaataaaaaagttgagaagatatattaatatgtgatatatcactccacaaacatgcaagttcaaattcaatatagaagttgaatttgaacttacatggtttaatttgtttttttcgttgcgaggtgtagaagttgaatttgaacttacatatttgtagagtgatatatatatcacatgttaatacatcttctcaaattttttcaattttttatagctatttgggtaatatataaataacgagaggatatcctctcgatgaaaatagtttcccagtagaaaaccctttcccgccgttaatttacaccatgctttaggaagctcgcaggtgcgaggttacgtgtactactgcccggacaagaaggtcagcctgcacccttgctgcgcagatctcccccgcgtgataaccaccgagacggtgcagctgaaactggagaggaagatcaccaagaaatgcggcatgtgccacgagcggaatcaggggagcttcagcaacccatgggcctacgcctccagcgagaagatgatccagctgcacgtcgcctgcgtccggaaagctctcgtttcgcagttcgagtcgaggctttacggcgtgcaaaagccgaagatgctgctgccgccgccgcctgctgctggagcaagcgctgcttcttcaactagtagttcgactgccattgtggaatgcaacagcttccccgtgctcgaggtggataagtaccggaggaaatcggccgggttcctcgatacgttcaggcggatcgtcagggcagtcatggccatggtctcggcggtgatcaccgggaaccatttggagatatacatggctttcatagaattcttcaaaccgaactgagctgacaacatttgcatctttgcggtttggagctcgtgtgtttgtgcgcagcaccagtttctccctttaaattatagatttgctttcagaacttgaaaatgggtttgggtggtgtgtggtggttcttgcaagttgtaataagggggaaaaaaaggaacacatttgttcgtacaattttcaacatatatgtataagacgatcagtttaactggataaggtggttgtttaagctgcagagatgtttttggattttgagttatgacaacatgcaaatgattttccgaatgtaaattataattaaattttctttcagaacttgaaaatgggtggtgtaaaaaaaaacatattcttcatgcaagggaaccgtgaatagttcaaagtatagctcaggtgacatggtgcgagggtgttcgcccagtcaacctgggtcctggttttgaatcctaaatcagacttgtcgggcctgttcactttaatgtcattttcaaccttaccaagttttaataaagttgccaaaaaaatggctacatttagtttgtagctaaattttggtaactatataaaaaatcctgccaaaattttggcaagttaccaaaattttcgcaatgccaaaatttggtaaggttttttttttatcaaagtgaataggcccgtcatctcatggtgtttcttgtaccccttattcttaatacaaagatagccagctccgttattcctctttttttttttttgaccaaacgttattcctcttttgtttccaaaaaaaaaaggaagcgcaatctggcatacatgcatgcaaacacgaaccacttaacagttggaacatctgaaaaccccggccagccagatgctgaatcaactgtcgatcatgccgctgataggatttcgttagaaatagatacacacacatatatgcatacactgatacacaaaagcttgacctggagaatcaggccagagtatcaggttgagttgggactgtgggagctagtacaatcacagagtcgttctcaaaaactgtacaatgaagtagagaacggccaggaaaagcgcaatctggtacacatcttggttcaatccatcatccggcctttggaagaactgcaatattgaacacaaaagctcaaaaagttgaaaacactatcactggatagctacagataagtgggtgggtttatataaagtgacatcaatttttgcaatgtatgattcatgtaccttagtaggatcccctgagggatctggataaacctccaagttctcatctttctttgatgatagccgagatgctgtaccctttgcagcttcgattgtgtcctttccggcttcaacagtggagaaggccctcctggacaaccaaaagtaggcctgggcaggaggagacgaggcagagaggtcccatgagtcgacctgttcgagcacttggccgctaatctggttcaatacgaactgtgaggtaacagagacgatcaggtctcctccgatggttgcgaagattggattcttaggtttgcctctgaatgtccatttgatggtcaggttgcttgtcgattgcattgacatttcctggactgtctgacgcaataacacgaatgctgattagatagtcagactggaatcaatccaaactcatgagcatgccaatgtgaaataaggagagaggcattctttgtttgaatttgaactgacaaagtcctttttcttttggacagtatgttatgcaacttgtttgggttagatatcttacaacagagttctaacttcatggatatggtatagaattgcagcaatccttaccactgtagggttttcgagtgccttggtgatccacaatggcctcttgtacttctcccgtccaacaaatgttctgaccgggtcctgaaaaaaaaagaaaggcacgaaaccacaaggtgatgtcaagtagctcatcagttattgtatctgcatctggacatcctaatctgtcactagttcagtagtttgtttcttgctgttgtttgagtggtactttcgttgctattcttcttaatataaaatcagcatcagcctggctaaaacttctgaaaatggaggcatgttacctacttaaacattcatcagatttcctcggggaaaaaaaacattcatcagctaacagcagtattttgtgttggttcatagagcttttgcaagagcttctcggggtctactctgtgcctgaaactattcttgttggtgttgctaaaccttcggagcgaatacgcaaaagcgttactcgctgattgaaatggcatagctctatttttcccttccaagaaaaaaaaaacagatagtactgttaaaaaaaaaactacagatagtgtttgccacagttcatggaatcccatgatcatatcagactcgtagcttacatgtttgctagattaacttgaaaggagatgcaaagcattggtgcgagattggtaccaaattaatgtctgaattactgataacacatagtacggagtagcagtaaagtggtaattggtggtacaagggtgatgcgcacaccttgtatttgacggagacggcgtagcaggtgaaggcgcggttgtcgtcgcggaggtcgaggatgtcgcgggcgagctgcctcgcggtggcctccacgtaggggctgcttatgcactcgaagtcgttgcagagctccccgaagtccatcccgtccaccagcttgtccgtctgcgacctctcctccgcaccatctccggcagccgtctctacctccttggaatcatccacaactgcaatcacgcacagagccgggagttaattagatcacgtacgtgcgagctggaccgcacggcgagatcgcattggtgagatgagatcttcaccgtgcaggggggcgaggcggcgttggagcgcgggagcatggcggcgggagaggaagccggtgacggcggcggggatgcctcgccgtcgccgtcgccggggggaggaggagggggaaagggtgcgggaggagaagagagcggcggcggtggcggtggcggtggccattggtggcccatggcgcggtcggcgtggcgggacgtgaaaaggcgggaggataaggcgcggcgctccacggcctctcgttgccacatgtggcctccgctccattagccctggcccaacaactgctagtccattccatttctcatttctcttctatttttcctcaatttttttaagggaaaacaaaattggcccgtgccaactactataggtctagtattttctagtggactgccttcttctaggcccaacgaggaagatgtatcccaggatgggcatgactttcctgagctttcacgtgcctctagcttcgtgttttgttgaagaacacaatgttttcttatagaaactgttctagaaaatcatgcgtcacttatgtaattcttgtattctgccctctctgtttcatattcattttacgagttactttgattaagtatataaaaaatatcatagtattttcaacacaaaacaaacgtattattgtaacatattgaatattagatttgataaaactaatttaatgtattagatattgctgaatttatttataaatttgatcaaacttaaaaagtcaaaggtacatgtaatatgaaacagagaaagcagatgggactgcaaatgggagatgattttgtggatgaagtataggtcctgtttgggggagcttttagcagctgcagcttctcctagaatcttcagttgccagaagctcccccaaacagttcatcttttaatctagattttgagaatctgtagttgtagaatctgaaaaatgaactagaagctagaagctgggacccagcttctccagattctcactagctagcttctcagcagctcattctcagaatcttaagctccccaaacaggcccatagacacgaagaatacctctgttgctccaaaactgcccagtttacggacaacaaatcgaaagatgcacctgtgatccgggctacatgcaacagataaaatatacttgcatcgaagagtactttactcctggaggtaatcatatacagtatggtgataaagtagtgagttgtcctctttgtagtggaggaggtagtagcatttgtcgcagaaataacagggattgttcagagtccacttgtcgtccaccgtcatcttcgtggcatggaagatctggcacaccgaacacttctgtagccgcctctgcatctggaatgtcatgagagggtattccgcttggttctgtgtgtcctccgggtggatcaacctcatgtccctgatcacaatcatgtgtttgcagtttccctgaaaacgtatgtgcagggtattgtcagaaacatgggggaaagggttgtagatctctacctcaaccatcatacattactacagcttcaagttaatcgattttagatttcatcacaaaacatagataacaaacaacacaaggtttgattgtgactaaatgacgatttgatttccacaaaaaaagtgatgcagaaacatcacaacaataaaggcataaggagaatagataagaacctgatgacagtagaggtacccagcaccgagacggaagttcagatcagaaaagcgagtcttttccatttttgcagatttaaaatcaggaacatttgaaacattcaaacccatcagtaaatccttttgtcgtttcttcagcacaccagaagtaatggcatcccacttctcttccgcctcatttctggaatttttaatccagtcaagtataggtttactataatcaacagtagaacgccttgtgtcattatagaatgtgtcctgacaatagagagcgttgattaatacagttgcaattctttaagaacacacagcaaatttctgttcacagatgcatacctcaataagaaaataaccagaatgaacgtgttgctttgccacattcatcagcttgtctttgaaacagtaaatattgtctctaagatctgtaaggagctggcttcccaacactagaaattcctggctctgcaaggaaaggagatcaccaaaaaatttattccccacatatttcaccctacaaataagtataccaaaaaatatatgtatataagtcattactttcacagagccatatctcttctcataaacttccacacacagaagtacttctggatagactacaggtctgtgctccccaggtttgaaagttttgttctgggataacaaaaatggttagtgtgaaatttgagacaaatgagccacttgtgtaaaagagcaaatgaaataggctatagtttttaatgcaaaccttccaagttgtgctgatgtacctaagagattttgcaacatcaactttctcagctgatggcttagaaactttggccaacacagaatcaccactgcgttcaaaaaaatatgtttatagaaggctgtaatgaaaacaatataacagataaaatcaaatcatctagttatggccataagtgcatagcctggacagctgtattttatacttatcttattctctagtggctcagttataaaaaggaagcaaactattcctaccgggcataccatatatgatttacataaatgggctaataaataggatacatgagtaaatgtatgggctaatcaaaatccagtattaaggggaggtaaatttctatacctagttagttcagccagcacagaagtaccaattttttactgaaacatgaatctagccaaactgggctgcatcctgctatcatctgaaccacaaagaacgatttacattacttttacactgttatttgccacagcccatcagtaaaagttcaaattacttatcaacagaaattccacagctcttcagcaaagctgtgataacaccatcccattcggtagaaaattaaataatatatatctatgagcttatggcacaatcagaaaatggaattactaacaatacatacccacaaatcaaggtcaaataaatacatgcccacaaagttaactgttttacctgaatgagtgcaagctggctgcatgtttgtcttcctcttgtttggccttaatttctgccatcttcactgctttagtaagatagctcccctagttatagccatgccacaacatatgatgacgcaaaaccatggtcagattttccagagattaacaatagatgcaagaagaagagggaaatatgtatatatatttttttagagaaaactactatacaagataaattcatcagaaaatgcatgcaattaagcagagatgcaacattagggtaaggcatacttgtaaaatatgtgctcgaacttctctatcaaaatgcctgcctctctttttgccctttccgcattttgtatctccatctgcgcctgcagcatcatgtgaaacaacttccagatcctcgacaggtggtacagactcatgtgaaacaacttccagattctcgcctaatgaatttgaagtggtatttccaccttttttcattcttcctctggatttccccttcatgccacctgttttcccttcgatgccttgttgtggtacgtatggtacaactgccgtgtcaacagatggtccaggtatctccgtttcaactgacgaatttaaggtcggagtgacattttttcgcttcctgcctctagtttccccttttacccctcttgttttaccgttgtttccatgcacatgtggtatgcttgccgtatcctcagtaggtgatctggaagtctctctctcacctgatgagcttgatgtgatagcaccatttccaaaggtggaactagctgacattctgcatgtgatagttcgaaagaacatcagaccctatcattttgtgagccacataagacatgaatattaaatataataatatgaaaagaaaatttagatgccaggaattcagctacaagccataaaaattgaaaagagatgatttggtgcataaagtgcaaaccgctgttccatgctaccaattcacaatagaactttctttatgagttggcatggaatgacgctatccaacaattaaccgtccgtgttgcatctaattccaactcgcataaaagaagcaccaatcaagcaaaaatagcttaccctccatcaatcctctgatcctccagctgtgacaaagcagtggaatcccagccctcctaaaaacaccaaataacagagacatcacatcaaaatattgttcacaaaactagaactacaattaagcacattagcataagctcgataggaacggtcacctccatagcctcccggagagcgcgctccaccagctcctcctctgagaggaccctcaactcatctacgctgcagaatccacaaaatgtacaaaccagaacacgaataagcatatgaacaacatgacagacactgggggatttctccacctgatacggcggaatttggggggcttaccagagctcttcgtcgaattcatcaccaggatcgcccaattcatctttcagcgactgctcgcaaagtaacacagaacgcgattacaccaaagcaagggcacggattgaagagctagggtttggcggtgtgctcaaggggattcgaacctgcagctcgtggagcgcggaggacatgaactcggggaccgtggagacgggtccgaccatgaaggggacgaacacgggcccgccacgagcgaagggcatgcgccgctgctcgccggcggcagagctctccgcctcctcccccgccgccgccgccgccatcgccgtgtgtccgcctctttcgctggttgggggggttttcggcgccaatgcggtgggaagaaggctaaaagctactgggcccagtataaagcccaatatgaagaatcactactgggccgtcgtcgtctccgtcgagtatcgtctcgctccagagcactcggctggcgggcgaattttttttttaatatttacagaaataatctatcgaccaaaaaaattgcagaaatagcccctgccgccccaatggtgggcggcaagctgacgtggcagacggtgggtcgaccacgccgtctgccgccgtcggccaaaattgcgattagaccctagggcggcaaggggctaattgcaattttggccgcccataaagagcttgcggccgtaattttttcatctgggtcccttgccgccccaatagagagcgacaagggacccaaatgaaaaaagtacggccaaaagatatttctatgttatgttaataataaataaagaagtatttattggtaaaacttgttaatattgttataaaaatgtattgaagttggttgttgcgcaatttcatatgttaagtgaggtattattttgtaccttattcgatgtattagtactcagataatttatataggcctatcgcagtctgggtcatagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatatagtaatgggacaaggaagcatgacagtagaaatttcaatatgctaagttgtccgataatagctaacccctacgtgaggatccctctcctctctcaaaccgcgctttagtaaccctgtattgctctggtagttcaagctgcacaacacggctaggtggagttagaacccttctggtatctatccattctctgtattgacatctccttggtggttcctgggaggaaagattaaatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacaaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcaaccttcttgtaaacaagtggttaggtcgagaacgggattttctgtatcgacccactcgatgtatgcacaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattaattggcatcgatcaccgcataggcagagaggacgctggcaccaaggtggtagtaggtatacacaaggatcgctacgccagtttggatcctcaacaccccggcgtctagccattgacgaaagccggttggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagttacatgcatgatcggcgccgaaagttacattggtcgtatgcgccaaatggcgggcaaatatcgtatcgcacgcgaataaaggaggctgcatcggtgcggcagaaagtagtcatgcatgcgccgaaaggtatcgtgcatgcgccgaaaggtatcgtgcacatataacaacaacgtagtcattacacaagcatacagtactgaaaagtgaagcaaataaacaaagagaagattgctctactggccctgccccgcgccgcgaccacgcttggtcctccgggcctgtgctcgcacgtagtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacatcctctgtcgagcctgaagcgaagtcgaagtcaaagtcagtgatgtcgaagagcaaggtggaaggcagcaagcggtccgacgaggtcccagcatggtccagtggtggaccctgactcgacgtgccggctgcctgtgatgaagtcccggtgtactgccagaactgcgctaagtgcgaggtcgacgcagctgcctgagacgctgaccttgcagcctgggagaagtgggcggcctgcgtcatagcgaactgggcgaaacctacacatcgacaacgggacccttgtaagctaagacataatgcatgtaaattgattgtcgaagtaatgttgtttttttaagtacctgtggggggcacaacagaaggcctagccgaggaaggcggggtgctgaacggtgcacgaaaccctgaagcaatcggcaggtgaaacggctcacttatatgtgcgaggcatgtacagaaatagtaataaaaatacttacctccgtgcggagggggagtcggcctaggaacgtgcgcagctggacggggaccagtcagtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaatgttggatcgtcgttgaaccatcaacgacgacccggttgatgtcgtcgacctgcatggttaatttgttcgtaaatattcgtaaaatttgatgaagagaaagacatgaaaacataaaggaatggtgcgatgcagggtactcacagcacgagcgaagtcctggtcgtggtgcctggcgtagaggtctctagtgctcgcaacgtggggctgctgctccaagggagcgaaggtgaccctagtacgggtgcgtggctggtaccagcgtaggtaggcctggtacgcctcctcagtgtgtggctctccctcgtggtccacgacctcctcggttgcgaggaaccagtcctcaacaaaagtcgccaacgttactagtgcgaaacgtgccgtcagatcgtcctaccagtccacagccgtggtcactggcccaacagcgtctcccgcgagcggtagccccaacaagtacgatacgtcctgcagggtaggggctacctcaccgcacggcaagtgaaaagtgtgtgactctggcctccatcggtcgaccaaagctgctaggagggacctgtccacagtctattgtctggccgggtccgcgtcgccggcggcagcctccaccagccgacacatcggtaggaggccggcctcacgcagcctgcaataacaaattaatatgtcattataaaaaatattacagcgcaactaacttatagtaatacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatactgacgtgccatctctgaaaaatatagtgtttcgtgttagaacaattcagaaagtagtaatgtaaaacaaaagataatttgcaaaattatgaaatagtaataaaatcatgagaataattatgtacaacaagagtacaggctatttaaatatagcaaacgttactaatggtacactccgatgacgtgcaatttaacatatatgtagagctcgataatataacataacattacgtgtcgaagtccgacatacatcagcatacctaaagacgttaggcgccttagtccgacgttacatcacgagaccaaaagacatgacatgccgaagtctgacattacacgacgaaacatagaacataagaactacaccacggagccagacgtggcacgacgacgcctaggacgtggtcgagtggaggtagtgccttcacccgtagggcgagctccatctgctgttgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactatgacacatatattgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatactcatgcctgccttatcttgacatagtatctcaaacctgtgctgttgggtaccttgcactagagctcgatgtttcatggcctttttatgcaactcctctagctttttctgcatgaaagctccaaacaaaatgctgttattcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagctgctgcacgctgatcactgcatttggctgtcaactcatctaatctcttccaaagctcattgaattttttctcctggttatgattgcacagcctcttgaacatgttcatgagctccttgttcttgaattgcttgaagaaatcagcccccatatgacgcatgccccacctactctatacatcttcccaaacaccggggtatcctcgttccatactcccaaactgcaactcttctatcgctcgcagaatgccaacgtgcctatcatgtatcatgctcacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgctatcttgcatgcatgtagagctaagaacgccctttgcagcacactcttgccaggatgttcaattgaggggaatttcttcacttcgtaagagctctcagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatatgcgtgcactctccagggacaaccatcttttttcttaacacaccgaacttcatattgcgaccggttcgacttggcaacccaaaactctctatgaagtgacactgcaaaatgttttactgcttccttcatatcttcttctctactataaatcgctccctgaataacctcattttctttgtgctcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccacttcacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaactatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaatgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatctggcagggcttcgccccttcttctcttctcctcccctctcttcttttttttttcactggaattgaggagggaagaatgagggctgggggctaggcggcaagccttttataggcagcg

SEQ ID NO: 36632 - DNA, 2969 bp, Oryza sativa
cgccccaccagagggcggcaagggttttcctgcaaaaaaaccctccctccgtcaccgcccgttcctcccccgtttgccacgtcaacttgccgccctagaggtgggcggtatggtctatttttgtaatttttttggccgatagattatttctgtaaatattttaaaaaaaatctaaaaccgaaaaaaattcgctggcgggctgggtgctctccaccgccgacccgtgactcggcccggtcgcaacgccgccaagctactccactatatccagtattatggttcattgataccgattagatttagctactagatgttaagagagttacagtaaacttattcctatttttattgaaattgaattattcttttatgaaattgaataaagactgttaaattcgcatacccaagggtactaaggccctgtttgttttagtttaaaattattgtaatctagattattgagtcagattattataagttggattataaaaagcctacatagaataagctgttagctgtttgtttctctgaatcattagctctacatagaataagttgttagctgtttgtttctctgaattattagctagttgttaggtgttagccacccagtatagctgtttgtttctcggaattattagctagttgttaggtgttagccacccagtaatctaaaaaaacacctttagagtggataactagattatagtaatctagcttatagattataataatctatcaaaataagctatctgtttgtttcatcttacttctattaatctatattataatagaagtaagatgaaacaaacatatagcttattatgatagattattacaatctataaatccactctaaatgtgtttttcttagattattgagtgactaacagctaacaaacagttaataatcaagagaaagagaaacaaacaatcaggtttggaaattccagtcatttcggacctcctttgatacgatattatttcggccaaaattttattttttttaacttttcatgaatttcagtaatatttgttcaaaatttcggactaaaatttcagaaaatttggtctatcggtgacctccgatacagtcggtcaatccaataaattaaaccctgcaaacagtttattctatatcagcttgttataatacagcttatagtaatctagatcaataatctagattacaattaagttaaaacaaatagagcctgaatcaataagcatgtaaaatggatctcaaccataatagatttacaaagtcatgtttatgcgtcacttacaaagttatgcttatgcgtcatgtccaaatacgtgctcattcaaataattggtttcgataagcaggtttccgttgctacaaagagaaaagaagatctatcaggtttccgttgcacaaagagaaaagaagttcccatgagtcatcgcttgtcaaacgttgtttgacgatatccttctcccaattattatccatgagcgccaattatcatccataagtcatcgcttgttgtttgacgatatcttctcctaattattatctcgttttcaatctaagataattttccgtgaaaactcgataaaaaagaggaaactcggtaaaaaaaaaaaagagtactgggattgctggttctcgttctagttcgttgaacatcaatttcacaaataagataatccaattcatgaacatcaatttcacaaaaaagataatccttacactgctatctaatcaaagtataaccctccagtctctccaggattgctatctaatcagtctctccaggtttgctatctaatcaaagtatcgatcgaaaatccatcagtttatccaggatttcatcaacacagaagtccagcgagctctgatcgtcccctcctcgcagcggctttttccatctctgcataaatcaaactactatatacacaaaacattctcaaaaacaaaatctttagtcaaaaaaacactcacggttcaaatgactaccgtttcgccgtcgtcgaacgaccacagccgcagcggttcgccgccgtcgtcgtccggcaagactaccgtttcgccgtcgtcgaacgaccacagccgcagcggttcgccgccgtcgtcgtccggcaggaggctttgtggaggagggatcgcgtgttcgcgccagattgcttcgaatcggttgtgctcgatcatgtacccgcccaagttgatgtgctcgccgtcgtacgcgacgccgttcccgctcgccgccggcggcggcgcggcatcctcctgggagtccaccatgagcgcgcccgcgtgagcgtgcgcgtgcgcgcgctcgagcgagacactttgttcagcctcgtcggcggccttctggatcgtgtcgctcgcggcggccagggagacgtcgatggatcggagaagctccagtagctccacgtcgggcatggcggcgatgccgtccacctgcgccgccgccatggccaactcgccgccgccgccgccgggtccttgctttgcggcggcttggttctcgcagtaggaggcgttgtccacggagtgcttccgccgatccttctccggcagcgatttgtaccgagtggcgatcgcccagacctcctccttcgacggccaccacgtcggctcgcccccggcgccgacgcccgggcagatcacggcgacggggacgtcgcaccgcgtcgcgagcgagctcgccttcctcaccagcctctccttcctcatctccaacgccgcgcgccgctgctcgccggcgacggcgggggtgacacgagcctctccgccgccgccgccgccgcgcggcatcggtgctcccatcatctcaaacgtgtgcgtgtgctagcagatgaatcttgtgctagcagatgaatctcctctcgcgcgagttttgtaggctgctccccttccgggcccaagaagcgcacggggttgggcctgaacacgacccggagttcccttcttttttttttttttgaaaaagtcc

SEQ ID NO: 36633 - DNA, 3575 bp, Oryza sativa
actcccttaattgtttaccaaatctaattggtgaccattaactgaaacaccggataggatgactccccgaattattgaaactagtgcaatttgactcctccaacggttttacaggacggttttgctgacgtggcggtgctaacccgattttcattctacgtggcgctttcgtgtcattagaattaaaaaattgtttgtgggacccatttgtcacacacaagaatattatgggacccaccgacatgtggggcccacatgtcatcctttctccttcccttcttcctcctccctctgtctcccttctctctcttttctctcccccttctctgatctgatctcccgggggcgcctcttcggcctcactcgacagcaactcggcgagatcggcgagcgtggtgaccgacgggcggcggcatccatgagagcaggctcccgggggcgcctcttcggcctccctcgacagcaactcggcgagaccggcgtgcgtggtgaccgacgggcggcggcatccatgagagcaggccgggcggcgcagatggagtcggcggcgacgcggcgtggatctctggtggtggtggaagcggggcggagcccgaaccgtcctggctcgcggaggatggccggcggccggtcggcaacgggcgcaaacacccggctctggcggcgaggccctccagggcgggcgccggtcggcgacgggcgctcatccccctggtctccggcgaatggcgtctttctctcagatcaatcagcaccatcttttcacaagatggccggatcgagtcaaactagaaagcaacattgtatcaccggggagattccacgccatttgcagctcgacgacatagacacgggcacacggccgatattacgcgtacagcaatctgacaaacgcgttgttattcccctctccaaccttcctcgatcgtatatatggcagcagcgcagcacgtcgtcatccggccatggacgtcacgggagctggtcgcctggtcaggccatggcggagcagggagcggaggggtcgatggcggcgttgagacgaggcgatgcgctcggagccgaggacgccgtgggagcaacgcggcggagggggcccgacgacgccggccgtggacctcggcgcagagggcggaggagatccggcggagaccgaataagggaaggagatcagatcagagaaaagggggagagaaaagagagaggagggagagagagggaggaggaagaaggggaggagaaaggatgatacgtgggtcccacatgtcggtgggtcccataatatattcttgtgtatgaatgacagatgggtcccacaaataattttttaattttaatgccacataagcgccacgtggaatgaaaaccgggttagcaccgccacgtcagcgccacataagccaaaccacactctaaaaccgctggaggagtcaaattgtactggttttaataattcagggagtcatcctacccggttttctagttaagggtcacaaattagattcaatgaactattaagggagtctaaggggactttttcctttttttttttggcaattgcttatttgaccctgttttgccgatttgaccctaccttttgaactttgcttatttgaccctccttttcgagtacgaaggttccgtctgaccctctttcgctgactccgttagggttcaatttttttttaaaaaagaaaatgtttccagagttcctaatggcaaaaataccctccaaagccaaaccctattctgactctctctctctcactcgtgcgtacctctctctcacttgtgtgtgcggcggcggctagctaagggggcggcggcgacggcgagctgagggggcggcggcggcgtcaagcacagccccgccggcgcccgctcgttgtggtggagggcagcggcggcggcgagctgaggcggtggcgacgacgtgatgtacagccacgccggcgccctgtcacgccccgaactagtcccgactggaactagcccgtgacgctccaaattaacctgttaatcgataccagtcccagaaaacagtgctggtatcacaggaagacagaatatcacagcaacagaggtctctttattatagagtagtagtacagttatgttgggctgcggacagaccccgagctcacaactgcattacaaaaggaaaacggaagcaggacttggaccaaacaatacaggcacgacttgggaactaggccgaaaccctaaaactcatcgtagccggcttgctcctggaagaactcctcatcagcaggatccgcttcatcttcttcagcaactaggggggaattatttatatagggcaagggtgagtacgggagtactcagcaagccaggggaaataagtgtttaatgcaggcttcaaggagagactggtgtttttgcaattgattttatttgaactcttttctgaaacaactaagtgagtgcttctcaaacgacacggatgagacagtgcgtctcgtccggtcggagtatgtgccatgtatcaatctttagaaatgaaaacaaggttggcacccggccaacagcttttcaacggccacccgggcctacaacttttcaaacggccacccgggcctagctgatcccatcagctacagattttcaaacgtcgaaccccttttcacaacagcaatttcacaagcagtagtcaaacaaaactacgctatgaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggtatttccaaagctgacacaggtttaccatatgccgacgagaggggtcccagaccaacaacaggttaggtcccagaccatactgtgccaggaagcccaggggtcctccccgacaccaccccggcgaatccacatgtctctcggcatcaaggcacccctgataagctagttactcagccaggggtgtcccattccacccatatggtcgtacttgtcttatgtttggatgaaattccaaggaaacggtccttaagtgcaagaacgggaaaccgtacacccggtatgttccccggtccgcggttttggaaattcatttagttcgcaagcaccgacccaggtgtcgggttttccaagtcttttgcaaaacccaagtttttacccaagttgttactcagattttaagtttgaaggcgtccgtcgatactcgcgcagggtgcacgaatatcgagacgcaactagatggttacaaggggacatggtatcgcaattaacaaagggaggatcaaatgcaacaaaattaggtaggtccgccaatctgccttgcagacgggacaagcagatcaagtgcgatcctatcagtgcataatattttgcaagcaatataattaaatttcaaatataggctcaagatggtcaaaggtggcttgccttgctcgagagctgaagcttgctcctcgaaatcctcgcactgcgggttttggggctcgaaactacacgcgaaacggg

SEQ ID NO: 36634 - DNA, 11009 bp, Oryza sativa
ggttgggaggatattgaatttctaagattcttggatttttcgtctaaaggaaaaggatttaattaaatccttattggaaaagaaaagaaaagaaaagaaaagagggatggaaattagacttccctcgggcggctagggcgcggcccgagagaaaaggggcggctcggccgagcttaacgggccggccggcccaagaaggcggctcagaacggcccaagacgcgcgcgcgcgggagggaggagagagagagccggtggaccgggctcaccacgcgcggtcccgggtgggacccgcttgtcagcggcttggctcaccgtgcggagggagcacgcgacgcggcgctagggtggggggaaggacgcgggtgcggcgggcccacgcgtagcctcacggctcgtggtggagcgcgcgcacgggaagggactgaccggggtcggctcgacccggtctaggctgagctggcgccgacgtggcgcctacgtggctgccacgcgggccggcgggaggtagacgacgacgccggccggaacggacggcggtcgacagcggcgagcggcggagcgaaccacggcgataccggcgaaagcgagcacaccgggtggttgcacgagacgaggggagacgagccaacggctcggattcgccggaggaagcttgacggcggcgaatcgcggcggcggcaaccggcggggagggaagagggaaacggcgacgaggtcacgaggggccaattcccggcggcgagagcatctatgcggctacgggaatccgatgctagcgtcggattgggcggagctacgccgagcgaggctggcgacgagcgggtgctacggagctcgggcggcgacggcggcgggcacacggtgagcgacggcaacggtcggggcggcgccggctagctacggggaggctactcgtgctaccaccgaaaactaagggggggagatggagcgaggaggaagaacggagggaggcactaccatgaagaggaggggcgctgagacgagaggccgacggcgcgggagtaatctctccggcctcgggccggggaagaggaaggagagggcgcggccaaagtccccttccgcgtcctagtgcgcaccggctcctccggcacacacgtgacggctgcggtcggcgagagggacgacaatggcgcgggcgagaaacagagaagattgggagggggaaaagaggaagggcgggcgcctgggtttatagggggcggcaatgtcggtttggaaaccgactttggcggtcaaggcgcgggctggcgctccggctagcggccaaaacggcgacaggagggagggaggatgacgccggcgggaggaaaaagggaaaaaggagggggagaaagggggcttgcccccttgccgatttaggaaaaaggaggagggaggcggaggcgtcgcggcagagggaggagggctcggcctccgtcccttggcggcttgcgcgcggagtggcggggccgaggcgatgacggcggcgatgacggcggggcggtttggagcggcgcgacgacacgggcgacaggcgcgggctggcgcggcagagggtgacggcggcggcgaccagacggtcggccactcggcacgcgcgcgcggcttgcagcgggagggcgcggcggatggagaggcgcggctcgagcacgcacgctggctgcggggccgagcggctgctggcgcggcagggtagcggggccgggcggcgcagacgcgacgcgggcgaggaccacgcgggcgcgcgcgcgcgaacgacgcgcggggagcggaaaggaggggcggaaaggaggactcggctcggcgcgggcggctcacgcacgcgcggacagagcggagggagcggaggaggggcgctcggcgcggcttgcgcgctcgcgcacgcagcgcgcgcggcgcacgggcggggtggagcggagggagagagagagagagagagggcgccggggagggagggggagatgggccgagagggattcggcccatcgaacccgggggaggcaaacttgacttttgtggaggaatttgatttggagggatttggattcggaattgaactcgatgatagatcggggattgagatcttgagatggcacggacactagacgacaagcgaagaaacaaatttcacaattagggtttttaagagataattttcccgctaggcgccacgacggaacgggcgatacagaccaaccccctaacaagaatctcgaccccgagattcagcacctaagggagcagctccgggaactcggcgtggagaagatcttctcgctcccaggtcgcctcatcttcagaatggttgctccattggactttgtagaacttgatggtcttccttcgagtttgacgttctgcctcttcaagaaccttgattggtcttcccttgtaggtcagattcttttccagctcgatattacccagggggacttgctcttctggaactcgaagacatttctttaactgagatacgtggaacacgttgtgcacatctgcgagaccttcaggtaactcaagctgataagccacttcgcctcgtctggcagttatgaggtaggggccgatgtagcggggtgctaacttgccggacatcccaaacctcctcataccacggaggggtgatacccgcaggtacacatgatctcctttttcgaacttaaggtcacgcctccgattgtcagcgtaattcttctgacggttctgcgctgtctttaaatgttctcggattagcttaacttgttcttctgctgccttgagtatgtcaggaccgaataccagcgcttcgcccacctcattccagcacaagggggtgcggcactttcttccgaacattgcctcattcggcgacatctaaatactggcctggtaactgttgttgtataagaactcagcatacggcaaacaacgatcccaagtgccttcgaaatccagggcacacgcacgtagcatgtcttctaggatttggtttactctttctgtctgaccatcggtctgcggatggtaagctgtactaaagtttagatcggttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagccggtttcgtgagctggtccacgattacccaaatggagtcgtacccgctaggggttcttggcaaaccggtgatgaaatccattccgatttcttcccatttccactcgggaattggtaggggctgtagcagaccagcgggcctctgatgctctgccttgactctttggcaaatgtcacacaaggctacgtattctgcgacgtctcgcttcattccagcccaccagaaatatgccttgatatcttggtacatcttcgtacttcctggatgaatggagtaggcggactcatgagcttcttttaggatgagatctcttaattccttcttggccggtacacagatgcgtggaccgcaccaaactgtgccttggtcgtctatggagaaattggtgtctttcttctcctgtattctttttattaactcttttatcccttcgtcgtttttctgagcttcccggatttgcgactctagggtaggctgtactgtcaagctggcagggacacctgactgcaccacggtcagcctcaacttctccaattctctgcacaggcgatcttggtcaggccgtattcgagctacattgcaataggccttgcgacttagcgcatcagcgaccacgttggctttacaggggtggtaatgaattccaagatcgtaatccttgattagttccaaccatcttctctgcctcatatttaactccgtctgtgtgaagatgtacttaaggcttttgtgatcggtgtatacttcacatctgttcccgattaaatagtgcctccagatcttaagagcatgaaccacggctgccaattcgagatcatgggtgggataattgacttcatgaggtctgagctgcctggatgcataggccacaacctttcgttcttgcattaggacacattctaagccttgtcttgatgcatcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcatgggtctggctaacttagagaatccttcgatgaatcttcgataatatccggctaagccaaggaagctgcgaatctctgacacattcttgggcgggttccaagcaagtacagcttcaaccttgctgggatctacttcgacaccgttggaggagatcacgtgtccaaggaatgctactcggtctaaccagaattcgcatttcaaaaatttagcgaatagttgatgatccctgagcttttccattattagcctcaggtgttcagcatgttcttcctcattcttggagtatattaggatgtcatcgatgaacaccacgacaaactagtccaggtattccataaagattttgttcattaagttcatgaagaacactggagcattggtgagtccgaaggacatcactgtgaactcgtatagaccataacgcgttgagaaagcggtcttcgggatatcttcagatctgattttcaattggtggtaacctgatctcaagtcaattttagagaaaactcttgctcctttaagttgatcgagcaaatcgtcaatccgtggcaacgggtacttgttctttatagttacttcattcagggctctatagtcgattaccattctttcagagccatcctttttcttaaccagaagcactggggctccccaaggggatgagctaggtcgcacataacctttactctccaattcttcgatttgtcttttgacttctgctaactcattagctgccattcggtagggtctttttgcaattggtgcggtgcctggtgccagttctatggcgaactcaatctctcggtctggtggcatactcgttaattcttctggaaatacgtcgggatattcacagactatgggcaccgactccaaggaggtgacttgtaaacaggttaagatagaccgacttgcggtaggactgttagaggtaaagcggacttgctttcctccaggtccttgcaaagtgatggacttttcggcacaatctatctgtcctttgtgctttgccaaccaatccatccctaggatgatgtccaagctttgcgagtctaggactatcggtttggctaggaagtcaacttcctcaattctaaggttaacttccgggcatatttgagttgcccttatatccctcccaggggaatgtactatcatcggtacacgtaaattttgggttttccaaccatttcttttcacaaaagcttgtgatatgaaggagtgggaagctcctgaatcaaacagaactattgcgggtatggagttgacagagaacatacccatcacaacgtctggagcatcctgagcagtctcggcttgaatgtggttcactcggcctcgaccaaagttgttggacgcatgagaaccttgtccacttgcctgggagctaggacgagactgagctgccgctggagtaggagttctagcagtgctgccattagcatgccctgagctggtgttggtaggattctgagggcactgtctagcatagtgacccatctggttgcaccggaaacactgaactgctgacggtccctgcggtgacttgaaagaggtaacactgtttggcgcagtattgccactaggggcacgctgctgtggctggggtgccggacggttcatctgaggacgaggggcgtagcctggctggcggttagcttgagtgaccgactgatggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtagggaagtcatgagcaagcaactggagtctcattccaactgcgattcccttcaagaacttcctgatcttcttcttgtctgtgtccacttcctcaggggcataccgagccaacttgttgaactgacttaggtactcattgacattgctgttgccttgcttaagtctgttgaattcctctttcttcatgtcaatggtgctttcaggtacatgagctgcacggaaagctgtagcaaactcatcccaagcaatgttagtgggttcagggtgtgcattgcagtaattctcccaccaatctgcagcaggtcctcttagctggtgagaggcgtagagcgtcttctcaacaggggtacactgcactaagttgaattttctatcaacatctttcagccaatcgtcagcctcgacgggctcgacggtctgagagaactctggcggacgagacctcagaaaatctgtcagcttggatctattgttgctcatgtgagggtggccatttccatgcgcattatgctgaaaaccggctacggctgcggctaatccttgcaagatttgtgtctgaactgccattaagtgctgcatgttgttttccacatgaggtggggaagggaggcgttcttctccagaattgtgactggcagtgtggtgagagcggtgagactgttccatctctgcatcacaggaagccgtgcgatgcgagcggttgctgcggcggggttgctcaacttctgcgttgcgggaagcagtacggtgcgaacggttgctgtggggagactgctcatgatttacttctggctcggctctaccatcttcaaaaccaaagcgggctggcgcacgagctgcacggcgggggcggctagccatctaaactcccagaagagggcggggtaagaatcagataagcacttaggagggcaaggagcaaagtaaatagcaactcagatagcacacactaggcataaactggatttttcaaatcataaaaacacctgatacaacgggtgtggacaagtcacagagctacaccgagcttgactgtgcgcacaccacctaggagaaccagactaccaaacaacacccacaacaaacacacgcacgcactacctcgccacgactccaaaagagttggcggcggaacaaaagggcctagcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtaggggagctgggtagtggaaatggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtgacaggggcggcctgagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcccccgagacggtggctgtagtcgtgggccaggcgacgaagcgcagtccaggagaggtcctggtacgcgatctggagagtgggcctggccaaagtgaagtggtgtgggcaaggccagctccgtgtatacctccacgggggtagaggtacacagagagctcacagtgagggggaacacggcccacggagtaccccgtgtactcgggacacgagaagccaaggaaacgggcgaggtcacgaagctgagcgacgtggtgaccctcaccaaaaccatgggaactgaagctggcgttcactgccatctacaattttgaaagagggagaaagatcagtaaccattttagaaacaaactattgaaaataaggaaaccaaaagaagccttagcttttcgcaagtagttttgaacttagtatccttagggtcgtcctaaacatcgggtttcgccctagggccaagcctgtgctctgataccatctcttgtcacaccccgaactagtcccgactggaactagcccgtgacgctccaaattaacctgttaatcgataccagtcccaggaaacagtgctggtatcacaggaagacagaatatcacagcaacagaggtctctttattatagagtagtagtacagtcatgttgggctgcggacagaccccgagctcacaactgcattacaaaaggaaaacggaagcaggacttggaccaaacaatacaggcgcgacttgggaactaggccgaaaccctaaaactcatcgtagccggcttgctcctgaaagaactcctcatcagcaggatccgcttcatcttcttcagcaactgggggggaattatttatatagagcaagggtgagtacgggagtactcagcaagccaggggaaataagtgtttaatgcaggcttcaaggagagactggtgtttttgcaattgattttatttgaactcttttctgaaacaactaagtgagtgcttctcaaacgacacggatgagacagtgcgtctcgtccggtcggagtatgtgccatgtatcaatctttagaaatgaaaacaaggttggcacccggccaacagcttttcaacggtcacccgggcctacaacttttcaaacggccacccgggcctagctgatcccatcagctacagattttcaaacgtcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaagatatttccaaagccgacacaggtttaccatatgccgacgagaggggtcccagaccaacaacaggttaggtcccagaccatactgtgccaggaagcccaggggtcctcccagacaccaccccggtgaatccacatgtctcccattccacccatgtggtcgtacttgtcttatgtttggatgaaattccaaggaaacagtccttaagtgcaagagcgggaaaccgtacacccggtacgttccccggtccgcggttttggaaattcatttagttcgcaagcaccgacccaggtgtcgggttttccaagtcttttgcaaaacccaagttttacccaagttgttactcagattttaagtttgaaggcatccgttgatactcgcgcagggtgcacgaatatcgagacgcaactagatggttacaaggggacatggtatcgcaattaacaaagggaggatcaaatgcaacaaaattaggtaggtctgccaatctgccttgcagacgggacaagcagatcaagtgcgatcctatcaatgcataatattttgcaagcaatataattaaatttcaaatataggctcaagatgttcaaaggtggcttgccttgctcgagagctgaagcttgatcctcgaaatcctcgcactgcgggtcttagggctccgaaactacacgcgaaacgggacaactcaacaaacggcgaaaataaagccctattaatgacctctaagcgtgctattagatagatctcgagatttgaggaattttggaagttgaacggagtcaaacggatctacggttgggaggatattgaatttctaagattcttggatttttggtctaaaggaaaaggatttaattaaatcctttttggaaaagaaaagaaaagaaaagaaaagagggatggaaattagacttccctcgggcggctagggcgcggcccgagagaaaaggggcggctcggccgagcttaacgggccggccggcccaagaaggcggctcagaacggcccaagacgcgcgcgcgcgggagggaggagagagagagccggtggaccgggctcaccacgcgcggtctcaggtgggacccgcttgtcagcggcttggctcaccgtgcggagggagcacgcgacgcggcgctagggtggggggaaggacgcggtgcacgcgcgcggttcgcggtggacgcgggtgcggcgggcccacgcgcagcctcacggctcgcggtggagcgcgcgcacgggaagggactgaccggggtcggctcgacccggtctaggctgagctggcgccgacgtggcgcctacgtggctgccacgcgggccggcgggaggtagacgacgacgccgaccggaacggacggcggtcgacagcggcgagcggcggagcgaaccacggcgataccggcgaaagcgagcacaccgggtggttgcacgagacgaggggagacgagccaacggctcagattcgccggaggaagcttgacggcggcgaatcgcggcggcggcaaccggcggggagggaagaggggaaacggcgacgaggtcacgaggggccaattcccggcggcgagagcatctatgcggctacgggaattcgatgctagcgtcggattgggcggagctacgccgagcgaggctggcgacgaacgggtggtaaggaagttgggcggggaagggggggggcccccggttaaggacgcccaccggtcgggggggcccgggcaagctacggggaggctactcgtgctaccaccgaaaactaa

SEQ ID NO: 36635 - DNA, 124 bp, Oryza sativa
gcctctccaccgccgcccgcttgcctctccgcctcgtccgccaccgcccgcccccgctcaccgtcggccgcaccgccgtgcgcgccgtttgccactgtcatgccgactgccgagagagcgaggt

SEQ ID NO: 36636 - DNA, 176 bp, Oryza sativa
atccgccgtccgccgctagcggcttgaaaccgccagaccgcgcacttgccgtcaggactcgtcgggtttgccacagggatcgatttactgcgtcatcatcacagcttcagcggccgccgtcgtcgccgtcctcaacaccgtcgctggcgccgaaactgcctccgccggtgccggcg

SEQ ID NO: 36637 - DNA, 664 bp, Oryza sativa
ccagattcgtaaaatagtggcacaggcatggcttgttttagaatgcttatatcagttctggtgttttggctaactctccattttttctattgtgctaaacgtttttgttgttaatagatccggccagacaggcaaaccttgtattggagtgccacttggccaagagaagtagaatccttggctagacaatttctgcagaacccatacaaggtgcgaataacttgtgccatcgccatgccatcttttgaaaagtatttttgtgttctattattttctttcttggtactaacattttgcacatgtcgtaactcaggtaatcataggatcacctgatctgaaagctaatcattccatacagcaaattattgaggtcatatctgaacacgaaaagtatcccaggtatctactaataacactattatttacaaagttgtaccatgagctgttcctccaactaaaaatttccatgagttaagttaatgttaacttgtttcttacagactcagtaaacttttatctgatctaatggatggaagcagaatcttgatatttttccaaactaaaaaggactgtgacaaggtcccccgcccacttagaatggatggatggccagcattatctattcatggtgacaaagctcaagcagaaaggtgatgagctactg

SEQ ID NO: 36638 - DNA, 11562 bp, Oryza sativa
  unsure (1)..(11562): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacagcgaacttcaattgacttatgctgcgccaaggaaactttcaaattgtactaattactaaacataagtggaagctagcaaaaccttgtgtaaactttgaaatgttcatgttttatttgggggaaaatatgcacatcagtacatgacatgcatgatatcatgatggaagacatggagaaaaatgagaaggcatatggtcagcaggcggtgaaagtgcaagaattacaaagagagtaaatgcttcaagcttgagattgcagacatatagagtttttcttttaaaaaaggttcataaagcaaccattaccagcaaaggattgctcctactgttgcagaccatgacttaaaaagttgaaataaagcatgaacttcctagtcttaatctatgtgaacctaaaatctcgcattataaggtaaatctgagatcctaaaagtgaactttctggctggaatttgtaagattaaggtggacaatgaagtaatgaaccatcaatgtagatgacactgtaggggcacaactacagtcattagaagagcagattttgctgaacatatataatgcatgaaacaatcacagaacattgattgtcataagtaagaagcactgcatatgacaaaagtaataatactgcagaaattagcacttgtatgaccaagcagtatgagcttcatgtgcccatgcagaagtaactttaatatggtacgctgggatactcacatcttcactaagaattgggaagccggcatttctgtaatttcagcttgttcactgttgccatttgaacctcttaaggtcactgagagcatcttagtatggttgaaaatacggaccaatcattttcatgcatagagaatgaatgagcctttgttttgatgcttgaaagccataatgtctgtttagaagcaaatcacagtgccctggcctggaactccttccgatcacaatatttctagttgcataattgatcctagaaagaaggagaaaaaggcatcatcacaaggtcaatcaaacttagggaaaattctccaagccctattactattttgtatagccacaaaccattcagtaataaatatcattgacagcatgctggattaagtctgatggcacttcttaattagtgtgactttttgtacatagaactgcgagatgatttatattaacaatatgaggtatacgactggaatattgattcaaacagcagactgagcgtagtgtatttacatcaaaggatcagttacataccttgaaagttaaaattgtcactcatcccttcatagtgttaggaaacaggaacatcaagaaaataaacaatgacgaactgaccattcctgataggtttacaatgaggcaaaaattagcagttgcttaattgctttaggcgatgtcatattagctcatgtaagtacaaaagagctgcattccagaaacacactgcaacaaacaaaaaggcatacgtacatgtgcttgtgtttcaaaatggtactcttaagacaccaactcagacgcaagttctgtttcccaaatcaaaactcttagaaaacgagcataaagaaaaggataatctagcatttgccgtgcccccaaatcaaataaaccctagaacataatctccaacaaatactgcaaagaaacctgccatatcaaccatatagcttgagctgttcgcctcccgcggccatacagcctactgcgatcctttgtcttcagccttcagtggcaacgtccgcatcgttgagcaggtgccctaatgggagatgatgaatgagataggggagaaagagaagtgatataatggctgagcaccccatctcgcctaaagttgcaacctcgcactcgccttgaccacgcctccacaatagctactaatgctgccactgacagtggatcatgcatgaaccatgttggcaagttcaaatgccccaaactgcttagagatggggttttttgaacctttgatccatttacatgggtattttgaaaccaggtgcttagacactggggtttatgaaacacaagcatatgtacatggggttctctgatatttactctttatttttcaatggaatggatgggcacaagatttacttctgcatcagtgagatcctaatcagtagtgagtagtaagtatgcccaaatctaatatccgtgaaatacagcagaagtaaattagcaagcagcagcatcagtaacagcagccatgaacagttagcagtagccaggaggagaagcatggctgcgaggaacggctcccaaactcacctgagaagagaacggagaggagattcaaattgagcgagcgaggagggcgcaaataaaaaaacccagccatgattgtggcgccgtgctccttctccttcgttcttctccccgacctccgccatccccacaccccactgctccgaccaccatcttctaccggatctggcggcccctgtgcaagaacctgcatcgagtggggagaagagggagagaagaagtggcctgtggcggcggcggcttacgtccatcgcggaagaggcgacgatggcggcggcggtggctggaggaggcgaggatgcggcggcggcgggcgcgaggctgcgggagaggccagcgagggggctatggcttggtgcgggtgagcgaaatctgcgccgtccgttcccgatccgacgatccacgggtgcgaaagggccgccacagcgtgaaacgtggacggtcagatcggccctatagagagatcgaacggacattgttattgggaaccagtatgtaattaacgaaaacgcaagggttctgctgcaaaaattgctgacgcggcgcgattaatttacagcgatcgcattagagtggttaatattttctctcttctttttttttttcacccggcctctctccctcgccttcctctcctcctcgccttcctcccattcctctcgattccggcgtccaatagccaggcgcgccggccgccggtacccgcggcggcggcggcggcggtgcctccccttccttcgcggcgtcttcctcctttgcgccggcatccttcgtcgcgcacgcagggaaatcaacgcctctcccgggtggttagtaatctttttctcgtcttcctcccaagcctcttgctaggttagggtttaatcccatgttgtttcagattgcgccgagaggggtagggagaagggagggagatccggccaccctgcaaggcatcgtcaccgccgtgatctggtaagaatctctctcgcctcgctgcaatggatccttagttttggcctgttgttcaagcagagctggtcttgtttgcgttcttggtttttttttttttttgggtgagggtgggggtggggggcggaggaggtgggggttggggttggcggtggcgcggcgggaaggtgggggttcaaattggtgtcactttcttgatcatcgagttgtcgtgtggcatcgctttaaaaagtttcttgtattttaattctcttgttcaaaaaatctgctagtcatgcgattaaccatctgtacatggtacagtaataaccaccgatgaaaataacatcaaatgaggagaaatctctgctttagcagttacttgtcactactgatgaagataatatcaattaagaaattatctgctttagcagtttagttagtactcctagtactactagtataaatatgaatttcagaattgcagtaatatgaatagttcaaatgtatcatgtttctttctaggaaacaagaaccatgtgttacctgtttgcacttcttgctttactgtcttcattagcacagtctatgattgccccaatatacaagtgagttggagtcactttgccttcttttttttcctcaaacaaaaatgcctctgtcaaaatcaggaaaatatgaaaccatgactacaaaatcacttggctgactaatttttctgtggttattttcttttcaaaaggtactacagaactgctctagtttgcttggattagctcccattttttttctgaacataacgttttgtctcttgtatcgaacaaatatctgagattgactttggttcattataaattgtcatacaacgacacttctgtacttatgatataagcaacgatcttttgtactttcaccaccattttacgatccaaacttaattaatcttttgtactttatcgtgctatacttaattgcaaggaaatcatagaatcttctattttggcatcctatgatgctttgataggtaattatgttgtcaactcactattcactgatggtctacaccaaaatcgctatatattttctgcaggaagcactatatacaactacatagtgaatctgaggccattgtttggtgcatgccttcatcggaagttctgccttttttttttaacttgagttgtatggactacttatgaacgtggaacttctctatccttttgtaataaaacactataattcagatggttggagtgtaatgcttgtgataaagcaaaatgcttttactcttatttggagtttacagactgagttgcctgtaaatttgtaaaaaataggttggaaaattggtatgaaaaatctgactatctgagagtactagatgatgcttatttgtttttattaacctgacatttctgctatgcctgattttggtgtgcttctgtatgtggaactcctgcaatgcgttcgcaggtcactctcttttaaattttgattactaccaaaatgctatgagtaaaatgtccattctttgctttttcccatgcttatttcaatatatgttattcacttgactcaaccaaatgttagactattgtataatattagaaaaatatgagggggctaattatagaacatgcaaaattagtagttatgggttggtggtcagttggtggcagaaccactaccaccactatttctgttatagtaggattattttttaatttttgtaatttgctggttcaggaagaagcaatccctgctattcttgtgatattcagtttgtatccaagcaaaccaattgaatggaggggattgggtgggtgggaggggatcaacctaatcacccccatgggtgaattttccctgagaaattcctatcagataactgaacaaagcctgagagaggaaaggaagagaagggagaagccattttcaccaactgctctagtgcttgatagagtctgtagaccaactgctccagtgctcagtagagtctgtagaggcaaacattcagatgaatactagagataaaatatatattcatatggagatatctaataaaacaactgaatttcagaattgcagtaatatgaatagttgaaatgtatcatgttcctttctaggaaacgagaaccatgtgttacctatttgcacttctttctttactgtcttcaactcttcattagcagcggctatgactgtagacttagtgtcttaattaagtatatacctgaaattatatgcatttgagagagttcagtacttgagttggttaagttctactcttgtcctgaatgaattaaatatttgactagtttcttctagtttccatgtaccagttgctactctaatgtctttgggattgactagttatggtcactaatcagcaattggtagtagtaacaatcagccggcttgcccaaatatacaagtgagttggggtcactttgccccttttttttttccacaaacaaaaatgtcactgtcaaaatcaggacaaaaatgaaaccatgactacacaatcacttggttgactaatttttctgtggtgatatatatattttttttcaaaaggtattacaaaacttctctattttgcttggattagctccttttttttttctggacataacgtttttgtctcttatatcgaacaaacctctgagattgactttggttcattataaatggtcatacaacgacacttctgtacttattatgatataagcaatgatcttttgtactttcaccaccatttaggagccaatcttaattaatccttttgtactttatcacactaatatacttacttgcaaggaaatcacagaatatgctattttggcatcctgtgatgctttgatagctaattatgatcactatattatgttgtcaactcacagttcactgatggtctacaccaaaatcactatatattttctgcaggaagctctatggccattgtttggtgcatgccttcatcgaaagttttgcctgatttttttttagaaacttgagttgtatggactacttatgagcttggaacttctctatccttttgtaatacaacactataattaagatggttggaggataatgcttgtaataaagctaaatgcttgtactcttatttggagtttacagactgaattgcttgtaaatttgtaaaaaaataggttggaatttggtatgaaaaatatgacagtactagacgatgcttatttgtttttattaacctgacatttctactatgtctgattttggtgtgctttctgtttgtggaactcctgcaatgcgttctcaggtcactctctttttttttttggattattctgttaaactttgtaatttgctgtcattcctatgttcaggaagaagcaatccctgctattcttctgatactaacctcacgctttactgcgggagtttagtacgataacaataaatagaaataatatgtaagacagctagattgacacaagtttatgatatacgataattcaaatagtatatggaatgatgattcaatgtaatagtaaggtgatgtagttttatgagagaagaaaagaaaagagataatttagaccataggttaattatcgaatggctaaaaacaattgagatgatatggctcaatgagagaatttggattatagattaatcatctaagggttaaaaataattgagatatagcttaataagagaagagagaaataacattaactaagtgggagatactgaaatttatgtgaattatgtgagatgatttaacatgtttgtattttaaagctctaaagtttaataaatatatagttgtataaatatagcatacatgatgattaagatgtaataattgttagtagatgatgatataacatctttgtattggccggttaagaaggtgggtttggctcaagaggaggcaaccggtattgctcggttgaatgggcgacaagggcaatgattacgacgatgagtatgaattgattagtaaaaattgtgattccaactaatcctttggatatatgccctggtacactatatatagagatcaaggctgagtgattcacgtctgataaaatcagtcccaattctttgagcatgctctatccccttctcgctcctcttattgtgacttttctcctaccttactctgagttttatcgtaaattgatgtaatcgatgcttgtttctgtcgacatcctctttcctgcgagccaaagatagcggtaaagattaaataacatgccattgtttgtttatcatattgctcatttcgttttaaaagaattaaaaaccattccgtgttgacctacatctctttttttcgtatttggtgattactttttttttcttaaaattgctttgattgattattgttatgtaaacttcctcttcatgagaaccgaagatgggtaaagattgaagaatctttgttgtttgacatttgcttgtttatcttggtttttaagcattagaatcccttatgtgtagatgttttttttaaagaaattgctttgatagttgattcttgtttatgttgcagcccgccgatattcgcttggaattgtttcttcatcgtcctgcacgtgtcacttgtgcagttgtaaggcgaacaaactatcttacacctccaacctgccaggtagaggtaagaacaagtccatcttgagaaataatttgttttttggttcttttaatcatggcagagttcttgtgctgcagacagcaccattttttgttgaattggttgaattttttttctctgttggtatctagtttgatctaaggcagatgtcttcttgtttattccagggaaattagtaaatcacatcacgatgtgggaattactattttgggatctgctaggcagggaaaaaaagaaaatgaaaaagagaagagaactactcaagatcagaggcaacctaactgctgaggtatgtttcattcttatacaatgccctcgaaactttgcttttagtagagagtagtaacaattctgaatttacacgagtcataaatgtacgggtaaacctgctcttgtaaatttatgctaagagaaaaatgctattatgccatttatgatgctacatcaatcacattaacacaattagttctagttggtagtggtctgtgggccaacaggcaaaccacggtagatacatgtgcatggcagtggcacccctaaaacttaaagaaaatagtattgcgccgtggattatccatgtatgttactctctctattcccaattaatcattatataatttttataaggttattttcaaattatattcattccctagttattatttgtgcatgggagtgaatagacattagtgcatgcatccatgtacacaactctttacaaccaatattcaatgtctttgctttgttagtggctaggaaatagcgggatggtgcatgcataagtttgttataaatgtagtacgggagagttattgtttcttcttaatcctagtgcacttatatagtgtgatatcaattggaaacggagggagtatcaacatagggctgtaggaataggtcatttgacaaccatgctttggtggcggctcattttttttttctcttttctctatttgtttatagttcaatttattcttagcagtagttctaatgcattaatggtctgatttttggattatgatcccagttcaagactaatccagccgcacctaaaaaattaaaagaaaaagcccttttactctatttttggattatgatcccagttcaagactaatccagtagttctaatgcattaatggtctgatttttggagtatctattttcatgctaccagtgttcttccctaaggtttgacttacagaagactgcgaattaatgttgaatttctactgatgacatgctgcaaatgtaagggaaagtagttgtatatggagcttatgttaagtcgaagcggttatctattttttatgcagagaaccgatttcttgaggaaaatgcattcgcatgtgatttgtgatctacaagaggaaggccagagattggatttttatgttgaagaaaaagagcttataagtgaagtgagcgtgccagggtcagaaagcactctaaggataagcactgaagtttgcagagctgttcttttcaagataatcaaaaggttccaatccatgcactctgctggattcagtctaggtgggtttgaacacaaaattctgtttgtcacgtcagattttgaggtgaaaattggtggtattagtagagtgaaagatttcaccaagacaagaggatcgaaggattacaagagcatcggaaaaattgcccgggaagtgatattctcatcagtgacaaatttgccggttgatatcgagcaactacttgaccttttgaccgacaatcctatggagcaaacagcccttttgggcatgcactactctttattggacccattgactcaagtatctgagttcctttggtggcacaagcgcctcattcacctcaaagacataaatccagaaaagtttcaaagaatcatggaaaacatcccaactggtaacaattggatgagtcgggcggtggagaataagtacataagaaaggtttcactgggcattcctaagaggagaaagggattagtacataccaccgaggaagtgaagcctgaaacaacagcggcaagtcaaggtactggtattgagggagtaaaaccaaaaactgcagttggccaggataccaatattgaggacccaaaacctgaaactgcaacaccaaaatgcaagtactcggaagattcatgggggcagagtttgttgtgtaggaactcaatagaacacctggacagatgggcagcattgagaaggatcaaaaaaaagaaatcaggtggcaagataagaacggtaaaagttcaattcgaggaaatgggcagatgctatatcataatacaagcattctctaagttctttggagagttgcaaaaagccttggcagaagagaatgaactgccacagaagaagcagtgaagttttggtgtcgaaaaggtgatgttcactgtagcaatgatgttgtgcaaaaacgaggttccctggatacttgttagcagaagatgatgaggttcattgaaaatattaattgcattgaataagcaatgatgttccgttgatactgtgcttaacagaaaggtgatgaggttaattggaaatagtgcttaacagaaaggtgatgaggttaattggaaatagtagttgtattggtatattggctgagaaatgatgtaatgcaaaaatgaggttccgttgatacttgatactatgcttataagaagatgatgaggttcattggatatagcagttgtatagcagttgtattggatatacatcaacggttacgtgactactacttcttacactgaagagagaatgtgattgattgttgatacagccacgtcgtataggacaaccagaatcccagattacggtgtgtattgtgaacatgctctactcgtacaatacaaacacccacaccaatatttgatatattccatcactgccctggcaaacattctactgccgcattgtctctctctctctcttgccgccggcgggctcgcctccccctcgccgccgcctgctgtcagccgccggcccggggacggaaggagaggcggtgagtcctcgtgggctgccgccgccgctgccggatcaccggcaccggcacgcgggcgacccgatctgcggcacgacacgtcgttggccgcgggagttttggtgagcagctggcaccaatacgacgggaccaaacatctcttacaatttggggatctcgcgcgctgccccgatttgccttcaaaatgtttccctcttctcttcgtttctttctgtttctattttgtccctggtgttttaatgttttaataatctgattttctttgttgcgttgataccagttgaagatttctctggcctcacctaacaatttggacaaaaaaaaaaagagtgatcacattatctctaattccatagtgctggtgtggcagtacccttttgcaaacaaattcctttgccgcaatgtcaaagcttgccattctaggccgcaggtatgtttttattttctactacttcctccgtttcataacgtaagtcattctagc

SEQ ID NO: 36639 - DNA, 26433 bp, Oryza sativa
  unsure (1)..(26433): unsure at all n locations
atgacttttatattactcaacttatgtattccactatttctcatgcatggtgtgtgaagtttcaactttcaagatatgaggttgcatgaaggatgtaaatataggaatttatggcctatgttaagtttggcactgtatattaggtcctcatttacctgtgtactttgatatctcctttactggagtgtatgccatcatgtgctaaatcaacgttgttgctaatgatttctttcttcatttctattatttctgtattactgttctggttaatctacataattctttgctcaagatttatgtgccaacaaaccctaaaggtgctgaaggccttgcacctggcattgttgtgcctgaaacagacctttatcttcgaagattgtggggtgaacctagtgaggttagttaccatttcactttttcagtacttgtatcaaccaatacctttgaatggtgggtcttttaacctcttctgttttgtatgtggacgtgtggtttatgatctgaaccatatgaaccatcaggatcttactagccagccaagataccttattaccttcacagttggatactctcaaaaggcaaatattgatgcagcagtcaaaaaggtaattacttagacaactagcatgtgtaaactgattgcattgaataagcatacaattgctttgttcaaaatagtcttcagaatagaaaaaaaaaacttatgttcaactataaggcatctatcatgcttaaacagttaactgagacatctatcattcacttcaaatttacatgccttattatatagttttcagaaaacttcacaattatgttgttccactatgatggtcggactaatgactgggatgaatttgagtggtcaaaaagggccattcatgtgagtgtcagaaggcagactaaatggtaaattattgtaacagatcctgttgtgttttttcatcttctagtttagcactatgtatttgacaaccaaaggctaagtgttttactctttttttttatacaaggtggtatgccaagagatttttacatcctgatattgttgccccgtatgactacatatttatctgggatgaggatctaagtgtacaacatttcaatgcagaggcgtaagcatacaccaccttccccccttgtttgtttattttcggtctgctaaggaagagtatttcaacatgaatttttaggtacattaagcttgttaggaagcatgggttggagatctctcagcctggtttggaacctgataaaggtctgacatggcaaatgaccaaacggctaggagatcaagaagttcacaagtgagctgatgaatctacaatgcttcattgttgcttgatcatcacctacttgtattagtttcttgagtgatacttctctatgtacagagtaaccgaagagaggccaggctggtgcactgatccacatctaccaccatgtgcagcgtaatggctcagtcatttatcatgatgttttcttttctttttttttctttttttttttgaaacgatcgcggcaagaaccttgccgaatatattagaagagtgaaataaacagttttacattagacgattacaaaccagacggataagcgacatgaaggaaaaacagcaacggcataacaaaacggaaggaggatcagatgttttctttttcttaaaactatccgtcttcacattctgtttcacatgcagatttgttgaaattatggcaactgtgttctctagggatgcatggcgctgtgtatggcatatgattcaggtggagtggcatctgcactgttcttagctttgcttgaagctgtatgcttatgcccggctttttgcagaatgacttagtccatggatggggcctcgatttcgctcttagaagatgtgttgaggtatctttttttttttacattaataagactctgccctactgcattgttatatagtcctaaccagcagaaggtctaggttttcttaattttaagattctttttaaatttaattatcttggggactagtggtgtgccaatctattaagagcaaggaaaatgtgggggctaagtgattcatgtagcgaactaatacagatgacagggcagtaggtttttctcgataaacggagggcatgttaactgttttattcatgctcctagcaagctagcacaatctattatgtactggttgccaactttgttatgacagttatctggttttctccactccacatttatttatttcaaatcagtcatgttttattgagtcagaactttggtttgacagccagctcacgagaaaatcggagttgttgattctcagtgggttattcatcaggttattccgtcactggggaaccaggtatatgcactgcttatctcacttctcactccatacaattatatgatgttgtaagttgtaacattatctcctggtactggtagggcacggctgagaatggaagaacaccatgggaaggggtaagctagctctgatgtattcctcgcttctcatctgggcatttccgatgcatgaattctagacttaacaacatcctatatgaatcgcaaccatccgcaatgcggatttgctcttacgattttatttgataatgtgccataggtgcaccgaataaaaccgtatgagcaaagacccagagtcttaccggctagcaccataagttggtgggctagcccgccttggtttgagcctcaccaccgagaaacgctcaggggttttccggctagttccacaagatggtgggctagacgacctgagttcgaagcctcacccccttctaattatttgatattaggtcattccctaatattcgcgtttgagcctcaccacctcttaatatacaactttttttcacaggtgagagctcgctgtagaaaagaatgggggatgttccaaaaaaggttggctgatgctgagaaggcatattacttaggaaaagggatcacaccgccaaattgaacagcagtttagatgaaaatacacgcacatcaggagtaacaagtcttagcaagttttccatttcggaaatctgcctcttgcgtataggaatagagatgttcatcaaagcattgtcgccaaaataagaagagaaagaaagcagctgccttctgcaaatttcagggcaagttttgtacatgagaatcgccagttctcgcctttttttcacttggttttattattattctttggtagtgagattagctatgttgttagtacagtagccgctgtaacaggggattctatgctctgcttccttgttcatacacattttttgtattattggccagacggccagacctgatgcaaaatctatgctactgacaataatacacattttgttatagtcaattaagtcgagcgtattagtaatcatcaaacctttataaaaccttatacattatcatcatttaccacatagtggatgcagagcatctataataagacatacaatttattttctgatacattagagatcttagtagtaatagtaacttcttaagccaagcgtcgaacagtttattttaagcgcatcagcaacgcaattgatattttttttttacttacgcgcggttaattagtttgggattaggccatgattcggaaacatggcttggcattgccacgcacgcatccgccgttgccgccgccgccgccggcgtagcccacctgggtggagctctcgtacttctggtagcgttgcgcgccgccgccgtgctcctcgtggcgctcgtatgcatggtagtggttgcggccgccggcgtgctgcttctcctcgtgctggtacgccgcctggtggtagctgtggacgctgccttggcggctaggtgggcagtggccgtcgtcgtcgtcgtcgtcgctctcgtcgtcgtcgtcgtcctcgcagtcgtcctcgtcggaatcttcctcctcgcattcgtaggattggtggtggtattgggtatggccgccgctgctgtggtggccggcggcggcggcagtgaagtgctgcttgttggaggcgttgccatacgcggcggcagtggcgccaccgtagtggtgctgcccgccgccagccacggcgacggcttggtggcggttgtagttgtacccgccggcgccgcagccgttgacaccctcgatggcctggtgctgcttgtaggtggcgtgctgcttcacggcgccgccgccggcgccgtggtggcggccgtaccctcctccggctgcggcgtcgcactcctcttcgtcgcggcggtaggaggagtactgcttctgcacgccgccgccgttgtggcgagcgtacccaccggcgtcgtactcctcttcctcgcggtaggagtactgcttcttcacgccgccggcgccggcgccgttgtggcgagcggcggcgtacccaccgccggcgctctcgtaccctttcaacacctcgtgctggtacgtggcgtgcttctgcccaccgccggcgccgtgctggcgagcgtagccgccgcagccgccgccgcctccgccatggttgctctcctcgtacacctcctcctccttcttctcctcgtaggtgtgcttctgcacggcgcctgcagcagcgccgccattgcggcacacctgcacgtcgccgccggcgccgccctgctgctcgtacaccttctcctcccggaacgacgacgacatcttctgcacggcgttctcgtggacgctcatctcgtccatcttcgtcacgacggtggtgacgctctcggagctctggctgtggtagttcacctgcggcttgctgtagccgtagccgtagctgtaggcgccgtactggtagccgccattgccgcgcctagccatcgccattttttcttttggcaaatctctctagcttgttgctgggcagtagtgctagctagctgcttgtgttgttgtgttgcgttgcgttgcaagggttgtgtttttataggcggggagatgggcgcgcgcgcgggacgggagcatttgtgctcgatcggtttttcttcgtggcacatatgggcggtgcatctaatcggtaagatatgataaacttttttaatcgagtcggcatccgctgtatgctgcatgtcaagtataaaaaattaaaaatactaataaatatagggtgtatttagtttttttgggggtaaagtttttttttaaaatatactagtattaaacatagactaataacaaaacaaattacatattccgtccgtaaattacagattctgcccgtaaactgtgagatgaatttattaagcctaattaatatgtcattagcaaatgtttactgtagcatcacattgtcaatcatggcgtaattaggctcaaaacattcgtctcgcaatttacatgcaaactgtgcaattagtttttttccccacatttaatgcctcatgcatgtgtccaaacatttaatgtgatgttttcggccaaaaattttggatataaaaaaggccatagattaatagataataaatcatgaaaattcaaagttaactcttaccggttataacataaagtttatttctaaaaaaataatataactaattggttacatgtaataaatactaataggatgttccttgagctattagaatctctctccggtgagatatactccctccttctctaaatgtttgatgacattaacttttttaaatatgtttgaccgtttgtcttattcaaaaatttttgtgaaatatgtaaaaatatatgtatacataaaagtatatttaacaataaagtaaataatagaaaaagaattaataattacttaaattttttgaataagacgaacggtcaaatattttttaaaaagttaacagcgtcaaatattttggaattgagggagtatgttgtgcaactttttatcttgataggcatctctcgtcattcgagcctgcagccagggaggcgccatacatatcttcaatttggtctatgtgttcatcgggcatcttgtaatttggcgcatatactcaggccgacggcctttggttgaatgatgataaagcgaatcaaaagatcctatgcgcctgccatgttagatggtctgtgttttttccttcactagctatcatgccgtagctagcgcttatcctggcatatcacagccaaaaaattgatcatggtttactgaaagtccgcaactgatggaattttcatcttgcagtgattttatgagaacacacattgaaacatagatatggcatgggagatgttttttttcttttttggatatggattgtctgcagtcacatgtattattgaccgtcagtactgcaaataattctcgtcgattctttgcactttaaatcaatcaattcttgcatgacattcaaacaactatgaaatatttaaatttttttttgataagatcaatatatgatattcataaatatgtaagtttaaatataacttctacaaattacaatgaaagagaataaactaaactcttaaccattaagtgcattattcagccatactttctttttcaacttatataggttgaattaaatttatatgtttgtacagtgatatcgacgtaccacatattaatttatttaattatttttttattactatttagattacatgtagaacaccaggagacagctccttgaggagaaaatgacttttcccctggcatactgaagtagctagcagaacaaaactactccactatatttgtttcgtacatgtcgttcaaaaagttatcaaaaaaaattaaaaaaaaatcaagatagatcaatatatgatatatcttttcgtaaacaagtgagttaaaattcgacatatataattcaaaacaaaaataataaatttgaccatgaattacgtgttttgttcatagtcaaatttgttatttttatttctacttgcataatttgaatttaaatttgcatgtttgcgaagtgacgtatcacatattgatctatcatactaatttttttcaattttttatgactttttaagtgacatgtaaaaatgatcttagggatgaattgcgttttcccactatactctattttttaagagaaaaactcaatgacattccatggatttattaggcatcttgtaatttggtgtatatatactccggtcattgattgaacgataaagcagagatcctattcgcctgccatgttagatggcttctttttttccttgcctgccttggtacttatcctaacttgttagagcatgtataatagcagaatataagttagctataaatatattttaaaaaaattaaagaaaagataaaaaagcagtggactacaaatctgtagccagctgtaacacggactccaaaacataatgtgtgtatgacatgtgggatcagatattaatagtatagtaagcaactattgtatgaattgactattatattggttacagataatttaaaattagtagttgactacactattaaacttgctcttacagtgcaaaatgatcatctttttttttgagaggcaaaatgatcatctcgctgtgctttcactagtaacaaactgaaactgatggaagaattcccatcttgctgtgccttcatgagtacacactaaaacatacgtagtacatcgacacatagacatgagtgacatgctgaaggctgaagcagctagcagaataaaaaactccatgatatattgatattccattgctcataattcgtccacttttgggaaagcttggaataaccaacaccttgcctcaagttgatctcactgacctttcggctactactagaaaagatcaacgtacgcgatgcttgtgactgtgggtgagggcattcccaaccaagaaactaatatagattccataaacttaacagcataaaaaaaaaaactagtactatagacactattcttctaatacaaacactactattccatacttaaatttaatactacttatctcatataatgtcttagatgttgtatagaaactatgtctcatgcaagatattgtttccttctcttttcttatttatttacttaccacatcattttttatcttaggtggtagcttatttaatgctaaagacgcatcctagccctgatacggcgcctgcacccagacctgcacacgaccgtgacacactgacatgcaggtggttttgcgtttcagcgtggtgttgcgtactgtcgcctgatcgtccgtcgtgcggtcgtgccgttggtgttgacagttgagcgtgggatgtttctctcctttgaatattagcagccgcgtagcaagttatgacttactgtatatatgcatatcagagttggaatatatgaataccaataaatgaagaagattcttattttttttaagactgataactggggggcaaagtgcccacctttacatattacttggaaccaaatggcaggtttagccgcgtaagcacatgagccctgtagaataaagtgaaggaatacacgggagacttaaaaaaaattatgttattattttctcttcttttgggggtgggtgggtgggggggggattttatgttgctttttgttgttagctacaacctccgtcctaaagacgtcgttgattttttatcacatgtttgaccattcgtcttattcaaagaatttacgtaattataatttattttgttatgagttgttttataactcatagtattttatgtgtgatttatatcttatatatttgcataaaatttttgaataagacgaatggtcaaacatgtgagaaaaagtcaacagtgtcatctattaaaaaacggaggtagtagcaatttttagctatgagatatacagctaaaaatacttacattttggaacggagggagtatatcatcggtttgttggtagccataacgaaatttttaattttaattagagttgattttagaaagaagctgtgagttttgcatgctaacgctggtccaaatattctcgtgtacaatataataccacaataaaacggtaggtgcatatatgtcgagcatcaaaaaatcggccgggagtactacacgatttatttagacatcgtcgacacatcgtaagatcgtcgaaataattttgtctcactccctcaacagatcaacctcgtctcccgcacgcgcgttaacaaagactataataaggctgtgtttgagggagaggagattgagaagattgggaagatacggaaaacgagatgagccattagcgcatgattaattgagtattaactattttaaactttaaaaatagattaatatgattttttaaagtaacttttatatagaatttttttgcaaaatacgcaccgtttagtagtttgggaagcgtgcgcgcggaaaacgaaacaaacattcccccatttgttctccaaacgaacgcagcctaagtgacgcgcgatttatgccatcagaagcgcttgctcgggcgcgcaaccctcgatgcagccgagcgcccggccaccgacacggaagcagatctctcacgctattgcacaccatgacatactgttaggtggtcttcttttctcctgaagacttgaagataaaaattaagttttttacgtaaaatgagatggtattaggtggtcttcttttctcctgaagatttgaagataaaaattaagttttttacgtaaaatgagatggtattaatgtatgattgattgagttttaattattacaaacttaaaaaatagattaatatgatattttaaaacaactttcatatagaaagttttcccacgaaatataccatttagtagtttgaaaaatgtgtcacacaaattttaatcttcatcgttggagaaaagaacaggaccttaagctcataaataattctcgggtccacatgtcaaccaccacatcaaaattaaggaaattacacgatgaggatctcaatcccaccagcacgacttcctcctccgatccttgcacaactcgtactctcgtagcggcgtggctgctggtggagacggagagtacgtagtcctccttgcggcggctgacgtacgtcgtgctcctcctccccctcgccgatggtagtgttctcgatcgtatgcgcctcgtagcgcggtagcgctgcacccgttgcacactgctgctttcttcttgtcatggtggcggcgaccggcgatggtacgtgcctcaagacaacaaccaccccgagtgcctcgttgcggacggcgtgacgtgctgcatggcgccgccagcgctgtggcagagacgtggtggcggtggttcagatgagcgtgggccggcggcggcgaaatatcggcatgccctgcttactctgtttccttgtcttatctgtgtacgtgcaggtgtagattgtgtttgctactgtatggcgtggtaagtgctagcaatgagacgcaggcagtatatgcgaccgatccattgatctagtttacggcttgcatttagtatttgttttaagaaacacagtagatctacggcggcataatgttcttttctttttcaagattaccggcgcatgcataatgttctatgttctcccactctcaactcccaagccacggttgtggccttttgtcggctggtgggctggtttctattcttacctgctggcgcaggcacagcaagcgggcgaggacacacaggtggcagcccaatatcccagcccatatgggtgttaccactaggctcggcttgcaacatcggaactccctagtcccaacaaacgttggccgtagtttgatggctccattccagttcgtccgctataataagagagattttaaataaatataacatattctaatatgattaatagtattaagatgtgttatattttattaaaattttttatattttgagacagagcaagtattaaacttgaatacaaccgggaagccgtgttccgccgttccgcgcgacgcgcgcgcccacctcgcgtgtgtgtatactgtcgtgtcggcttgccgcgtggtcgcgccggccgccactcgagtctcgccagggcttgcgcgaccgtcgtgtcgtgacattgataaccggcgcacgaccgcctagtgcgcgcgcaaaaggaaatatggaatcctgcaactgcttgcatgcatttgtgggtttgtgctctggctagcgcgatctcgctaaaattgtgcgtgcgctagccactataaaaagcatttttgcagacgacaaaaagcaatttttacaggcggaggggaggaccgcctgcaaacagacaacggtgaaaatcatccatcttcacaagcaggcaaatggcccgcctgcgaaaatccaataaaaaaacaaaaaaaaatcgcctcgccgccgccgccgcaccgggagagggccgccgccgaaggggagccgcccacgtcgccgccgccgccgctgccctcccccggtctccctccccgccgtcgccgcaccgggtcgccgccgtgtccgcgcgcgccgctgccaccgcgttcacgcaccgccgccgctgccctctcccccggcctccctccggccagatctaggaggggaggccggggaaccacgtcgcggcagccgccgccgcgctcccctggcctccctccggccggatctgggaaggaggggagggagccgagccggccccgagcgtcgccaccgccaatccacgcctcgccgttgccgccattgacccgcatcttgccgctgccgccataggtcctcccccttacccctcggccagatatgggacgaaggggagggagtcgagccggccccgagtgtcgccgccgccgaccagcgcgacctgtgccttaccgttgccgccgccgaccccgcgcctcgccgttgccgccgccgacctcgctggtgccgccgccgaccctgcgcctcgccatcgcgcgcggatcctcacctcgctggagagaaaggtgagggagaggataagtgagggagataatgggacttagaaaaaatctactctagcctggtctatttatattgctccttattttcgcagtcggaccatataaggagcgcttgcgaaaataattttcgcaggcgccgcttaagtggtccaaatatcaccccaatttatatttttgtagacggtcatttggcaccaaaagtcatgtccgactacaaaaaataaaaccccaacgttggggaaaatgttttatctagtagagagcccgtccatccccccgtatgatctttaccacaacagagaacacgtacgcatgaatgaaaaggagtactgtaacaaacgtgcatatatagaagcacgtcgaagctcttatttattcatgtaccacggtctcatttattctcgtacgtacagaccatagataagatgctgcatgtgcgcgtagacacacgctcgtacgtgcgtcagagcgcgcacacacacaccatgtacacgaccgtgcacacacacacacacacactcacacatagtcatacagaaactgcagcctcgcgtacgtcgtccggtgcgaccgaacgtgctcagccgtagtactggccggtgcaggagtcgtactggcgcccgccgccgtggccgtggcggtgctcgtcaccgtggacgaggtgctcctcccggtggccgcccagatgggcatcaccgtggcggctgccgctgtagcccaggtggccgccgccgccgccgttgccgtggtggtgccccctgccggcgcgcgccatctcgtccacctcctcgtacgactccctcctgacggcgtagtgctcgccgccggcgtgcggcggcctgttcatctcctccgcgcagtggtccacctccgagtagtactgcgccatggtgcaaacaactagctgcaaattaattactacgagtgtttctgtgatgtgcaatgcagggttacaatgttgggtttgttaatgtttggttctgctatttatagtgtgcctgcaacaccagcagcccccaaaggtgtgcgtgcgtgtgtgcaagggaatttgttctgagatagatgcctttgtgcattgctgtctgccgagacgtgccagatggccgtttcgacgggaaggtaggagagaaatctagacacatttctacctatcaatatgcccgcgaatttctgactgagctgaaagtttcaggcaagctagggcctagggaaggcagacagttacacagatcatatggattgaagcaaagaagaatgtagatggaataaaagaagagcttggatgcttggtaaatggagtatatatatcctgcaaactagaagagatgagaataacaaagaattaatgtaatgttttgttggaaaaagaagcatgcgtatattgtgaacgtttagcctcagttcgaaggagttgtggggcttgcttaattattagcggtatgcaaaacgagataaatcattagcgtatgattagtcaagtattaattatataaactttaaaatgaatttatttgatttttttaaagagacttctgtatagaaaacgtttacaataaatacaccatttcgagttgttctttagaattcggcctttagcatgaatgggcataccggcatactgtatgaaggaaaccattgtctgatttatgcatggttttatcggagaaagtaaatttcagtccctttccagaatttgatgagtatgttactctgtactgaactttgtttcaattaatatccgggtgaaatcttcttatgtttgcaatgctagaaaatcttataatatgaaacggagggagtactttgatttgggttgtgatggcatggatgtgacaaatacagtatattaagatttacatatttatatatgcggagcaatcctataagtatatgaccatatcatatgtaagaagtattaaaataaaaacttgcaaaagaacaaacgataatcctgtacatgcggaagaatatttggaatctgtaaactaatatgaacaaatagtgcaaaattgcattatatatccattttcacaagaagctcgttttcattctacacctaccaaactgacatcctttagtatggtttatgaaacctcaccaaaaaaaaggtacagtttataaaagaaccaattgataggaacaatttgtgtttgagctgttctgctactcacactgtttttttcttgtgaatgtatgtcctttcattattgttcttgtcctgcttggtagttgtcatcaatgaattgcactgcctgaacaaaaggcagaaagatggcatcctgatatattgtggattacagatgggatcgataacagagatgtacagagatgtgcaatctgcaatgtttccaccattttgaagttcttcctgatcgagcacaacttaacaacgagtaaagatagatggaccccgtgcatatataataggtgttagaaagggggtggccgggtggggaactatatacatgggctgcaggaagaaaatgtgttaaatcaatctacagtctcattaggagattggaaaagaattgaaggtaaagactacaagagtgtcctgaaatgacgagagcccgcgattgagtgcatcatgcatcgattggatcaaacagggatcatgattcatgagcatgagaggcaggaggagcacgaggatttggcgagttcgctgccaacgcacaaccatgtttagatggtgcttgttcgtaaggcgttttactaccagtttaaatcatgctgaattttcctttttgccttctgttcttctgttcttctgtaattggctttaaattttgttatcagctacacgatgttaattatcagtccttatcttttcctaaaaatttactagctagaattctgataagaaagatggttcaatacaaggaccattgtatattccatctgtcttgaaatacttttctgtggatgttattcacctcttaacttggttgtttttttatttgaagaaaatgtttaattacttagaagtatatttcctaacaaaatatattacattctaatataatcataaaatgttattatattttcctataaacttgatcaaacttaaagaaatttaacttgtaaaaagtcaaaatgacttataatatgaaatggaggtagtagtcaataggcatcattatttggaacgtgagagagtatgtaaagaataatttttaaagataataccattttaatagaaaattgtaaaatagaagttggttggctgaaagtttgtaaaaacagtattactttaacaaaattcagtatgtaaaaaagtaattacttacaaatgacaacgccgtaatagtatagtaggagtaaaatttagcatatatgttaaaattaaggaccttctaatttagcgtgttacaattaggcaccgttattggctctcataccctagcttccatacgattggcgaagagccatatatagttgcaatgagatcatcacgatcattcacgatatataactaacctgatggttcttccttgtaagttaccggcaggcagcgacgatcgatatagctaaacctttttctgggcgtctggctgcttcttgcttaattaatgttgcatacgaactgaaactttatactccagactaatcactatcacactatcagagagattcagaacagtaatcgaccggtgataattaggacaagctttattatattcaggtcacgaatttatttttcatacaccccccctctccgttcgtagtgatcgcacagagaagaaggtgctaattagctaagctccgtgtacgcacgtacacacgcacgcacgatatacacgtagagctaagccaccacatgaccaccacgactacgtacgggcacacatatacgtacgtacgtacacgggtacacacagcaggttcgatcagtcggacttgagcaggaagctctgcttgcgctcgcggaactcgccggtgcaggtgttgaagtcctcctccaccttggtctcgcgcaccatcaggtagtcgttgccgtggttgtggttgtggtggtggcggccggagccggacctgtcgatctcctggaacgtctccttgacgacgtgctgctgctgcacgccgccgcggccgaggaagccgccggtgggggtcaccgacctcacctcctccgagcagtagtccacctcctggtagtgagccattgttttttagttggggagtgaggtgaggtggtgttgtgatgagcgagaaatggttaattagggtttcggtggtgtacgggatggtagggttagtgtagggggcggttttatagtgtggaggtgtggttagggaatctggttcgtgagagaggtgcatgtgtgcacactgcacaggctcacacaggctttgtgcttttcgggctttcagcttcgctttttggtgttcatctggaagtatttggaatattattgatttatcggccaggatgatacctctgcggcggctgggtgaactgtaattggacaagagagagataagatggactaaatagtattaatctgccgttaatgaggatgtttttcatgaggaatggtgggtgattttgagttttaaccagccaatcatggatctgtgcaagcaagtgttctgtacttctgtcgtgtacatatgttcagatttcagagtatcaactcacgagaaggcgcgcctgaagattcgtgctaaaatagaggaaatggagaaagccaatcttgaacatggtacatggaccatgcaggcagaggtaatatataatatgtttattcattcattagtttctaaaacaaaacatacttttattagggttttttttgggaagtatattagttaggtttgataataaaggtacaatggatgaattgttagagaacaataaaatattccatcgaaaccaattggtccaattaatcataatacaacgggcatctctgtttggttctcaaaatagctgaaatagaaccctggtgtttaattaacccttttgttactagctaaaaaactattgtcatgtaagcattttccatttcatgtggcttagctaagctgccttttaacctgatgcaaaattgcatttccatgttaccgctggtaaatgaacttatcgagatttgcaggtcacattcgaaataagtcaccggtcgggtaagaagaatatactcatcctttgtactacctttgtgttagtgggaatatatacttgcgttccgccctgcaccgcattattactgcacttgggatggtgacctcaagatgctcgcaggtgtgatgggagaaaagaggaaccaaagtttggaaatggtgaacacatccagacgtgtatgtgatcagttatgcgatgcatcgcccatttcagattccttccagcatccataaaaaaggaagaagaaatcattcacagcagtcattttctgaccagccgccgttggttttaaaccaagcggttattcaagaatgtggtacaggaggattccggaaacactatctggcaattggcatgatcatgagtcacaggattacaaacaaaatcataacgacagattaccaattgacttaagtatcgacgatcaatatcttttaaccgcgtactgaagaacaagttgacagatagatgcacaaaacctgctgattctaaccaacatggctctcatgccgaagaaaatcactcatttatactactcaattcgcacagatcaaaattttggttttgaatgtgacattgctgtgtgaaacgccatctgtgggttcactaatgcctcttcctcttgcctttatggtgttttctccgacctccgctcttgaaatggggttcggttgaaccgacatcattatccttgtctccatcgacgaacatgttaattccaagatcgaatccatctgttaggccccgtagcctgttttgtttttcaaaataagatcagttacatacacaggttgggtatattggaaatcccaacggacaacctcagctttaagctatacttgcacataattttacgtattttataatggatagtagcagaagatcagctccacatacccgtgaagctcttttctcatccacttctccgtctgcttatcacgttttgtcagcggagctcgagtgaacagctcctcttcttgtttctcttgcaactctctctgccgcatataccttgtaaattccctgctttcatcacctgctgtttcctttaactgcaaaataatacagatgattattcaggtggacatagaacactaatcatataactatacatctaatcaaattgctagtgcatcaaatgaaataactggcaaacctcttcaggtctatcagcagcgtcatcaataatctctttgaagtaagagctttctgtagccattcgcgctaatgttttgtctttccttgaagcttgtttatggcgcttatcctcatcatccatggtagcagcaataaattttggtggacgatagatgccatcgttgtcctgaagtcagggatgtacatcagcaaaaataattgtatgaacatgtcaaactaactaaaaaatgatcaataatgctctaacaaacagataaacagttcagtgtcaacggatatagtgcactcatatattctcaagtaattccaaatatgaaagaaataagaaaatatttaactgcgattagtatgtccatagaagcaagcattagaattaagccaacgctgatataaaaaacaagataaataaatcaccattttataaattaagtcaagaaatactacatcataagtatccatatatcataattctaccaaggtgtggactaatagtagttaattttaattccagacgaggactatactacaaaaacacacgaaagaagcatggccaggcttagcctagctgacaattacttaagaactattggttcatcgttgggctaaagtaccagctagatgtcaagtttgatttaatgatatccaaaaaaagaaaaaaaaatcaacgaatacaatttctacaatttcgagaaggtaggtaatttcaggtgcacacaagaacaaatctgaccacttagcaagtgaaaattaaaaaataaacagtgaaattgtttgtggagtggaaggggagatgaacaacctgccccgcaggatcgatcttagagtccatcatatcagggttcggccgatacttcagtaggtcttcatcatccttaggctgatccttactctttgcttctgcatttagcaccttctcctgggcagctccgctatccgcggcgttggtgagcttctggatttggtactccatcttcttgtctatgggacgaatctaaaatccatccaattcaacacagcaccctccaatgttagccaacaaaaattgagccatgaaacttaaaaatcagtacaggagggctctggcacaccttctccaagaacagcctgatctcgacaaggctccgcacgacggggtgaccttccaccgagagccccttcgccttgcggaggagatagtagacgatgtcctggcagtagctcagcagcaggtggtgctttgcctccaggtacccaatcccatccgccgtcggcagctggttcttcttgacctacccacacatcaaacgcggaatgaagctcgctgtcatcttgccaagaagcgggagagatggggcaactcacgaggaggaggggaaagtgggagtaccttgcgggtgagcgccttgaccttgccggtgacgaggtcgagcccttctttcatctccttcaacgcggcgagcagcttcggcgcgtcatctccgcggaagaccgaaccccggccaccagcgccgtcgccggcgacgccggcaggactggcagtgccgccactgtccatcgggctcctgcaaccgccggacgccttcgccccgcgcggagtaggatggttaaggttggctccaccacgaaggggagagggtcgggttggcggagcgaccggcggccggagagcggagaggaggcggcggtgaggtcgtgtggacgacggcggcggcggcgggtgaggatgctcgcgcgcgctggacctgttaagaggctagggctttgccgttttgttgctattgggccacctaggcttcctgggctactttgtttagagctaccgaatgggcctgtaagcccagtaacccctcgatcatcctaggattgaaaaaaaaaatgtaagcgtaaatagtagaatttaaaaagcagaaatgatcgtttcaatagatcacatgaaaaatatataaattggataaaataatagatttaaaaaattcaaaagagtttagttgtcgctaaatttcctctaaaattgatgtttatttgtcagaaatttcatagggtttaaaagtttcagtccttcatttcaaagaatcgaataggacaaattttttataggatttaaatattaaagaagtcctccctgaattctttgaacgagcactcttactctgcagttctcttttactatagcagcagtttttcaaaaagaaaaaatcgtatattcatgtgttatgtttcgtctcgacatatccggttcagtttcctttagaaacatcaatccgtccactctaacacggtctccgagttactactttaaccaacaatatatatataaaagtaatatattttaaacaaaaaatagtataatagtttgtttaataacaaatccagtgatatcaattttacatgattaattttttttgtttttttcagttaaaaatgtttgatttgacactatactgaaaatgcttatattttaaaacagagaatgcttatattttgaaacagagaatgcatatattttgaaacgttgaaacggagaatgcatatattttgaaacggagagagtacgtttttaaaattgctatcgtacttttatcgttcaaagttaaccaaggacgttaataacttccaaattgtcaagcaaagagagaaaatggtatacatcttccccgctcctttttccacatgcaccactaacgttcacatctctcaaagttatatatcagtgtaaaggttgttgcatgaagcactaccgttgaatagcaccatagatcaactgaaacagcctccctatcattcgcaactcaagttgctccaaaaaatgaatagcaatagcacaaataataccggatactaaaaagataacaaatggagcaaactgttctttcaagtaacccaacaatagtaaacaataacccggatactaaaaagataacaaatggagcaaactgttctttcaagtaacccaacaatagtaaacaataaccagtaccgcacgaggacgttgcctcaatagtcaaaataacactggacaaaccattctccaagtcgaagctaaacttggaacacatatcctacgctgttggataagtatatttggccattcgtgtgacatgttccacctccaatcaatgaaaattgacttatgtcaatcaagcagtcgagggaatctcaaaggaaatttaccaaagaatgcatttaatacctatcggtatacagtaaaagttttaatctttttgccgccctcagtatggccttcttcctcttatgggaatgctatttgagccagatctgttaccaaacccaccacgcccccttgaccggaaattgcctcctaaacacagatacaaatcgattagaaaataaggaaataacataatactatccaaaagaaaaactgaaatagagaggcacctacctcccatagaactggcagatttagccatagattctagcgctggattcacaacctggccagcttccctcaagatcttaacaagattcctggagaattttgcattggagagtgtgaaaaaggtgaatgcagttccactagcaccagcgcggccagttcgacctattctgtgaatataatcttcaagagttgttggaaaatcaaaatttatcacacacttaatatccttgacatctgcaaaaataacaagaaaatgatgagtatgtaatcaagataatacttttgccctgaagaccacagcagaccaaactgggatatcaacattgtcgatctccatagaagtcagcgcatggcttgaaccagagccgaagaacaaaaactgcccatggatgcactttcaagttctacaactaatacaagtcgaaggggctgaaaaactgaactgggcatcaataactgttggatgtggatatgatggtgattgatctgtcagccttaactcacaatactgaaagttatccaataacataccagtatccataactatccaaatgaacccaatgaaaatctgtaaccaattccaacacaggctgcaatgcttaaggtgctgcatcagaggtcaatatgaggatcacacttcacactgtcaagaacaatacagtagtaggcaatagctctacaaacatcttgggaccagttggcagtgataagaccagggcacacgtttaaaatagcagcatataaacttctaaaaattcatggaaaacaagggaaagcataacagcgagatccacacttctaaattacttcatttgtaaatttagttgaatttacactagtgacttagacaaataataattagtagacattttcatgtatgcatgcatgcgagctgaaattgttgttaagccacacatagatctacgagatcacaagtccacagcaaaaagggaactaagtaacacatgaataataaataactaaagatgcaaaagaaagtaattccttgaggagagaatagattcatataaccatatgaattttagcgcaggaaaattaacaggcctgaaagcgaaagcacctagagctctaaattttcaaacataaaaatacaaaacaaatttagaggtcaacagatgaaaaaaaaaatagtgctaatgataatggccatagactctcatcgattctatatttctacctgaagataagttcccctaagagtgaaagaccaaaagccaagtaattttcaaataattcctaaccaagactaaatgtcaacattaggttgaagtgccctggtaacactgccatcgcttactctcgagggaaataaacaggagaaaagacgatctacctctgacatgatggcaccttgcatacaccatcaatccacaagttcagttcactcaaccaaaaacagctgacagccctccgacttatcatccttgagcacttggaactacaacctaattctaattttcaaacaagtcaccataccaagaccacgtgccgctacatctgtggcagccattataggacttttcccactcttgaactctgccagaacatagtccctttctgcttgagctttgtcaccatgaatagataatgctggccatccatccattctaagttgacgagtgaccttgtcacagtcctttttagtttggaaaaatatcaagattctgcttccatccattagatcagataaaagtttactgagtctgtaagaaacaagttaacattaacttaactcatggaaatttttagttggaggaacagctcatggtacaactttgtaaataatagtgttattagtagatacctgggatacttttcgtgttcagatatgacctcaataatttgctgtatggaatgattagctttcagatcaggtgatcctatgattacctgagttacgacatgtgcaaaatgttagtaccaagaaagaaaataatagaacacaaaaatacttttcaaaagatggcatggcgatggcacaagttattcgcaccttgtatgggttctgcagaaattgtctagccaaggattctacttctcttggccaagtggcactccaatacaaggtttgcctgtctggccggatctattaacaacaaaaacgtttagcacaatagaaaaaatggagagttagccaaaacaccagaactgatataagcattctaaaacaagccatgcctgtgccactattttacgaatctggggctcagaannnnnnnnnnnnnnnnnnnnnnnnnnnnnnnnnnnnnnntatgttactcttcgcaggttagtgtgaccaccttccagcatatcgatcaaccgaccaggtgttgcaatgacaatctcaacccctggaagtagacgcaagagacttagcctacaaaaccttatgtccaaaattattttcggtaagatgggacaaatacctctcctaaggtcacgtatttgtggtcccttaggtgctccaccatagatacaagtgcttctagttcttgagtatgatccaaatttgccagattcttgttgtatttgaacagccagttctcttgtaggagcaaggatcagaacaattgggccatcaccttgttctgcacccgttacaatgcattcattcaattgacaatttaaaatagagagcacgtacatcaattccgtaacagaaacaaacctagtcgaggctgtgcaccaacatgaaccaacccagggagaaggtaagatagtgttttcccagagccagtttgtgcgataccgatcatgtccctgcccttcaaagccattggccaaccttgtgactgaataggcgtgggctctacgaatccactcttggctattgcttgcatacagtaatctgttaaaaaatgaaaaaaaaatagaacgattatttcatccaagacatgttgccgtattatccagagatacagattgctataacagttaacagaaccccgatttgaaatagcaaacctgggaagttggcctcctggaagtagcgaaccggcttgggcacgtcgtggccttcaacagtgatatcacgctggcgacgatactgcgacacatccatgtctgacatggcctgcacggcggggcactccacatagaagttcttctcgaagggtataaggctccggaagtcaggcttcggcaaggagagcgagtccagcgcgtcccttccacctcctctcccaccgccgcctcggtatccgccagcgccaccaccaccaccaccacctctaccccacccaccgccgcccgcgcctccaccacggcctctcccgccgaagcgcgagaagtcgccaccagcgggggccacgggagcagccggcgcgggcgcgtacgcggcggcgtaggggttggcggccgcgggggccgacgcggcgagcacgggagccccggcaaggtcgctgcacggaacaaccaaaccaatcgattcagtcccatctcaacgcagatccacatcgagccgtgagctaagctagggttagggttagggttagcgtacctgcgcctgtcgcggtaggaggaagggtcggcgtagcggaggtcgtagggattcatgtcgccggtacggtacgtctcggtgcgtgcgcgcgcgcgcgagggttcgccggagtccggtggcgccgccgccgtgggggtcgaggaggaggaggggaaggggagacgacgagggaggtttggatctgggaggaaggcggcgtgcggcggggtgaggaggcccgtggtttggttttgatgggtaaggatgcgaagcgtgtggggccgggctaggtcggttgctatggcccacgtgtcatggtccttgggggagggggggggagacgcgacgcggctcgtacgcatgagaagtccctcacgcaactttccccgcgtgtgattgggccatgtcgtaaactcgtaatgggccgcatctccctttcactgtaggaataagttcactttgcgaccctcaaaaggtatcgaaatcttatccgtggccctaaaccacaaaaccaaatatcttaacccccaaactcttaaaaccgattcaatttgactccctgggcggttttggagagcggtttcgctgacgtggcgcctacgtggcgatattgaccgagtcttcgttgtacgtggctttgacgtggcacttacgtggcagttgaattaaaaaatatgagtgggacccattagtcattcacacaaaaagaatgtgggcccactgacatgtggggcccacatgtcagtcctccttcctcctccctctctcccttctctctctccccccttcttccccttcggccaacgggcgggagggcagcgagagcgagcggcggcgggcggcgaggccggagctgcggcggcaggcgagggctccaaggtagagagagaaaatccaaggggagctcgagcaatccgccatccgtgtcgtcggcggcgaggtcgtcgtctccggcaaggggggagccaggtcgaggcgaggcgggggagcccggaatccgcagatgcatgaggtacaaagcttataaggcattactaatcgtacaaacggcggtgccggctacttctttgcaccgccggccttactcctgttgtccgtggaggtaccgccgccgccgcccgcggcctgcgccgccttcttggcggccttctcctcaagtgccttcttatccctgcgtcaaatccaaactcgaagatctaagaacccgcagattggaaccccgcgtcaggccggggacaagggagatcgaatcgggagacaccgagcaaacagacctctcgcggcgctgctccgaggtgagcccgtcctgggggtccttggcgttgggcttccgcgcctgcgcgcgctcgcggtcgcggttcctctggttgccgcgtgcacacacgccgccggcgagaattcaaggaataaacagagggagaagaacggatcgccactagcaagaacaaaaacgagatcacgacaa

SEQ ID NO: 36640 - DNA, 7165 bp, Oryza sativa
gctctcgctgccctcctgcccggccgaaggggagagagagaagggagagaaggaggaggtagaaggaaggaggggccccacatgtcagtgggcccacattttttttgaatgactaatgggtcctactcatattttttaattcgactgccacgtaagtgccacgtcaacgccacgtactaacgaagactcggtcaatatcgccacgtaggcgccacgtcagtgtgaaactgccctctaaaaccaccgagagagtcaaattgcaccggtttcaagagtttggggtcaagatatccggttttgtggtttagggtcacggattaaatttcgatcacttttgagggttacgaagtgaacttattcctttcactgtacgcggccattgcttgggctctggatggcctggtagtcctcgagctacaaatactcggcatagtggcccaggagaatagtagacaagtttgaggtctcatcggaggcatttcacaagaatctcgaaggaaatatatagtttttctttgtataagatttctgcgtttcaaatgataaaaagctttcggatgaccttgaaattttttaataggttgttttatgtttaccgcaattgaaaataggggacaataaaggctaagagaattgaactttcacgctggctttggtccaacgtgagacatatgcgctaaactcgagtctcgaacatcacgcacacgaaagatgggattggcagcgctagtgaagttagcagaggaggctgtagccaacatacattttggatgagtaaatggcttcatatctgcatgctaagttgttgccccaacctccaataaccgttggcatgttactaggagatatgtgatggtatttttatttgaattgaagcagcgggtgctaggaacaaagatgtctagtatatagcacagatgcataaagtacacatcctcacttcctttgtgggtgtctgacctttagtttcatgatgcagctcgctagcagaagaaaccagtgtcgtttggatgtgtccgaatgccgagaagtggatggcaccctgcacggtggcaccacatcggtgaggggttaaataccagtctacaactcacgccaaaggcaccatctgtttcggcattgtcaacgtgaaccttaaatgcactctacgagatcatgttcactcttttgctccgagcatgattttgagctaggctggtagccaaaagcccatatcgctataccctggtccaagctgcaaacaagtgtaatcttatatgctgttaagtgaaaaacctagtagaaacatggtccatcacgtaacatgagtaataaaaactagctatagtgtaattcgctcgtataaataaaatgaaagatcaggaaaaacaaattgaaaatcatgcaaatggcagagactaacggacccttcgtttcgtttattcgcggaataagccaaacgatatatttacaaacgaatagtaatttgtgaataaaaattttatatacgtgttcttagtgatataaaagtaaatactaaaaagtaaactttaataaaataacctcaaaatttaatattgaaaattcaaattttgactaataaatataagcataagtgaaaagattggcccaaacaggagagcaagtttaatagtatagctaactgttggctccaaattatctatagctaatataatagcccatttatataatagttaactataaaaatatactacatcattaatactagcccatttatataatagttaactataaaaatatactacatcattaatacccggtcccacctctcatacacacgtaacgtcttggaatccgtgttgtagccggctacaaatctgtagtccgctttcttctctctcttctctcttcttctcgatatatgattatagctggtttataactctattgtacctgctctcaaagctaaaccagagcaccaatctcaaagcattctcctcctccccggaggccggagtccagacgtcgaggcggctgctgaccggggggcgagcgaaaatatttctagtcgtctccctccctcaacctctcatcagatctggccactcccacgcacccagtctcctaaaccctacacaccctccccccctctcctctcgccggccgcgccacccgccgccgccgcggccatggccgccgccgggggtctcccagcctcggccaccctcctcctcctcgtcatcgccgccgtggccgtcgctcccctcgcctccgccgtccgcccggtttccgacgcccacagatccgctgccgccgagctcttcgccgcttcccccgacggatccttcggcgagtaagtcgacagtgtcccgatctcgagtgcttgtcccacgccgggcgcagttgcgcgcgcgccaccgagctcagctccagatcgatccgaggcggggctccctgcttgagaattatggatgcttacttgcgttttggtctgttcattcgcgcagtttggagacgacgtatgaggcggtcaggacgttccagatactcggggtggagaaggacaagggcttgattggtaaggcgtgcaagttcgccgccgagaagctggcctcctcgtcatcgtcgcccgcgaaggatctgttccacgcggcccggatcagcggcgtcctcaagtgcagtgttgattccggagtttacgatgtgggtcttagcttagcttaacagatcttgttgatgccaatggggttttcttgtttgatggcatggtgacacttgtgttattggtgttaggatgtcgctacgaggcttaaggctgtgatcaaggacactaactcgctgctggaactctactattctgtgggagggttgctcagcatcaaggttactccgctgaattcactactagtttatacttgtttgtttgatttgctcatctccacttgttgatagttggttgatcttttctgtccattaatgaatttgcattgtttgcttcaggaacaaggccacaatgttgttttacctgatgcagataacacatttcacgcaattaaggtgacaacagttcattatagctttgcgtttttttctcttgtttacattctgcaatttacatcagaattttattttaaaattagagttgctgagatgtgtctttgttcgtttaggcacttagccaaagtgacggaagatggcgttatgacactaacagcgctgaatcgagcacgtttgctgctggtaacagttattattaaattgtaacacttaaaatatttctggcacctgtaaacataaatttaatgttgatctgaccttgtattagagggtgtgcttattgctgttcactgtttaatttcttgagactcatttaagttattatagggttgaatagtggattagtaatcagtgcctctatctctgtgaagctttctataccaccattcaccacttaatgggaagatctttactgcaattgggttgcatattttttgttactgatatttaacataatgtatttctacaggtatcgcactagaagcattgtctgcagttatttcactggcagattcggaagttgactcatccatggtgtgtgcatcctctctacttgagtatctagtatatatacttgatttgcaatagctatatgatttttcttcctttgacctaaataataaagtaccagtaatttcatatggtgtaaattatgttataaaaccatgaatagggaagtggctttgaatggatggagaacatatatagcactcatcttatagattatattacctctgtaactgataaagaagtatcgatgaccatagatagctaaatatcataatacaagttcattaaagtttgaagtgcttaatttcacaagaaaacaacaatctggtaatgttgtatctccccaactatcctcctttaggtgcgacaatctttcatctgaaaccttgaacatatatcaaccttgtctgtgattttaaaagagattcaaccatgccactatggcattctatgtaccatgactttcatagtttattttagtgattatgtgttatcttttgtgtagcactgcttcatacaatttgttggtgctcttcattcgtatgtgtcattgcctgttagcatggtgttgcaaatttgtactgattcctgtttcttctattaaaatatcatgacaacagatagctgtggtgaaaaatgacattgtgaagctatttgacacgatcaagagctatggtatgttctataaccttttgtttgtgctgcaaagttaccctgatggtatcagcttccaaattacaaaacctatgagatttagataagtgacagtagccagtacaatttatttttcatattttgattttatgcgtagtaagtgaggaaatttaccttgcctactttgaaagattagtaggaatcatcccacctacaaatacaaaatataatgaatgaatactttctaatggtatatttgcagatgatgggacattttactttgacgagaagcatgttgatgctgccgaatacaagggccctataacaacatctgcttcagtagtaaggggtgtcacctcttttgcagctgttgcttctgggaaattgaatgtgagctttcttgcatcaatcttgtaataatcattcaataaatttatgtgtaaaagcttttgttaagtagctgcacttaatctacagatccctggtgagaaaatactgggtttggcgaagttttttcttggtatagggctaccaggtagcgcaaaggattgctttaaccagattgagtcattatcattcttggaaaacaataggcaagtcattatttatttgttttcttcaattggcatgcatcttttattcttttttgtaatatattgagtgacacctctttctgcccttttcttaatatattttcaaaaatgtaaatgtttcttagtgcactgttagccttttgtgcttatttcttatctacaatttgcagggtatttgttcctctggtcctttcacttccttccaaagtattttcgctgacctccaaagaccagcttaaggtgattagtacttgctaatatattggattttgccagatgtataaaatttttactaggattgagtgtgaatctctgtatgaatgagcattcgattgatatgtgctgtgatgaattgacatttatatgaacactgcaaaagtgactgttatgatgggagaaatcccatattattcaacttgcaagcactgcatttaattgtaaaattttaattcctaactcatatcatattttaagtttgaaccagcaaagctgttatagtaactcacatgccattttcagttgtccttctagattatattctacacctagatttttcttattactcgattatgtctacagttagtataaagtataccttatctacaatagtttctcatcgatttcctttttttgtaatgttttagtccatataagttaactccagtttgtaaatacttggcattttcaggttgaagtcaccacagtatttggatctgctgcacctcctctcagagtgaatcttgtacaagtgctgggctctgactctaaggtcatcactactgaaaccaaggtagaatcaagattagtggctacctcttggaacttcctctatgcctgtctttttcccagctgccatcctctaaaacccttttacttctgatatcaggaacttcagtttgaccttgataacaatgttcattacctggatattgctccattgaaaatagatgttgggaagtactcgcttgtttttgaggtatgtgtaaagtgtattagtttgtttgtgttatgataatagtaattgacaagccttttttttttctcgccagatttctcttcaggaacaagaacatgaaactatttatgctactggagggacaaatactgaggcgatctttgtcacaggattgatcaaagttgataaggcagaaatcggaatttctgataatgatgctgggactgtggagtctgttcaaaagtaaattgtttaacgatgtgattcccttccatttttttttaaaaaaaaagaaagagagaaaaaaagttagagctacattaaaaaaagacaagctgccaaccttgtactgaagaaatttcatctgctttcttaagtatatagccactgaaagagttccattctcatctggaatagcagacaagtgctacaaaattacttagtttttatttttcatttccctgatatatgtctggagattttcctgctatttttaacttgtttacttttgttgttttgtgattgtgaatctatttaatattctgatttagttaatataaaattgcatgaaaattgtgaagcgggaaagcctgctttatatgtctcatatttcaagcttcttcatttcaggatagatctgcagaaagatactagtgtttctctttctgcaaaccatctgcagaagttgcggttatcttttcaactgagtacaccactcgggaagacatttaaacctcaccaggttgctctagaatttaaccctttttttcccagtggaacactatggttctttccctgacttcattgagcaaatcaattttcaggtgttcctcaagttaaagcatgatgaaagcaaggttgagcatttatttgttgtaccaggctctgcaaggcagtttaaaattgttctagttgagtaccccatcccccagttagttacactcatctttttcagcttgttctatgttttcgagtgctacgtcatcatcagtttcctgtccatgcattacattatccagagactagttatatacagagcagtttctcaatgtggaaaggaatagctaggctatgtagcttggtttgctttagaacacatggccaccagcaccatttgaatttgatgtcagccatatttatatgaacactgttggtgaaagttgagatttgaagaaaaagactaccatgtgcatagcatatacattgaaataaggcaaaatttgctataggacacccgaaaatcgtgtaattggctgtgagacaccgcaaaatcttggctttgcccacggacactacgaaatttgtgaaattggctgtgagacaccgaaggcaatattttataatttttgaggcaaaagaggtcagatatttttttaaaagaccaatctacccctgccgcccacttgtccacttccctccccaaccccatttccca

SEQ ID NO: 36641 - DNA, 19053 bp, Oryza sativa
aagggcacgttctctgcacagtcgtcagttaatcgactaattaagttgtcctttggtgacaaatatttcctggtgccatagaccaattagcatctgagtggattataacagtaggggcatcgtcaccgtgcaggatcaaggaggaagaagcagccaaaggcagtaatggagcgcaggcggagaagacgagcgagagattttctctgtatggaacgcgctaggcacggccctattcgcgtctgtgcgcggcgaggcgcggtgcgcacatgccatgccggcatgccaattgcgcaggggtagattggtcttttagaaaattatctgacctcttttatctcggaaattataaaatattgcctccagtgtctcacagccaatttcacaactttcatagtgtccgtgggcaaagcccagattttgcggtgtctcacagccaattacacgattttcgagtgtcctgtagcaaattttgccttgaaataaacaactgatttatttatatatgtttcaacataatatagcggggatggatcttcctgtatttttcttggattcagcctgtatttgctactatacaaagacattctcatgttaccacagattataatatcatgggatttgtcagtaacaagtgttcctacgtgtctgttcaatttgtcataggactttcttggtttggtggagaaattctactacctttctggaagatatgacctggagcttgcagttggtgatgctgcaatggtatgtaaccatgttactggactctcattcccgttttgttgcccttgctgatttctttttgttctcaggagaattcatttctacgagcccttggccatattgaattggacctgcctgaggccccagaaaaagccccaaagcctccggcccaggctgttgatccattctcaaaatttggtccgaagaaggaaatatcgcacatattccgttcaccagagaagaggccacccaaggaactctcatttgcgtttacgggcctcacgcttctgcctattgttgggttcttgattggggtgggtcaacaactcctatgtgtgtttcttcatttctcctttgcagttttttttgtttagtctaacgtgtcactcttatgttgtctatgcttgtggcattcgtttgcagcttatgcgtctcggggtaaacttgaagaacttcccgtccttgccagcacccgcagcatttgcctcacttttccatgctggaattggagcagtgctgctgctctacgttctcttctggattaaggttagtaccgttcattgttggtaaagcataattgcattaacaaaggtttctgctggcgctgacattcattcttgttgtaatagctggatcttttcacaaccctgaagtacctcagcttccttggtgtcttccttgtgtttgtgggccatagggctctatcttacctttcctccacgtcagcgaaacagaagactgcttgagaggacgatccaaagaggagtattccgaatcacaaaattttcaagcgtcacaagttgcttaggttccttattttagcaccttcgctttgatattctgaccatttttcttgagcaacttcgagttacgagggacgagtcgatttcagttttgtgggggttaagaatactggagctagaatgtaggacctcaccttcttgtatgatgatgccctgatgtgttctcaatagacgtatgtttgatgatagaattaataatatcttattctgcaaatgcatagtatgccttttgcaaaaattgagttccatatgcagaatatgaacactcttaatcccgaggcccatatgatatcacgaacggtgacttcagaatttagatatgattaaactttgcacgggggcattcgcgtgctccatttcatcagaccatatggttctggaaacacaccttcgctgcaacctgcaacttcgaaaaataatgtctgtttatcgtgacacggtcacacaggtatacaaattgtaagtatacaatttgagaaataagtatacagtgtaatgctctatgcaaattgtcaaaactggagtaaactttccctgcagagtatataagttatgatttccgatggtcttgactctgatcagaatgcctatacatttgtattacaggttgcgcctgatgacatgtataactatttgacttctgtaaagaatcatttgcagttacaggttcccggatcctccatactaccgacccgttttatggtgggaaacaacttcttagtttgattagttatcatcatttgtaaactatccagtttcacctgtttggccaccacggtcagggtcactcgtaaagaatacaccaattactaagaactctccttgcctgccgttccacttgaaaaaaaatggtgtggagtagaccaatctctgtgaattcaggactaatcgagggcgtcgttttgtcgcctagctaatctggaatacaaaccatcgtgcttattaataagctcgctgtggtttccatcctgcataccacacaaaagaactttaagaaatctgaatgacatcatatcatgtgtatagtaggatcagattagttctggtttgcgttttcagtgaagcaacagcggccgaaaacatacctccacaatattaccattttccatcacgataattctatcagccgcttgaattgtagatagtctacaagagaaatgattgtgtcaactaaaatcttaaaattcaaaataaacaactgcagtatgagcatacattacctgtgagctatgatgatcacggttcttctagccttaggatcagtactaaactttgtgattacattctagcaaagcaggagggagcgaatcagcaagccgcccataggcacattgtatttatatctaggtacataattggtcaaatatcttgatgaagaggttaccttcacataatgttcactctcagcatcaagtgcactagtggcttcatctaataccaagatggatgggtccctaagaagggccctcgcaatagcaacgcgttgcttttggcctccactaagaagagcatcatcgacaatggtgttataaccatcagggagagacattatgaaatcgtgagcatatgcctgctttgcagcccactccacttcttcattgctaacttctcttggacaaccatacctaatattagaactaatatccattcggaatagcctaggttcctgcacacaccaatatatgtggctatttaatacaacaaaagttctagtggtagcagagccttgagttagatctgaacctgtccaacaaaaccaatcctttccctgaaccatctgatgtcaagctcactgagtgggacaccatctactaatatctgcattgatcacaaaacataacttcagaccagccaactggtttgctttgaagcgactgcatgcggtcatgtggcacagacaatagtttgacgcagaaattatcttacttgcccatctgtaggttcatatagccgaagtagtaggttaactacagtactctttccacttccactaagaccaacctttaaaagtttcatataaatgcagccagtttgttagtcagaaatgagaattcagaagtatgaaataattaaatcaactgtgttcttctacacaacacacacacatagggagagaactagaaagcaactgtgttctctatctcttacaattgcaactacttcatttggatgaagtgttagattcaatccacccagaattggtacctgttaaaaaaaaggagatcaataatataaggacacaaggtaacagaagattcctcttatttacataacaaatatgataattatgaaattgttctgctttagggttcactctactggttttcagtcaaaagtcaaatgaatattatggttagatcagctggatcataaacaggtattctttttttccctttttggtgggtgacaacaggcactcctcaacagagaagtatccataaaagcactgtaatcataccgtaggtcttgatggatatgaaaatgatacatcggcatactgaatccggccttccaacttctgtaacctgtggcctgcaatggtgacgtactttagatcactaaacaattttacaaccacaagtaaaaaaaaatcaactagccattctaaatcagacatcaggttacaacagtatcttgtaacatgcaatttattttcttgccttcagaactaagctgtctgctaggaagtagatccatcaaacggaagaccttttcacttgctccaacagactgcatcagagaggaccagttgtctccaatccaccatgttgacaaaattagccactcagcatagagtatgaattttgtcagttgctcagcagttagcttcccagccatgatggatatccctccaatcaacactgcaatgacctacacaaagcttatttgccaagaatacatcatcaacggtacaacaaattcatatcagaaccaggcattttatattttacaaaattgctaatttaaatatgttctgattggagtatcattatgaattgaacagaaacatcaaactacctgagtagaatggtatagatagttcaaactcaagctccagcctccataagccattgtttgccgaaagcttacatcatatagcttatctagccactttgcatatctatcagagtacaaggcatcgtgagattttgtttttgtgtgtatgtatgagcgtgtttgagatagagagagagagagagggaggtagagattgccttttaaactcctgcttttctgttccataaacccgtactgtccgaaccaaacttatcacctcttgagcaacctgatttagtttaatgtgaaaactgagatgaaaactttgccttatgaaatgctaccttcatccaaaaatataagggatttttcccatgggacagaggaagtagcttattgtaaagagtacaaacttacattgttggcacttgcagtgaactcctgtgcaaatttggctgctcttttctgatacctattaatcacagtatcataatgatttctctcgcatggatcacaggtgttaagcaacaaaataaaaacgtggtggtgcttccttgaactttcactactcaggtaatgtaatatgaaagacagctaacacagaaaagggagagacaatatacaaggtaaataagagtaggtttttaccgtccatgaactagcataatggtcgacaatgtcgcacaaatcaacatagtgcacattccaagtggccaagataagactagcagataaattagtgcgcctacaccctgaaataaagtgacaaaatggtacgtgagtttttgaagctactggttacattttcatacaagactactaaacaaccttttcacctgaagcaaattgcgtgagataagattaagatcattgccaatgactcgtgacacttgctggcagtcagaaccaagcctacttgtcaaatcaccaacagtttcttcatcaaaaaaagcaatgtcctagcataatttaaaatacagttaaaagcttcatacttgggtcaaccaaagtaaaacaacagaaaactttatgtacattaatgaaatttctttcagcagtaatattttttattccttttgttttacctgagaaagaatagaatcaaacagcatttctctcattcgtttgacctacggaaaattttcagatgatgaaggttagagactggtcaaacaaaggggcaatcgtgaggaataaacttggaaagttacattaagaaatctaacatggttttaccaatatcatgtttgcaacaccaaaacagcagcttcgcacaccactgcaaaattggataccagctagtaagcaaccacaattgatttttcacaaaaaaaaaaaaaaacatgcagaagacaaacaattttggtttcaatgcagattacggagtatcttgctaaatgcctatagtgcatttgacaggacactggtaaatgtagaaatttgtatttatgctaccctatagtgccatgagctaccaaatcgattcatcagcataatagaagattttcaatattcagacccattgaagctcaaagcatttccattcctgccctagatttggactaccaacacattatatgatattacattgtcaaccacaccatccatggaagtgatcttatggacctaaacgtctaacgaccttttcagttttcaccacaacaacaatgtgatcaggtacagttgtattgtggacagaaatacagaatgcatgcttgaaaatgcaggattaccaacttctttggtttttccgatgaatgcagcatcacctacttgttggcttctctaatgatcgcgttcacgacttaagcacagttttaacaaagcaaagaagcaataactgacctaaacactccggaaatcaaacacagaacaaccagaagcttagcgttccggtagaacacagcccctccgttctgcgccgagaagatggacgctgcgaggagatggggtatcgcgatctccgcgagctgcaaccacaaccacacgtcaccgcgttttagacccatcaacgagaactctgcagcagcagaggtcaaacccagaaatcgccattaccgcagcgccgacgagggacgcgaatccgacgaagacaacccatcggtcggaggcgacgagcgcccacatccgcctgagcgcggaggcggccgtggcgccgctggcctcggcgcggccgcccccggcctcctcgccgtcctcgaggcgccaccagcttcccccgggcagcacgttccgcagccgctcgatgaactccccggcgagggcgcgccgctgggccagcccgccgaactctcccccgatcgccgccgcggcgcggatcctcgtcggcctcgcccgccccggggccctcctcgtggccgacgccgaccgcagaagcagcgacggcgccctgggccccaccgccgccacgcccaccgacagcgccgccgagccggtggccgcggtgaggagcagcgccgccggagtcggcattctccactctcgtcaaaccccctctatccctcccctccacccccaccgcccgattcagattccgattccgcgttcgccggtgagagagtccgccgcctcggcgagcaccggcgaggtttaaataggcgtaggccgctgcgtcctcgccggagttggttgctctgccgtgcgcggcaccggcgccgtaacgtctctaccttctccggctaaattgtattttttccgcggcttttttaatcctttttctcttccacttttcgcgtgtgcttcttttttttttctttttcctaacgtgttttttttttgcgattttttctacgagaagaaatggatggaatgaggcgatgtggtgtggtggtggtattttgggggatttaaaacaattttctggaggagaataatcgtcgttggattttaggattggacacggagaaggattgaaagaacggcttcgtgcgtggtcgtggcattggaacatgaggtcggtgacacactgacacgggatgttagagaacaggtggtggtgccgtggtggtaggccctatatagactccatcgtttgtcatggagttgaggtagtgtttgtaaagtgctcccggttttaagctttaaagtagtgctactgttgttgtaaaaggtcaactaaccacttataaacgttgcagtatgggttagtataaaatattatctcgatcacaaaatatgaaaatataaccacatttaaatagattggatctatcgtactatgaatctagataggggatttgtatgattcacccgttcaaaggttgctatattttgaacgaacgaagaagtaatttaacatagagcatgatgatatatgtcacaccacaaacatttcagttcaaattttatcttcacgaggaaaaacaagttctaaagaaaagctggaattgaatgagcatgggggcatggtacgatgcatgggattcgatcttcgtcaagagcattttcttacaacatattccattcgtttcaatttgatcgtcacccataatagccctactcctattgatcagccaatatataagcgtggaactcgagcatagtggttgaggttagctgttgtaagctacgagattagaggtagcttgtattgtgttatctctgtttcttattggtggttccccactcttctcttgggccttgtatttctacactcaggtgccatcttatccaagtagaagtgtagaactaggatgcaaggatggatacgatccgagtggtcttggtcgggtcaaagtacgattgtattttttttctttatcggggactcctttattttctactacggactctaatataacatacttgtttccgtatatataggacttggaacatggtgctcccaccgaggtatgtacacgtatgtagaatatcctatatttaagaacagtaaaaaatattatgttgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcaactagctctcggtgacttggctcctcgtaagctccggcttcgtaggctgtggagattgtgttggctctgagattcaatgcctaaaccctccccggggggccccttttatatcgcagatctggaggtctccacatagaactcggagatatcagaccctatacgatacgccaacgacccagttctgcctaagtaggattcttcccatctgtagattccgtaaaaggtttccttagaatatacaggaaatatctgcatgcgcgtgggtatgccatatcgatatgtaacgtatatcgaagggtaaagggtatgcctaacccgtaaccttgacagtagcccccgacttctgcttaaaatgaactcgtgcaaccatttgcgacttcgggtgtcgagactattgtcattcccggtgcgaggaccgcggagatagaccgtagtcgagcacgccatttgaagcccaacggtcacgagcgaattttaaactgaagtccaaaaaactgccgcgcgtaacgggaccagaaatttccggcgggcatctctctctgttccctggaattcgcaccgtcggtagtgcgcctatttaaaggaattttgggaatccattttgaagtccgccaaatctgttaaacacacaccacctgcaagcactctttgccttctccgccgccgcaagaaaccctagttcatcaacctaggctcgttttccggcgaccttcgatcagcaacggacctcggcaaatcggcttccaccagtgcaacgttgaagaaactccaggaggatggcgctcttcctggccgtggaaccatggagagtgaagcaggaggtactaatcctcagcccatcttgggtcgcatggttgcgatcgaagattatgttctctgcggttttctccctcctccttccgaatttcttctcctggttttgaatttctatggtctttctcttctccatttgaaccccaattccatcgccttccttagcatctttgtgcatctttgcgaggcgtacatcggggtagagcctttccttgatctttttcgcttttactacgaactgcgttggatggaatccaacagggtatctggttgcgtcgggttccgacttcgggatggcctgaagtcgcgttacattcccttccagtgcccttcttctcgcagcaagtggaggaataggtggttttatcttgagatcaaggactcgaaccctgtcttcgtggttcccggagatcaaccggacaagattccgtcttggaccgccaagccccccttgaccccctctcttcagtcgtttattgacatcatcgacgatctccgagtacgggggtttttcgggatatgaagtcgttgcagacttcgttggtaggtggatccagccgcttcaggctcgggcccatccagcttataactattccgggccaaaggacgtgacccgagtttctcctcggggtatctttctcgcattcatcttgacatacttgtgttcgcattcctcttgacttatcgtaggatggttctcgattaacaggtctgagcggcgaaaccgtggagcgtcgcgtcggccaagtgatgatcagcgacccgaccacggcgagtgacatccctgtgcccctttgtgaaaagggggcagcagaacgtgatgaagccatcaacgtaagtatattcgatgaatatcccgcattctcctttcgaaatcactttatgacttgattgagcgtaggcccttcctttgactgatatcatcggaccgctcacggaccatcaggtggcgtcatctctgaaagtgaaggtcgtcaaggaggtatctgatgctgccaccactagcggtggcaatgttccaacaaagccgaggaaattctcgtctgtaagcggacaatgtcgcaaggtgtcgaccccctcggtaatttattttgttgttaaatcatgcagcaagaaggatttttccttactttgcgttgattgtattccaggcctcagatgcgtctcccccacctccacgacgacaacgcattgtgacgatcggcgagaagtaagtagatgaattcttgaatccccgcgcttcttatttgattgttgtctgactcgtggtcgtcctgtagggaggcgcgggcaaaggctgcgcaagccaagtccggaggagcttccagtgcgtcgcccgtcgtggcctcgacggatgtcgtgcccgcagccgggagccgggaggcgacgcctagtggccccgtcagcgaccccgcggcaggtcgtgatctaccagttgcagtcctcacctgggaggagctccaagtcgagatggggcgcctcctcgaagccggtgctcgcagcatcggccgcgaaattgcggaggcgaggtcggaagcggcgacggtgaacgtgcgtgctgacagactggtgcgcgagttggctgaagcccgtgaagacctcacgaagatgagggagttggcggctggcaacgagcgacaacggaaggggcttgaggaccgaatgtcggaactcgggaacaacctatctgagatctggggctcgttgagggtcacctacaccggccttcaccagctcgctggggaatgcggcgtcacgtccacgatcccggcgaatcccgatgagttttcgctgacctcctctctcgcggaactggcgacggcaatgggggaaatcccctccaagcatgcggccaggattgcggaggagacgtcaaacggaatctacaccggggcgtgtcatgtcctcgcgtgtgtaaggctgtcgcgtcctgaactcgatctgcgcgagatcttggaccagggggcggccagcgacatgcgtaaggaggtgatggaagaagtcggtgatctgggggagtctgttctccccctttttgaagagtaggacttcttgtatttcctagataatgtgtaaaactcgaactctgaccgcctttgtgagtgcgattactatcccggcttactttggtatgctgacctcgggaacttttgtcctcttgtagagatattgatgacgaggatgtccagcagcgcgggcagcccgagtcactggcagtaattccggtactcgagtttgaaccacacgtctcgcctgaccatgtggatcaaccccttgatatagagggaaggatggcgacgacttcctcaggttagtagtcccttcaccccttaatgcccatctgactaggtcagccatgttcccgaaagagatgtacagctcgacttagtgattatcacgtttagcagatctcgagggtgcccttgctagccaagatcgtcgtatccaatactggaagcgaagtttgaagtggcggagctcgagagaaccatgctggccgtgaagaaagagcaggctgtggaaacgctccgaggccgtgaggtatggtttaactcgtacttgaagagttgctgcacatccatggccagagtatgcagggagcttcgagtagtccgcggagatcccgatgagtcggcggccaggtacatctcgtggcttaatggggcctgtgcccaactcgatggaatcggtaagcgtatcgacgaggccttgaagcaggagtgtcgtcgatcgagccgatatgccggggggcatgtgttggcttgcctacgagatcatcgcccgcacctggacctcgaacatcttcgtgagggttttgctcgttctcggagggctccggcggagatagaccatctggcaaggtcaatgtcgttctcccatcttagcgacgaatctgcttagtgctgccatgcatccggttagcttttgtacctccttgagtcttgtaggcgacttcatgttctcgattgccttgatcttctcggggtttgcttctatccctctgccagagacaaggaatctgagcagcttgcccgacggtactccgaacatgcacttctcaggattgagcatgaggcgatatcgtcggaggttgtcgaacgtttcccgcatatcgtcaatcaatgagttgcctgtcttggttttgacaacgatgtcgtcgacgtaagcctcgacattgttgccaagctggttgctaagtgcgccctggaccgtgcgctggaaagtattcccagctgttatcagtccgaacggcatcttaacatagcaaaataccccaaatggcgtgatgaatgctgtcttctcttcgtcctcttttgccatgctgatttggtggtagccagagtaagcgtcgatgaagctcaataactcgcaaccggctgttgaatccaccagttggtctattcgaggaagtggaaagtgatccttggggcacgccttgttgaggtcggtgaagtcgacactcattctccattttccgttggccttccgcaccatgactggattggctagccactctggatgaagtacttctctgatgaagccagctttgagaagtttgtcgagctcttctcgtatggcttgttttcggtctggtgcaaatctccgcagtctttgctttactggcttggcatcgggtcgcaccatgagtttgggctcaatcacctccctggggacccccggcatgtcggacggccgccaagcgaacacgtcggcattgtcgcggaggaaggtgatgagtgcgagttcctatttctcgtttagtgtcgccctgatcttgacggtcttatcggggttggcactggagagtggaacaatcttgatggcgccgtctggtttcggcgtcttgtttgtcttggtcactttcttgggtggctcagtcgtggcgggtggactgggcgtttgctcgaccatgtcgaggctccgcttgtcacattgcaccgccagctttgcgttcccctgaatagtgattgttcccttcggtcccggcatcttaagcacttgatatgcataatgagatgcggccatgaacttcgcaagtgtagttctcccgatgatggtgttgtaagctgtatcgaattcagcaacatcaaaggtgatctgttctgtttggaagttgttggcttggccgaaagtcacgggcaacgtaatcttgcccaaaggtctggacgatgattggggagtaattccatggaagggttgatcagttggtgtcaactcgttttgtggaattcccatcgcgtccaaagtgctggcgaaaagaagattgattgagctgccaccgtcaatgagaactcgcgctaccttgatgttccgaatagtaggttcgaccacgatcggatatcgtcctgggataacggcggtcttggggtggtcttcttccgagaactctatcttctgctcagaccacttcatcttgggtgtagccccctgtcatgtcgaacagacttcatgttccactttcttgtattctcgcttggaggagtacgttgtggaaccgctgaagatgtgtgagacgtggaggtcggagtctggatacgctaagtccggttcgtgaggagccgtctcttcgttcgtctcgacaacgcgtactcgcttgcctttttcaaatgccatgtgcttctcgagcgactttttgaaaacaaggcaatcttccagagaatgtctgtccgtcttgtgtatggggcaccatgatttcgttgtgtcactgctttgtgggtctgggcgtttgggagggttcgcgtattctgctgcgaggacttccgcttgagctttccttttcccgtttttgcgatttttcttcttgcttgactcagatgtgtccatggctggtttcttctctcccccggtcttcggcctatcgttcttgcgtcttagcgcatcatcagcgtgggcgcatcgctcaacgatctcgaataatctccgagtggttgtgatgcgtcttgtcgccaactcctgggtagtgtagcgatctctgacaccggatttgaaggcgcgaattacagaagcatcgatgatttcaggaattgtgtttctgcactcgttgaaacatcgaacgtattccctcaatgattcactctagttctgtgtcaacgcgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacatggtcggtaaatagtttgctaacgcgttgtcgtctgcttcggcagcatagagtactgtggagtagacttgaagaaactcctctgggtcggtgctcccatcatacttttctattgctccgggtcagaatctctcaggccatcggacatcacgtaaggaacgaccgaaagccctacacccagcgttgggggcggtgggttgccggcggtcgtgtgtccttcgtggatgtctgtctgacgatgaggaggaggcggatgatgacgatgacgatgggtcgcttggttccggtgtacgattacgaggatgacggcctggatctcgacaatcctgtcgtcgtcttccgctgttgtctcggcgccgatctccatcgtcgtcgtcgatacggcggcgaccatgaccagtattgtctggcacccgtcgttcgcgatcgttgtgatcgtggtggttgtcgtggtcccggtcctcgtttgagcgatttcctcgatttccgttatcatggcgccgtgaagagacatgacgccgagagcgattcacgttgtctcgtgtgcgtcgtgcttcccggcggccgttgatttgatctcgaagatcgccagtgccgcgaggtggaggggtagcttgttgaggtgattccctccgttccggatcttcaccattggcctctccagttggtggctgctcctggtgtgctgcggtagcggcttcttcaaacgcgttgctgaggttagtcaccgattctcgtagacgttctgtccaacgctcgaggtcaacgttcagaacgggatcgtaaggagtttccctcagtatcgcttgaacggccctgatgtgctgggctggagtagtcgattgattccccgcttctgtgttggcgtgcgctgacgtgccaacgtcatcgatagccaatacctcccgcggcgcgctcgttgtcgatgacccatagtcctcaaggagatgtaagaccgatggttcgtgaggatcgatatcgattaccccaacgaatcaatctgaagttggagtcgctccttgttccttgccgttatccctgatggggatatatgacttaggagactgagctttcatggcgccgagaaagactttgcagctcgagaggacatgattctttgtcttgtgaataggacaatagacatcccgagttggagaagtacgctgaattccacgttctttgcaggcgcgaatttcagcacggacgttgaggaaaacccagcaatcttgcagggtgtgtttcttggttttgtggataggacaccaagaccttgtggcttcgtaagtcatctttgtcggctcgtggttcatgtcggaaggacaaggtttggccgtatcagaatccttcttgagcttggatgtcatcgatattccgttctccgtctcgacgggaggatttttcgacatggaatcgccttggttcgtagccactgcgttctcgtctccggtcattggaggaccggttgagatcggtgtcgtggtgtaaaccgggaagacgatttcgccgacttgagtccataccagcattgttgaagcagggagtacttggctgaggctggtgctgacgttgttgtcgacgaagctggatgacatagtagtagaaccttgagtaccaaggacccctacctggcgctccactgtcgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcgactagctctcggtgacttggctcctcataagctccggcttcgtaggctgtggaggtggtgttggctctgagattcgatgcctaaaccctcccggggggggcccttttatatcgcagatctggaggtctccacatagaactcggagatatcagacccagttctgcccgagtaggattcttcccatctgtagattccgtgaaaggttttcttagaatatacaggaaatatccgaatgcgcgtgggtatgccatatcgatatgtaacgtatatcgaagggtaaagggtatgcctaacccgtaaccctgacatattatttaaaagatattttacatgtatgatttacaaagtggatcatatataatagacttactaccgtaaacgtgtggatagccaaatgggtcgcccgactcggcccgagcacaaccaggccgaggctgagttcagtcaagtcggcacgacctgacctacacaccaggacgggccatgcccgtccaagtgttgcaccaacagcccatgaacgactagaaggcacgaaagcccaccatgctcctccttggaaaaagtctattttgtctccctgatctctttgggccaactctcatatggctcaaaataagtatattttgaatccctcatctctttgagccgtgtcgagccagcccatcgcgccgaggcagaggcccaagcacgacccaaaggtctggtcgggccaacaagggcctgactgcttgggccaggcccaaacccatgccattggccgagccgtcgggcctagggcgttttggtcaactatacttctttccacccgatgtactttgattttttttatttttaatatatttttgaaaataaactatttgaaaacttattttcagctctgaacctttttagcttgccattttaactgacatggtaggacaacgttttggcactttcaacagtggcgtatggtaatggcagtgaagggagaaaataaatcgcggatggcaatggccaaaagatttatttttaaaagtaagattttcatagggtttgttttaaaatttttagttaataatggttagaaaaaagatcgagctacttagccaagcctcataaattctgctctgttttctccctttagtgaatatactagtagcagctagcagagctcctgtttgtcttatgaaaaagaaaaaagaacagagaaacatccgcaaatgtaacatggcaagtttcggtgtgaaacgagttcaataggttaataaaaggaccaattggataaatttgacataagaacggttatggtcgtatactaaaccaagtgctagcccgttaattaatttggtcaaacgcatgcgtgtaagtactatgggaagatgctctctcaaaaaaaaagtacaacgagaagataagtttggtgataagccagctcaatgcatgcatacgaactttgatgccgaaaaaaaccttatcaaattgtcaaaattttggtatagtgactggcaggatttcttatatagtcacttttttgacaactttaccaaaatttgataaggttgaaaatggcatcaaagttaacaggcccgaaaattcccattagtggctctttactgaaccagtgtttttctaatgttgacttcttttcctcgactcaaaacgataacttcctcatttcttattactacatattctcgaactgctaaaatatacatcttatataaaaatcgttgtacataaaattttttaataaataaataaataatatttctaatatataatatttaatatgtaaacaatcatgcgctaatgatatgttccgtttgggagccacaaatagctctagccaaactacattcgaattaggactaacaaactttatatagcgaggttcacataggtcgactcaatctgtacgaatacaaacaggagctcatgcattcctacagaagagtgtcctagtctcttctctgatctctcttgtacatctgatcctctacatttttttaaaaaaaaaaagcagtgtaacttccggctcgaaaggagctccctagccgttgttgccgctgccttcccaaacatcttctccgccgatgccgctaatgttgttgtcaagctacggtggcggtggcggtggctctctctctctctctctctctgccgcccaacaacatcacgaagcagataaggtcaaaactcggccatcaaaatacaaattggattggactacgttggcttcgctgccatgtccaacattacttgtcatggttgcctaaagccctcatcactaggtgtgatgcaaaattgattcaatctggtcgtgcttgccatggccgttggaggatggttgttggctttgtttaaaactgagcatttgatgcttccttcctccatgtttcaaatagaaagtgtttcttccattcacctgatagaggcaaataaaggaggccaaagctccatcctgatggctacactttgatactatttggtctttgtcgttggtgaccatatgaggatgcatgctactc

SEQ ID NO: 36642 - DNA, 21519 bp, Oryza sativa
tgagatgtaatctaaattcagcagtgtcagctcttgtttgtatctcatcgttgaaggtgtcgtttgaagtgttggataaaaatccagccctatttttggatgacaatgtggtagacaggggccaagtcgttctcgaaggtgcttggatccgagtaggtgcataataccgaggtttgttttcgttacggaattgctaaaaaatcgtgcgatagtttttttcaaagaaatttgtcaacgcgctttaactagaaggtggtacagagtgcaagcaacaatgactccagggtgaaaaccttgagatgtgatctaaattcagcaatgtcagctcttgtttgtcatctcattgttgaaggtgtcgtttgaagtgttggataaaaatccagccctaaatcgatcccgccaccttcatttcactcaggtgtctcatttaccaccaagctagcattgtttttgtgttccaaacccagttacgtacaacttccagggtgtagttacaatgtaattgcttcgcaaaaaaaaagttacaatgtaactggggtgtagctagacatttttttgccttaaaatctgttgacagcgctataggtagacccttggtaatgtgtgttgagttgctccaagataatatatgtctgtcttcgccttcccccccccccccccccccattcccattacccaaaaaaagttgtatctcctagcttctcaccaactaaaatgcagatatcataatttgaatatggtagatggagttatattttcacgactttatcatcgcaccagtgatgttttccccttccgattgtccactcgatgcatatgccatgataagatccgctttccactttttctctgggggatgaataaaccttccatatatgtcccaatgtaaggtatagctatagctagaaaccatgcgcacgaacgaaattaagaaacgaacgcacaagaggacagggcaccaatagtacgtaccacaccactaccaatcattacaaaaacatatcataatgtaggaaaagctacaaaatatatacactaattaatagcatctataatgttgtccctgtagatatctgcattatgttcgcgcaacagcgcaccacgggatccagaaagaaattcgccgaaacaggcacatcattgccttatccttcacgaacacaacacacacctaagcctctagatagctatatccgtctatcgctctacctatcctgtccccttctttccttcctcccataaaaaaacaaggaaacaaacaaaaaaccaaaagggaaaaaagtggaaaaaagagaaaggcagaaggtccatcaacatctggtcgctcgatggggtgatcgatcaagcgcacacagttccaatcatgcatgtgactaatgtctacgcgacgaggctctgcagtgcgcgcgggcagaagctaaggttaaaccctgtttggtagagctacaactcctaaattttgcttcaggagttgagtctggagtgaagttatagagctatctaaacccaactccacatctctaatttattttgtgagagaactccacccagctccgatcacattttaagtggagcttaaactgtttggctgagctctaactccaggagagatggagctagagctgtgccaaacaaacccttaatattatgagaagttagtatagttaagaatttggagaagctgacaaaccaagcttccagtttttgtgtcaatttctagattctactgctgtagttttttagaatccggataaaaatttaaaatctgaactgtttaaaaaaaatttcagtagctagagattctacgagaaattacggctgacagaagctcccaatcaaacccgagataagatgagaagatgcggggttacgtggcgttgtgagagagagagagagcctcgaagcggggccaactagtttatcataaaaccgagcgtgccatatcgccttgtttccacaagcccttagcacatggcgcgctctcgtcgctccagcctggcagagtgaggcgaagacaagagatcagaattcagaagcagctagctctccaccaaacaggctactcttttactttagcttggttaatttcgtccagatcaagaatcttgctaggtggagagatgcaccaccaggaatcaattaacctgtgcaaggggttagtcaaactcaaacagcttgggcgggtcatgatgagatcatgcatccttggtccatggaaatttggccatgcatgcatgtgcaggcttgtaatattctagacacatgcatgcagggatggtcaatgtttttgatagcatatgcagccgaaatgccgaaattaatactatatactctagctagccgagatgggtttttttatgtgctagtattagtagatccacacaaatatgcatgtaaatcctaaccagatgctcggctaaccacgcagaaagaaaaaaaaaaaaggtagtaactatattaaaaacatgatcctatgtctgcttgttagccgcaatggacacgacgattaaggtaattaattaattccataattcgatgcatgtacaggacgacgacacactacaggggttcaacgatgaacaaccaaaccatgcgtacttaagcgtcactggtacggggactacgggttactgatcaaatatcatccctagctagcgctacgattcacatgcacaacttaattaatttttttaggaggttttaccatcggttataatacggagctagctagctaataattaaccttcaaatggactgaagcttgctgctgctgctgtcatctgtttcttcagatgctaaccgccatctggctcatggaggcggcggcggcggcctcctggcgagaacgccgcacgccgtgcggggacttgcccttgcagccgccgccgtcagccttgcctgccgccgccgccgctgcggcttcggcactgtcatcgccgccggtgccgtcctcggcgccggcggcctttgtattggacgagacgccgggtttctccggcgagccatgcttatgcttacctaccgcccccgacgagttgccttgctcctgcgccgcgcgcctcaccttcacaccacgtatcagctgctaataattaagagataaattaagattacggttaataattaattagctgctgcttgcagaaattaacagaagtactccataaacaaagatactgccaaactggtcatccgaattaaagacaaacagtggcatgcagcaactatatatagcttattggcactcaaaatcacatccaactgagttgagttaaagagtactcgaaagaagtgggaagggcaatgatggatgaacattacatatttgcctgacttgatatcggagtagatcacaatgaaatcaccctcctgcagctcgtttgaacgaacaaaatcacctgaaaaaacatatgacaacgattaatcaacaatacttgagagccacaaattaaggatggaagttattggcatggcttgtgactgtaaaatttgaataattcaaaagtttgctattcacctgtgttttcgagaagatacatcctgcttttgttgttgggccaaaacctgtgttcatgaaaatcaatatccattaatgtcagtgaatcaaaatctaagccatcatgtattcgaataacttgtgcatatataatattgccaatggaaataattaaattaattaatcaaaaacatgagctcagcagaaccagcaaaaatcatatgcataatgttagtactgaaaacagcaggaaaagatcacttttatttttttgttgtatgcacttgagcatcaacatagaacacgatgaatgcatgctcctatttgactcccagattccaatgatatgttcgtatgacccacttgcccaattgggaaagggaccatcccatagtcatttactatttctggttcagaggtttctatcccctcccaattaacaaagaagcaagtggacttaaacaagcttaataagcaatcccaaatcatgcttgatgcttcgatcgaatgttgattactcaccggtaccgcatgttccacacctgagacgtcccgatgtcttccatggggatggagacaccatccctcgtcttcagctccggcaggtgaacctctgcttccttctgaaaccatccacagatcaagaaaggggagactttttagttctaccatgatcggaaatgtgaagagaaggttcaggcaaattccgtctttgattaggggagaaacatcaagtatgtgagtgtgtgcaagtgggatccttccatggaatggatttgtgccaagtggggtagtggatttggaaggagaaggtgttcgagatggtggtgactgtctcactttggggagcacgatgcggccgaggctcccgacgtcgctctgcttcagcaccttctgcagcaggaaccgcaggttcttgtccgtcttcgcctgcagcaatccaatcgatgccgtttaattagctaggttgataaatattggagattctatccctggacagcgatgtgagtgagtgagttttgagtgtgtggagtgtgtgtgaggaggagaatcgagttctcactcgcgtgagatcctagctatggtggatagcgattgatgtcaatcgtctgcatgcatgcacacctgccgcttctctgaagccgtcgagcgctgaaggctctccgctccggccgtcgccgccgcctgcggcttcggcttcggtttctccggcgagggtttcggctgcttcgacgtggcgggaggaggattgggcttgtttgataggggattctggatgatctgggccgccggcggccagatgccccagctccggcagccggccgacgacggggtgaccggcgccgagtgcgcggcgcgaggggagggctcctgtggatggccggagatgtggatctggctcaggttgagctgctggctacgttgctgctgcaggcaggagaggcggcgctgcctcgccatccgcttcttccgggcctcctttgtcgaggacggctcgactccggcgaggcgtggagagcacatggcgtggccgccggagtactgcccggggaatccggcggtgaacggcggtggcacgaccgacggcatggtgtaggagctcgtggaggagacggggaacggcgcgaattgctgcggccaggccatgttccctccgcccgacgcatgcatgtcgcccgccgccgccgcggtcggcggggagaacggctggctgctcacgaccacgctgctcttgctgcagctctgctggaaagggaacgggccggcggcgcctgggtacatggcgtcgccgccgtacgcggctggcggcgtgaaggcctggtagggcatccaggatgtggcggcggcggagcccatctcctggccaccggaggggaactcgtagccggggtttgcgccggggctggggagctgagggtccgacgacgcggcgccgtcgtcaatcgccgtgcgggggcgcttcttctggaggtggtggttctgcacccaggtgaggatgagcttgagcagctgcatggtgccctggcgcccgccgccgagccgcgcggccgccgcctcgatggtggatcggcggaggcggatgctgcggaggtcgtcggcggagatgtactcacggttgctcgtgagccactccatgaagaacgccggcagatcgtcgggcgcatcactcccctccatgcatgcgtcgccggcgtcgtctcctcccccggccgcctccatcaccgccttcgtatcgccgtcgccggtacagtcgtccgcctgatgcggttgcccggacatggcgtcctctatcatcatgccaacgtcgtccgggaacagcggctgctcggcctcccacgggacggacagcgacgcgaggtcgaggagctggtctatgtcggcgagctcaccaaacccgtccgccgccgaggccggctcggacggctcaccgccgcaaccccctcccgccgcggtggtgaaagcgctggacgagttcgacgacgacgacgacgagaaggttgagcttgacggggaagaaaggcacgggaagtccgggagcaacgggaaggtatcgtcagcgaaaaagacgtcatccctcgccgcctcacccctgatctccgccgccggggccttcccccgtccgccgccgccgccgccgccgccaccctgcttccccgggttcccgtgcgagtgcggcgccgacgagccggcggaggcgtccatgcagagtggaggcgggcggggggcggagagcgcgagatgtaggcgaggcggggggtttggctttgtttgtctgtgtgcgtgtaggtgtggaggtgggtgcagttactgagaaaggagacgaacaggagaagcagcgggaggtggagggtgggagagtagagagagaagagatgcggctgcggcccacacgtggcggccgccgagggctgtgggaagcgctccaccgcccacgccagcctctcctcagcgaccgtacctttcgccccccgcacggcacggccacgtcccactgacccgtgggccccacatttcctctgggcccacttatcattgctgggggctgcgtttctggtgggtggggttccccttttttttcctgagttgtaacggtcaatgacagtggggcctacgtgtcagtgggaagtacgggatttcggcgcgtgctggttttgaccgccgcggcagagggggagggagaggagcgttcttgcctgtggtccaatgacatgtgggacccaaaaggaaaaccatagagtggtagggtcgtgtgcgcgtagcgatttatgcgcgccgtaggatgtccgtgtcgcgtccgcgccgactaaggggctacgcgtccggtgtttccgagccgtccgatccgaaccaccgcgtgatcgaacggacgccatcttcgggaggagacctgtgtgctgtctggattaggaatatggggtgcgttttttctacgcgcacgtacgaaacctacacgagctggagatgatgacgtggaggtgtgggtcgcaccttggttacgatgacgtgggattttaccattggttgcagtggaggtggcccgtgtgaacacatgcagcgaacggcccagctcgatcgatcaccagcagccgggaagcgtaagcgctaagcagaggcatggcaatgccatggcatacgtgatcttgttctggccgttgcgtgtggaactgtgggtggagcatttgctttgtcttgttcgatcggaggatgcggctaggtaggatacatgttttgcaggggtaagagcaaatttccactttctctttgcttgtttgcttcgcaacaaatgcatttgaaaatgacagacaggcccccaaaatcagattaaaaaatatgttttctttggtgtccttagtgatgaggagcacccaaataacccatgcgacatcatccaaggattttattttttttttgcaagtttgtactttaaaatgagccaataaatctataatacacatttacgactacgtgtccttttcaatatccgtggaatcaattgatatattgattcatggatgcaaacaaaaacaattgtaaattttgggtcattgaacgatatatatctctctaaaatattatttatatcaagatgacgatatgcatgtatctttcattattaattgttcgctcaagcatatcgtatcctttcgagggaatgaagcatcgaagctcttgactcacatccaatacattgtctaattcaataattggatttgaacatcaaatatattccatgcgttgtgcaatttacaaatcatttttaattagtattttactattctcaatctatattatcgataatatgtattttactattcgatagcaactgtaaataaaggtcgttgggtgttacaggtcaacaatcatttgagcgatatggtaggttgagtgtttcccctatgttgttttggcataactttcatattactatgacaacaaggttattttgaagagttaataccgccacgtccattgtgcatatttataaaaagtaactatcaaaacacaactaaacccgtagcaaaccacatgcatatatattgaataagtgattttgtaaaaaaatatttatagattttgatatatgagggatacttgtaaacttatgtatataactcagccatgtcatcatctcaaataattttagacaatcggattaatatatatcacatcatttatacactgaccattcgattggaaaataccggtttgcaacattggaatactactatactttagtcatgattgatacaaatttcgatttaaaagtgtagttgcatgaattttgattcatgataatctatactgcaattatcatttgcattgtgatatattcatgattgatgacttcgatgctcggccacagggtttgtagcgcgcaatctatttgagcgtagccatgtagcattgtaccatgaacatatcaatatgtggtgacttcatgcattaaaagaagatggacacgttgtaaccacaatacaactttcttatctcccaacaacttatattacgtgcggacgtatataaatacaagaggctgcaacaacattttggctctttgtgattcattgatccgaggtaaggtcataaccttacaatggttcaccaccatgtatttttcgaagtacacccatgactacatctatacacgtacgcacggtgtttcgataaaacaattttgctatgagtatataggcttatggttcactgaaagacacacactaataaaaagacacaagatttggctcgtgttttggattcacgaataaatctggaaaatattttcaatgacatataaaattttctactatccccataaaaaaatgtactaactttctttgatcatggaaattaaaccctacaacaagattaacgcatatactccatctatctcgatatatatatatacatatatatacatatatatatatatgcgatgttgttaaatcttagatatatatttgattttattatgtatataacaaattaaagttattcataatatatcgtaataaaagtttgtaataaaataaaataataattatataattttagtaagataattgaaaatagcgtaactgtatcattcgtgttagaataaacagaggaggtactcctaattcctttcactggagaccaaactacatcatcgactcatggcgtcgtaccacagaagcactagctgctggcaaagccgtagatcagtgggacgtggcggaagccaagccgtcggatcatcccagcgaggaaaccacccgcgaccgcgacgacgcaacagcaggaaaacccaaaaccggtcggactccacagcgacccctccgccacgaagcagcacgcaccaaaaaaagaagaagaagcgaagcgggggcgaattgaggcccaaatacttgggtggggtggagggccgagcgcgagagatttcggagagcagcgcgaatcccccaaaaatccacccccaaatcccaattccaaatccgacctccctcctcggccagatctcgccccctctccccggggggcctccgatcgaatcggcggctgcaccgcggccggcgattcccgggaggaggaggaggaggaggagtaggaggaggggatctcgccgagatttggattgggtttggtggttgggtgggagggagggagctggggggtgtggccagccatggcgtcggcgcaggtgtcgtcgtcctccgccgccgccggtgcggcgtcgtcgtcgtcctcgcggaagaaggatctccacgcggggaagaagctggtatgtctgttgcttgcgatagacgtagtcgttggttacccgatgttggtagtttaaccttctggaaatgctggatctttttgtccagacacgtttgattgaatagggagcattgaccgctttgcgttagagatgtagttccatcgatcgttttgcttatggtagagaagtcaaatgcgcgcaaattacccccgtcatcagcacgctcagtttgaaatgttgaattttcgttacctagatcttgctatttcatcaactgatcctgagtgatgatttgatgcgaaattaagttcaagttggttgtagaataatgatgtcgtgttttctgatatatccagctggcggagtaccgtaagaagaagaacaaggcggcgaagaaggctgctgaaactgcagaccaggcaacggcgcctgttcctgatacactagagaaccctcctccaaatgccaccagtactaactcgggagacaagttggtatcggacgtggatgtgaacacaacaagcacatcatctgtgccaccagtctacgagaatggcccaacgagttattccagaggtgacgagcccttgtcaaatggacctgcccctgtaaatgtgccagtcagtgttagtaatcctgccccatcgcatgatgtcagtagtgttggagggagcaagatttatgggaacttgagcttctctgacttagttaatgggcataatgaggattggagaggcgatgctgctcggaaaagggaggaacatagtcctgacaaggacgtgactttaaaatctaaattgagtgcctttggaaactcagatgaggtctcccattcttcagatgaggtcttgctgagtcagggaagaaatccagtcttgagggaagtaagtgacactgagcagtctagttcatattcatctggcagcctttttggaaagttagaaggcacgcaaagtcagggttactctgcaaacaatgatatctttggtcggttccgaggtatatccaagccctttttcatattaaattatgctatctgatgagtgatgataacttgaatatgtggcacttttaactctttacttttgctgctatgcagccacctctaaagactcttcccaagcagatggcttagcgtatgccagcagccgggagtatggaagtgccttcaataattcttggaatacatcaaattccacacctgtttgttttgataaacaggatccttttatgtcatctggttatccaactacatacaatcgatctcggccatcttttcttgattctattggagtacaaagagctccaacaactgaagtcccatacgtggagcctgcaaaggctagtaaaccatttggcaactcgaattctgagagttcattttttcagccaccaaatcaacaatccgctggaagcaatgatgtggatggttctctaaaatcaggaagacaagaatataacaacgagaagggatcatatggaaattccattcgtactgattcctttccttccaaagatgaacggaatctgcaccatagtactcaaatgttccaaaacttcacaattcctgggaaagatgatgattttgctgcactagagcaggtgatgagtgctcgatctatgttttcattgtctgtgctttcttgaggatatataatattttatatgtatgtcaggaatgacctagtaaaattggacattggacatgatattgagagctgtgcatttattaacaaaatctaaacgcttatttatgtttgtttgaattgatgacgcttacacctgaatgctattgtacacaaaacaaaagtttagctgaagttatgtctgtactagccatatgtccaaaagataattttaaaaagtatatgcttcataatatgtaacaacttgtttgactgcgtgctgcgtatagttactgttctgcgtggtgcagcttctgggtctatattctagacagaacgtccaaatcttgtgatggacgtgccatattctactaaattaacagccttatccttgattatatatttttacttctcctgaattgcatgtactttttgttatttacgagtatccgcatcctactcatgtctgctctggtttggctgttagctcattgaggatttgacaaaagagaagttcgccttacaacgtactcttgagaaatctcaagaattggctcaaactttggccacagacaactcagctttgactgataagttcaaccaacaggtatttccaaatctccattttggtttttggagttggatctagtatcctcacaaacttttgccatttattatgcaagtccacaacagaaaaacactttcttcacaattaataaaccagtttctgctataacgtagtatttcaatgtcaaagtttcattctgcccgtttctctgtctttccttgttgctctgccttattcacggtgaatgatattcaactagcataacatgcttgcaaaagtgtctctagcaactagaaaatgctaaatgagaatggaatagctaagcaatcacccaaaatttaccttacagtcaatacttcttatctgatcagtaaatcatcaattcttttacagcattggtataaggacagaatcaatactgattagtcatatttccagtcacttattgtcttgtgtatcatatttattattttgtttgcaaatgcttaggcacaagttatcagcaacctgacatctgacatggagagattgcagaacgaaattcaagctcaactggttaggcttattccaccttttctagcaatcattaagattctgtaattccatgcttgctatgctgacatgcttttgttctgttggttttttagtagtactatcgctgtgtaatttggaaatataatgtgctagttgcaagacatatgttagcatagaatatgacttatgaaatgtagaatgtctccggatatgaggagctagggaatgagttcataagatcacatggttcactatgtacccagcatgcacaatatgtttagattttggtgtttgactaggcaactggctgaagtatggcgctgaactattgcttgctaaatgcctaattcatatgaaagtatctccactaaatgtttaggttacttagtgtacatttgacttactgatgtttctggtagttagcatcatctgtgcactcagtgctagtatctatcaatatgaaacttatgatttagggccagtttgaatgtgcatattgcctgagcttacttaggggcacgcaacacagaacatgttatcagtgcattattaattaagtattaactattataaacttgaaaaatggattttttgaagaaacttcatatacttttttttttgcataaaacacaccatttagcagttcggaaaatgtgactaacaaaaaacgaggaagttgtagtttggagttgaagttttctcataatttgtatagttttcttaccaactccaatttttcaacagctggcacttgagtctgtcagaacggaatatgctaatgcccagctagaatgcaatgctgcagatgagagggccaaagttcttgcagcagaagtcattctacttgaagataaggtgcttagctatatactcgtctgcttcctctctaatgttgcaaatcaacctaaccttcttagtgggataataatattgacactgtttatagtttttgaatgctcattattttgagcaatgtttttttggagtatgttattatactataccttgagtacattaagccctagaggtgtcacaggctcacagcaacaaatcaaagtataatgacagatatcctatacacctgcaggtaggtaatgcctattatattcaagttttaatgcatcagatgtaaatatataatatcccttgatatgccaaacatgcagctgctgtttttttatctaacacttctctttaaggcactatttatcaaaagcgcatgcagtttgatatatcgctattttttaggctcttagactgaggtcaagtgagttaaagcttgaaaaggaaattgagggtttgagctctgagatttcttcatacaggtgaggttttctgctatgagtgcatggtatgtgttttacaaggtggggagatcaattgataagtgaaatgggcttcaaatataaatgtgaaagaaagtttctggtttttctcacattggcattcttgaaattgttatgcgaaaaaaatatgtgagtcttgtgttaacatgcaaaaaacatgacatgagtttaagtttactgaactcacacactgatcatccgagggtactgacagtgtttcctttacgattttcttttactatgcacaggcgcaaagtttctagtctagagaaggagcgtcaacatcttcaatctactgttgaggctcttcaagaaggtagttaccgttttactctgatgtaaaacttttttgaactcgttctttatcccatgcccaactcaattatctggtgagtcctagaaaatcattagttgtgttcacatcttgcacgcacatttttgttccctattatttaagccccatactcacacatcctttagtgtcacttatttttggctgtcaaataactaaaactaaactagaaatttatctgtaatattctagttggaataagacttgcatgtgtgtgatagacttaatttatgcatgaatattgccggttgtaaacttgacttcacattgatacttttggacagaaaagaaactcctacactctaaattgaggaatacttctgtgactgagaaggtcaatattatagaaaaaccttcagctgataaaagagatgcatcaactgcaacagaagatctaggtatgaatgttgatctccccttttgtttgatatctatgaatatgtatttcaattttcaactagtagtctgcttgacacgaaatatgcatcttcagatacaggggaaagcagctcttcagaaacccttaccagtgccattgacacagtagaagatggtgaaacatctgtatcgcggtccaataatgtggctgattttacttatttagaagaggtgtcttctagcatcccacatgatcagcttagaatgatcgacaatatcaactccttgatgtcagaggtaatctctttgatgtgcaaaaatccagtgtggttggtactttatatcacttacattgatcgattgcacctaaataaccttaaaccacagcacttgagtttcatagcctacaaaatttacttccttgttaatagtaattgttgcattgcagttggcagtggagcgagaagagttgctgcgagctttgagaattgaatcatccaattgctccaagctgaaggttttgttcatttcgcagcaactttgtttctactatttttgattcattgagcctatatttcttcctgtccagagcttcgatcgacccaatataaatgcgatgcatgtataattaagcactaagcctctagggtatacaaatgcctagggtcttgtatagttgcccaagggactatcccagctggcttaacctaccgggccctttcctccggatgaaatcatgtccaaatcgagggctattgtgtactgtaactttgtcatggtgtatctatcttatgcagtccattctttgtcttaaaggaattgaacaaggatctaacgcaaaagctggagattcagactcacagacttgagctgttatcttctcaaaggatggctaacgagaatgtccttccaaagccgatcgacacacgctccatcaatgatgcaactttgtatgctgatgaaggagatgaggtaatttagtttctgttatctaagcatctaacagcaaaactcacagatcacataaaagaacatctctttttcattattgttataaagccttttcatgtgttgacagcttgattttttttaaaggttacaacttatctgatgtaacatatttgattgcctttctccattagatcattgttatgattgtctgacgaaaaatatatacaggttgttgaacgggtgcttggatggataatgaagctcttccctggtggtccaaagcgacgaaccagcaagctcctctagtggaaagtagagttttggtataccataatgttttcttttcatttatatatgatatttttttgccctgttttggtgatagcatgatgagaagttgtatattggaggagagccccttgatgtaaccattcttttttctacagaaaatgaaatgtatggtttgacttctgtggagctacacttttgtattggcaatgaacagaatagctgccagcaggaaaaatacgcccccttatatattccataattatacgtggggtggaggtgtatgttgtaattgctgtatccatttgttatttcattcacttgttatccctagctctactatctccctcgttcattttctcttctgttatttgctgcaacttgtcatccgatttcctatattgctctggctactggttacaccggaagtggaagtgtggaacacacataaggaaaattatggtcctaaatcctaatccatatttatcgttactctaattttcctatggaaccttgaacaccatagcgctctctctctctctctctggtaattgtgccttgtagtttgaagactcgttatcaatgcagtgaaaattgtggatgcgatttatacacttctactcctagcaatccgaagccaaggctaaatgacaataacaatagaaaagactcaaaattatttataaaatgaagttctcaaattataagccgtgtcacaaagaagcaggcctgacatcctgtgtagtacactataatccacttttcagccatgcagcttgtgaagtacagaaatggacaaatcaaacttgcgattcttcggtcgactaaaagactttcctgttctctaaaagaatgcgaaagtcgatttttatccgcatgggatagtatgatctgaccaacgaatagactaaaatataacaagaaataatatatgatgactatttcttgttatgggtaggaacgcttagatagaacttggtgttcctgaaatcatcaaggagtggattatatccatctttggtcctagtcttcaacggcagtccaaactcttccatgaaggcagcagaatcaagctaacgatagttgacaaataacatcatactcgtcagtgcaccgaagtttgtaaaagatgtgatgcaagatgaactaggacactaggttgcatagaaaacaaaactggcttaaatagtctgaacttacaatgatggttctcctcgtcttaactggtttaaatgcaccggggttcttttgctgttttgagaaaccagagcagtcatggtcgatcttctccaaaagccagaaatcggttgggaagaaaatatctgcgtcaccctggcaagtaacataaccgagttcttttaataatatataataacacatagcacaacaacttaattaaacacatagcataacaacttaattgctcaaagttatttagttctttttccccatggggttggacagtagggtcaactaagctacgacatgtttgcaacgaatctaatattcagatataacagaacagaaacattattcaaacctgagcctcaagatagttgcgatgatccaaagtcctcccgtccttctgcaagcaggacacaacatcaacgaggtgtcctagagaaattgccttgttggaaaaacgcaccaaaagtcagtgaaggtcttgtcacctttgaagaaaccaatggagctctatcgccaggtatactgacatcaggaagatagctgaaatctgaagctataagggacatgcttggcaaagcttgatgtaaagtatctagtattttctgcatatgtcataacacatatttcagagattctggcagtaagctgacaaactcatcagcatatgatcacatatagaataacagtttataacctaacaagtggaagtgggttcaaaagacataccaagcatccagttggtaaccaagctctccgaggctttgggaatacttttgacacaactccttttgcagcaagtgataatttgtctctcacagacactttctcttcatttatgccagtaatctcgacacagcgggaaactagtgggtcttgtaatggtttgtatacctcagagccttgtgaactatttttcataaaaggcaaccatacaaatttaatgaagtctgtcctcattagttaccaggcaatatcaatcaatacaactgtccagattccagaagcacaagggcgatcgactatgttatactagaggggtaaggaatcagcccttcaacaataatatatcgaaaatgataaatttatctaacaagaatctagtaaaagaccagcatgagagcactataaaacaagcagaaccttcccttaatcttctgttgaagaatataccttttttcctttccaaaatataaagtatgtatactaagaataaacttatcttatgtagcactgtgcttatatatgttacaaatacaatacagtaatatatagaaaagaaatcataagatcaatagatcattagccacgaggtaacagaagagaattcagtaaaagaatttcactacagactgtcagacttccatcattttttttttacccacaagaagcataagttcattcatttcatcaaattattccaaagtccagatcatttcattgaacttgcctaaagccgcacataaataatcggtataagagcaaaaaagatactttcatatattgtctgaagcatacactctcaggaatcagaaaaaggaaaacacaaacctgccatttactttttcaatccatacttccatccatggagagacctgatctggcgaatagacaaggtcatgtggtagattgtcaagtacctgacaatacaccaaatgaatgttgctgttgaggctgctgccatcatgtctctaagatatgattgcgaagctaagaagtccatatgataatctaattcttcacttagcaaacaaaatgatactagcaaccagtgtttccctacttgccatcatcagtcagtccagactactggcatggtcatacaatggttaataagtgatggttggtagaatgtctaaagaggatcctatatctggttgttatggcaatagtgagggtacgtaaaggaacagcgcccaacgttgatacagtgttttgtttgcaatatcattggcaaagagagagtaatcaagagtttatgtctgctataactttataacctactcttacatatcctttgaaacacaaaataacacacagataaactcgacactgaaaaaaggtatatttgcagtattcacatcttgaaagcctaaataacatttgaggtgctgctacacattctgccaagctactaagttagtgcaaaccagccagaggactgcagctaagcgtcaattaataacaggaaaggtggactgtaatgatggtatattgcttctttgattcatatgagacatcaaagaaacaaccgagcagatagtcaaggcagtacctcaagcattaacacccaacaaggttgaggatccttgcggcctgtaaaatatgacaggaaagtaacccaaagtggtcaaggaataaaagtgcaacaatataaagatcagaagataaaatccgatataagtgtgatttgacatggagggattagtgggaagtctgtgtaagtgtaacccacacattttagactgagcctatcagcactacatcaaaatatggtgtaatagcattagctgaaaatttgcaagctgaattatcaaagttcatacattattttttaaatagaatgcattttagagtagattgccctacagaggagcagggacaagaagtcagcttaccccatccagctctgtcagttgcgtcacgacactcaaccatgaactttgacaaatggcttcgcacctcaccaacagtttccaattgcttctcagctagagaggaactaatttctactgagctagcaaattaagataaaagcaaggtcaaagcatattcgatcacataacagagatcataaagtgaaggaaggtttccttacatgtatttcatagtattgtatactttcggtggagcatttaacatcatgtagtcaagtatgcattttgcacatgtgccagaaccaccaccaatttcgtaaatctgatccatgcaggggaaaattcatatggtttggtgaaaaagaaaacagatgactatgtgccataatattataaggtaccttttctccaaaaaaaaaatttggcatgagaactgcagtaatattactagttgagaaggaatgaaaaaaagaaaaggaaaatggtgcagtagcacagccatcatttattaaatcatatgtgagcggttatggcgcttgtaagagcaaatgggtggatggaggtctagaactatgctgaggaggaagttaagaatgcaccttcagtgggactgaaagatttgctgtacggaggattgatgcagctattgcataggcataccatggctgcaccagagaaagaccacgcatcaagggtcaaactgacagaaaaatgacactacatgctattgaacagcttaagaaaacaccttgaagagctccactggagtgaaccaagcgatgtcatgcttcttgtacaacttatcaaggtactgcatatacgcactcctacctacataagcaaattacttccgtttctagtcaaatatccaagatattaaaacagcacaacacagaatcgtaattggcaaacaatcaatggagttcaacagtcgtggaagaaaaacagaagtcccaaatttctgcatgagaggaacagtggcacgcgcaacgtgttcgtcgaaatgccacctcggcaaacaaatgttagaaccggcctaatctgattcccgcaatgccggaacacacacaccaaactcccacatccaaatccggtccaagcaatagaatgatccaagaagcaggtagaaaggaggattaccgtcgagctggttgaagcggatgctggagtcgagcacgcccacgggtcccgaccgcttggagaagtagccatggttggggtcgtacagcgccgacctcacgaagtcacgcacctgcgcgcacgaagctcccaccaaatcatcacccgctacaaggagatctcactgcgcccctcccagcccgcgaaacctccgccccgagcgcttaccaggatgggcttgttctcggggacgatccccgacgagaacatcgccgccggataccaccgcgccagcgtcgccgctcgccggagcgccgccgggacggacgccatgtgcggcggcgccatgggggagtcggggagtgagtcgctgcggcggcggcggcggcaatgcccacgcggttccgggccttttccccgaaagaaaagaaagggaagtccgattcgtgttcgggcccaagcccaacacgagtccgagtcggagtcgtgggctgcttgggccgtacggcccgcggcctatttaagtcgcgcgagaggagacgcatctcctcgcgcacgcgcacgctcgagaaattgagagattcattcaattcgaagggcgggagagaaggaaggggagagatgatgatgacatcagcgatgccgccgggcggcggcggcggcggcggggaggctcctactccggtcaccggcgtcgccggcgacccccgccatgagcagcgcatgaggctggtgaggaaggcgagcgagctcgcgacgcggtgcgccgtccccgtcgccttgtccggcccggccatcggcggcgtgtgcgagccgctgcgctggccgtcgatggacaa

SEQ ID NO: 36643 - DNA, 3330 bp, Oryza sativa
  unsure (1)..(3330): unsure at all n locations
aaagaaaccagagccgtgctccgcaccgccgccgccaccgccgccggcgaaccggaacggcgtcgcctacgaggccgaacaaaggcgcgcgtgcgcgctcatggtggactcccaggaggatgccgcgccgcccccgccgccgccggcgagcgggaatggcgtcgccgacgacggcgagtacatcaacctgggcgggtacatgatcgagcgcaaccgattcgaagcaatctggcgcgaacacgcgatccctcctccacaaagcctcctgccggagtcgttgccggacgacgacggcgagccgctgcggctgtggtcgttcgacgccggcgagagggtaatcctttgaatgtgcccgcgttgagttggcctctagactgattttgttgttgataagagtaatgctatatttactttatggccgtgtggcttgtgacagaagtaagatgtaatctattttcattaaaaaaacactttaaaaaatctgtactagtcttaattagtagttagttaggggccgtttagattgcagtcaaaataaatctaatgctaaaattttagtagtttgacaatattataaaaattgacagaatttcttatatatttactaaagttggacaagaaactaaatgtatgcacatttttaataattttaacaaaaatgatatgatttaaaatgacatcaatctaaacaacccttcagttagaaaagaatgggcttaaaatcaagaatcaatcatattttatccacatcagcttttcaagatgctttttctagacaaataacagatttttgtacgcgtataattttccttttgagaaggttttgtatctaaaacagtttcatttatgcagagctcgagaaaacagcacaaaaaaatgaaaacggctgcgaggggaagatcaaagctcactggacacctgtgttgacgacattctgtaccggctgaagggtcttcgatcgatgatttcacttagatagcagtgcagtggtctgccttttttgtgaacttgatgtttctgtaaatttctatgtgagattcagatgttgctcgatctgtagctagttcctgtcttccagctgtaactgtaactgtaacgagaattaacaggcaaaagaactttgttatggggattctttaataaagctggataactaggtgatctgttcatctaaaaaagtganaagtagtcgtgggactgatcgagtttgctgtttgccgccttccgacagttgaccttcatgtcgccgccgcagttgccttttgctgaaaattggatggaaaacgtgcatcgagggatgggtatttgattgatggataattggatgtcatcaaacaacaacatggataatatggagcatgctgggtggcttaccactagcttgactctaggcattgagagacaacacaaactgtcaaagattggtggaagacactagctaatacggcatgagtttgagaggtttgcgcaccctcatcctcctcatggtttgggagatatggaagaaaaggaatcaacgaatctttcagcacaaggaggctacatcatctttcctcttcgccaagatcaaggaagaggcgcggacttggacgatggcaggagcaaaacgtttgcgggaccttctgcccctccatatataatatataaagagtacaaagtttttcatttctgatccttaagagttgttttttcttccactatattcaatgaaaagtcatgatctagtgccgttttgcttaaaaaacaacatgattgtagttaatagttattactccataaagtgcactttttttaagtgtaaataagtaaataactgatggatataattggaatatcgtcgaacaacgattggccctttttttcttttcattggcgtttagatcgtttgacgtagcgacgtccggggtcgttgcgccattcgatttgcatcggacggaaaagagggagtacagcgatagaaggggctattgctcggtccgcaacaacaaaaatcaagccacgaagattgtcctgggcccatggaaacaatacgacggtagcattgattccgaggagttcctctacatccattctacaagtgcaaccgtatatatcatgtctaacctgaccgtccgtcttatttaaaaaaattatatacttttattattaaaaaatagtcacacataaagtaccattcatgttttatcatgtaataaaaaatatttatcataaaaaatttctaataaaataaatggtcaaacattggacataaacaatataaaactacactattttgggatggagggagtaccattcttaatgcaataggggcaaatgacaatgcagtagcgaattatctatcgattacgttgaactgctcatccaccttatgtcatattctcgatcaaccgagcatcgtttttatataacgggtaatattttcaaccgctactgtttttttatatataaatgttttttctaatttctttctgcatcgtactggtgtcaacactgagtagtttaaatgatgaatatgatcaattatcgaccgatcgatcattgtttttgaaaagatgctattgattctgaatgttttcgaccgttttcacctcttttaacttccataaccatgaggatactccatacaatctctactattataaaaattaaagatgtttttgtcggtactttgacacgttatccgtgtatggttcggtttttaagttcgttcgcttttggaaatacgaatctgtatttgagtcaagttttaagatcgctcgcttttgaaaatacaaaaggagtcgtataagaaatccccttaaaagaactaccatgctaacttgagatgatcgaactcttaactacacatcatgattttctagaaatatatatatatccaagtaaattcccaccatgaatttcaccttaactaaaccatacaacaataataatattaaaatagccttcgtccgttgtaacatacgggcattttttaccgttattttcagggtagttataaaaggcacacggtcgaggacgatcttcacgggttcccgaacttccaaaaaaaaggggcaattacttatttgaccctgttttgaactgtaattgatgatttggccctactttttgaactttgcttatttgaccctccttttcgagtacgaagctccggtctgaccctattccgtttgggtgaggtgacggtgttaattttggggtaaatagtctattttgcccttgcttatttgacactgttatatcccttttgtttgcttgtttgaccctattttgttataccgtgtatatattcaacaatgttgaaatatttgtaataatttttgctcaagt

SEQ ID NO: 36644 - DNA, 202 bp, Oryza sativa
cacagctcgccgccctcgccccctcagatcggcgccgccccgcgcccgatcaaaccgccgccgccgccggcctctatctccacgagcgggcgtgtagcgcccgttccgtcgtggcgcctagcgggaaaattatctcttaaaaaccctaattgtgaaattgtttcttcgcttgtcgtctagtgtccgtgccatctcaagatct

SEQ ID NO: 36645 - DNA, 584 bp, Oryza sativa
taataatgcagaatgtaatagaatcagcctttactcacaaaactaaaataatgatggcataaatcacagtttggcaaagtaccttaggaatttcgtcagagttagactcagaattgttcctcttttttactatttgcagatgtccatgcatgattcaacaatgtttgggttgtgataccagagtctttgtcttcaatatatgagataatactggaagggaagtggagctgcaagatacaatcagttcttttttccctgaacaaaagcggctggtagaagaaaacaagagaagcaaatgatccatatttaccttggttacattgacagtaggaaatgaaatcccaaacaagtaacctagcataacaccaataactgctgagaataggagcctcatgccctcatttgatcttggcaagccactgctgttgaagattgacaaaataataatagtaataataaaattatgacgcatatttatgagcactacagaaaaaaataaacatattgctaatagtgatcagacattagtacagtacatcagctacgtactactacctccgtttcataatgtaagtcattctagc

SEQ ID NO: 36646 - DNA, 870 bp, Oryza sativa
gattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgatt

SEQ ID NO: 36647 - DNA, 901 bp, Oryza sativa
tcagaaaggcttgtcagacctgctggtcttggtgtccccactggctgccttgcagatgacgctgttcgtgtgcttgcagcggcaaccggggcgtctcaggcggtcgtagcctcgctgggccagcttgacgcagcctgtggccggcaggtagcacagcagacagggcagcaccacagagagggcgcccatgaaggaccagcgggcgcagcagttggagccggaacaggagcaggggtggtcggcgcaagagccctcatcatcctcattagtacagtgatagaagataccttgcaccagacacatgcatgtgccatagttgaccagcgtctgagccgagcacaggcactcctggttgcagacccagcaggaaggtaacgtccgaggggacgcacactctttgcacttacactttccacaggcctcacacagcaagaagtgcttgtctagctctggcggagctgtcgggcctttgaggtccagcggcttacagtgaaccaccttgggctggaggcgcacagccctgggtgaggcctgctcagccacgggcggtggagccatgtgatctaggagcctctggtcggaggaagtgctgctactgctgcttacagagctgggccgaccgctgaaggagatccagtggtgagtaatatcctggtcacagcgggcaggtgtaggagccagctctggtggcccgccccggggccgcttgggacccgtggcaggggccaggctagggttgtctatgtagtcattctccacgtggctggtcttcatctggccaatgggtaaaaggtgagtgggtgctggagccggctgtggggggttttgttgtcaagaaggggttgcccaatgttaagttggaattccaagggaagttgctttgtggaaccgggggctccat

SEQ ID NO: 36648 - DNA, 826 bp, Oryza sativa
cttactcgcctattatttttctatctctttggggttggccgtaaatcctcctctcaaattagacatggggcaagatttacattatttgctcttcataagaagataagatcgaacatgtgtttctattatcttcctagcaattctaaagagttgctttgaggaatagtgagtgaatgttttgtttgcccacataactaggaacatgagatttcttggcatatgcatgaatttatgtggctttcattttctcgaaacacattagcgcatgctcaaatggcaatagatttaaaatgaagaaagcgaactatgagtaaacaaaatgaacatgtttttgatcatcttggttttgaaaagtgaaataaaaacatctatcaaataaaatacaaagctttttccactgattgttgaatattgaattagctactctcacgaccataccacataaatggtatacgtggcccaagtcttcataaatatgaatatcatcgttgaagtcattgtccaactcttcatccgtaagcatgctgcagacatagttatttgtttgatccaaagcaatggagaaatcatcttttgctggatctagctatttgtttgaatggccataatacctccactaaaactagacatggggtaaaattttcgttgtttgcgctccataagaaggaaggaagaactagttttttttgctatcttcttcgtaattctgataacaacattaggaaattgtgaataacttttttatatgccaacattagtattaatatgggttgaattcttggtgcatgcacatatttttgtgcttctaccttctcaaagcacattg
